United States Patent 10,724,096 (METHODS AND COMPOSITIONS FOR INHIBITING AND TREATING NEUROLOGICAL CONDITIONS) - sequence listing, part 137

SEQ ID NO: 2459 - DNA, 120225 bp, Homo sapiens
cgcaccgggcatgctcagtggcgcggccggctgggtggcccgcgagctgcacccggatctgctcggcggcggcgacgtgagcgcgcaggggggcggcggcctcgcctcgtctctctctctgcgcctgggtcgggtgggtgacgccgagagccagagagatgtcggatttcgacagtaacccgtttgccgacccggatctcaacaatcccttcaaggtgagcttcggccccagcatctcctgccgccgcgacgcgtcgttgtttgtgaaaacggacgagttccttcgcgcccactgcgtctgcccctcggctccccttagcagcccagagaggggcgcggggccgccgtcctccatttggggtcgcgccccggccccgtgtcactcctttgggttttggggcttgggggtggaacctcctcagctcgtgcccggtcgcccttccacacgtccccgactggtgagggtcgtgtctgcagccgggactgggcccgcgcgcccggaggggtcctggcccgcctctcaggagagaaagccgagggcaggtagagtcgccccttgccaagcaagtgtggctggcagggccgggagtcggcggaggggggcccgccctggggtggggttgtcatggggacccgaggtggcggcggcggagagctgcgtggggtgatggcagaggtgtggaggaggagagaggtgagggcaccgagtatgctgcaattaaaaaaaaaaaggttatgtttttattttttaaacttgtgttgcacccaaataccaccagtggcgctgccatcccccctctttctgttaggttgaggttgaggttattgataccaaagcaaaacttaaaaataaacatatctggaaaacaatagtgcacgtggacgacctcttccctacccagctgcttctagcaaggtaaacgatgggatattttccaagctcctagtgcgtcaccggttctctgggctatgtgaggataccatttcctacttgagctgcttttcttcttggagtcgaccttatcaaccccggcttcggaagggcttggcacagaatcctgcaaaggaaggcggctgagatattcatcgtctgcgtttaaatgaatgcaacatctaaataactctctctttgaaagtattctgaatttcctaatgagtgtaactgttagcacgtgtaatttgtttccaactgttggttgaagttgtttctcaatccccccggccatgtgcagtagtaactttaatttgcagtcacacagaataaaacaggaactctaatttgtggtcacacaagtgtcacttctggcttgttgagtttacatctttttactcctggttttatctttcattaagaatcctggaagaggaaaactatttctgctctgattattaaatgcctgataattccaaggaggattattttaatgaaatgaccctgattattattgacaactcgactcactttgtagcagtgtagaattagactcagtcactgtttcattgtccctaatgtcacttaaaattcagtacaactggcctgtacctttcagtgacatggttgcattttaagacttttttttttttcctggcagttttgtttcaattagtattggacttgcttccatgttgtggaaaatcaggtagttcttaaatggtagactttctaaagagaccgttcataaattgttaaatgggtgttattttaaaatattttgaagataaaacatcaagaaccttttagcctttcctaattcagataattcactgacgctgtttattcagcatctgacgatttggcagtgtattttctacttggtcattccatttcatggttcatttcatattaactggctctcttgttagggcaaaacattgtcttcatcttagcccagactgtccttttgtgacatctgatattgccatgacacttttcctcttctgacattcataaagttgctgtagtaattctaaacccaggagttgttttaaatattcattgtggcataacgttataaatcttttttgttcttttataagtggatgtatccaggacaatgattattcaagtttgtaaaatgcatcagggacagatcatttaggtctaaagtagacttggttgtacacatatttctgcttatgatctttctctgtttttggtgactgttatagcactgtcagtgtatctgaccctttatttttccatttatgttcacctgcccctcctcctcacaaagtatagttttatatctatattttgtctttttacttctgcttatatttatgtaaaagtgatttttgaaataacatttctgatactctacttaaatctgaaatgtttctagaatcatttgagttactttatgatcatttttctttttttactttttttttttttttgagacggagtcttgcactgttgccccggctggagtgcaatggcgtgatctcaactcaccacaacctctgcctcccgtgttcaagtgattctcctgcctcaacctccctagtagctggtattacaggtgcccgccaccacacccggctaattctttgtatttttagtagagacagggtttcattgtattggccaggctggtcttgaactcctgacctcgtgatccacctgcctcagtctcccaaagtgctgggattacgggcgggagccactgcgttcaagcagatcgtttttctttctttctttctttctttttttttttgagacggagtctccctctgtcgcccaggttggagtgcagtggcgcgatctctgctcactgcaagcgctgcctcctgggttcacaccattctcctgcctcagactcccaagtagctgggactacaggcgcccgccaccaccggctgattttttgtatttttagtagagacggggtttcaccgtgttagccaggatggtctcgatctcctgacctcgtgatctacccgccttggcctcccaaagtgctgggattacaggcgtgaaccactgggcccgacccatttttcaaatctgtttttatttgcagtatttgaagataaagctcttattttcaagtatatgatatttcgcatttggtaactatgctaatttctttttcattaaatcctatttgttttccattgcctttttcattttttagcatttcttttccttcacttttatgttaggaatacttctgcaagcatcttcgtttgtgccgtatcatgaaagtagtttgagtctattctccttatataatataaccatagtggtttacttgattttattggttcttgtaaggctatttgctggattcagttcatttttttttgttgagcccctgctttatattctagtggttttcctaggcttagtgaatggttttatgaaatttgaatggctttcattgcgcatcaagaaacttggaataactggaaatctgtagtgatcgaaaagaaaataggtgattaattatatagaagtttctgaggatccactcttgagctgttaaaatggggttttaaagctatagagggaaaaatattttctgtatagtcaacatgtaattattgaagaattgctgtatgtcctttgttttctgttgagtttattcattcaacaaatactgaagaagtgtctctgtccttatggctattagtctaacagtgagacaaatatgcttggaaaatgaatgaaaggggagagtttaataaccagcagaggtcagcaatataggctcttacaagtcagcataagagtgtatggttaagtgccggaacaagtgcagtttgttcataaaaggaagaaattagtaagtggtcagaaaattttcatgctttatgcttttgcatattaacatgataattgattgaataagatagttcattatggaaataacatttaaattaatttttaaaatatgaagagaattagaatttcacagctgggggggcaaattcttaaaatatattcagtcagatctcatagattaaaaaacaaagcccacagaggcacacttgctcattgtcttgtgcccatgtgtaggtagtgtagaattggcattagaacttaggtctcctgatttctagtccattactggtgacactgtatgtgctccctggttgcattttgataccaaaattcttgttttgtatttggaggttagagttgaggggaggcagcagaggataggattaaaaaattttggctcaagaatttgaaaagatctgggcttgatcctggctttgacactaactggttgtgagaccttggaaagttacttaacctctttcagactcagtttactcatcgcgtgttctcactcataggtgggaattgaataatgagaacacttggacacagggtggggaacatcacacaccggggtctgtcatggggtggggggaggggagaaggataggagatatacctaatgtaaatgacgagttaatgggtgcagcacaccaacatggcacatgtatacatatgtaacctgtacgttgtgcacatgtaccctagaagtattaaaaaagaaagactcagtttactattttgtaaaatagggtaatagtacattctctataggattgtaaataggattagatgaacatacatttagcatatagtaagagcttaatgtatagtggttttaattaggtactaatatttagtattaatagtaatttaagaaattctgtttaatggccaggcgcagtggctcacgcctgtaatcccagcactttgggaggctgaggcgggcgaatcacgaggtcaggagttcgagaccagcctggccaacatggtgaaaccccgtctctaccaaaaacacaaaaaattagcttggcgtggtggcgggcacctgtaatcccagctacttgggaggctgaggcaggagaattgcttgaacctgggaggtggaggttgcagtgagctgagatggcaccactgcactccagcctgggcgacagtgcgagactcatctcaaaaaaaaaaaaaaaaaaaaaaaaaagttctgtttaataatctctatatgcttagctatgaatttagtgaaatttatgttacttttggatcttctggagtgctggtagtagctgtttgactgatcatagtcaaggaatcaaagctaaaaataattaagtgctttgcctacatcaacctgctagactagaccaaggttgtctgaattctggtgctttttcacaacacgtagttcctccctaataaaatatctccatgttaaaattgagcatagtgtccattttgttttggcctcaaaaattaattttagtctattgaaattttttttagaaatggcctaaaattcagcattctcacttatgttatcttttaagttacagtaatctggtggcattgtaagagttgaaatttaaaattgaaaatgacccataattcaagtgtgttattcatttgtcttagtctgtttgggctgctgtaacaaagtatagtacctcacagtgggtaatttataaacaacagaaatttattgcccagaactctggaggctaggaagtccaagatcaaggtcccagcagattcagtgtatggtgagtccttttcctcattgatggcatcttctttgtgtcctcacatggcagaaggggatggcagctctttggggcccttttcttttcttttcttttttttttttgagacggagtcttgctctgtcgcccaggctggagtgcaggggtgccatctcggctcactgcaacctccatctcctgggttcaagcgattcccctacctcagcctcccgagtagctgggattataggtgcatgccaccatgcccagctaatttttgtatttttagtagagacggagtttcactatgttggccaggctggccttgaactcttggcctcaagtgatccacctgcctcagccttccagagtgctgggattacaggtgtatgccaccacacttggcctctgggtcctttttttaatagggatattaatcccattcttgagagcagagccctgctgacctagtcacctcacaaagtcttcaccttctgataccatcacgttggtgataggtttcagcatgtgatttttaaggaaacaaacgttcagaccttagttttcattttgtaacatcaagaatgttatccatcttatttcatttaccttgacaatgatacttacaagttgatttcactcctcccttatctgtttaaaattttgaggctgagcttgatagctcatgcttgtaatcccagtgctttgggaagccaaggcaggaggattgcttgaacccaagagtttgagaccagcctgggcaacatagtgagacttccatctctactaaaatttaaaagttagctgggtgtggtggtgcacacctgtaatctaagctacttgggaggctgaggcgggagggtgacagagtgagaccctgtctcaaaaaaaaaaaaaaaaacccaaaaaacaaacaaaaaaaagatataaaattttgagtttggagattggatagcactaggaaagtattctgaggatttcctttgtgattgtcacattttgaaaactgtcttttaacattaatctggaacatagtggttgcagtttgtgggcctgtgttattttacgttcatgtcaactgcatgaattcctgctcatttttcctcatgttaatgtttttaaaaagcacatattgagctgctgttatatttcatcaacttaagatgccatcctttgtaagatgcaccattatcttatttaccactgtctcacttatctgttgctatgtaacaatcccaaaatataatggcttaaaataacaattatttgctcacgattctgttaattgcgctagacttagctgggcaggttttttcttttttttaatgttcttttctggagtcactaaagtggcttcagtcacctggtttatggtttcagatatccttactcaagtgcctgctggttacctggagatgtcagtgggcacagcaattagctgtctttcatgtagcctctctactagtaataaatgggctttgtgcatagtagcagcagtgctcccagagggcaagagctgaatctacaaggcttcttgaatcatatgctacttctgctgtattctgttggtcaaaacaaggcacaagttcagcctagattttaaaaggagtggcaagcaataggctccacttcttgactggagacagacctatgatctgaagatacacctagtataaaatggcgaggtagtcgtaggataacttcactagacactcccattcaaatagggaaagagtgggaggcgtgtagcacctgctgatgcatagcagttctgaaatctagccaggcacgtgttgttagggtcccctacattggggacaatgaatgtttcttgattagggcccagttctgctacctcgtattggttccttcacctgttattttcttctgcttttggctccaccctctgagaggtcctttatttatttttttctataagaatgagcccttttggcagctgagtagcatttttggcctgcttcttgcccattgaaaattgggagcccagaagtttctattaattttgaactgtttctttagtccaggctgtcacaactctcttaacagtttctttttaatcttaccagagttcaaaccatgccttaaaaaccacatttgtcattctttttgagacaatcttcatttagggtgaagtgtccgttgccatggtcggtattcttcagatgtttagaaaacttttgtctaggttgagcatctcatatggccaggggaaggctgctgccataggaggctgctgtgccacgtgacaaaactaagatttgaacacagttttattttggccctgtagctttacagtcatatgagatgatggtgattatgaaaatttcgaaagtaaactgttcttgtgctgatattaccaaaagttttttttggactatgattaatatttaatagtgataaatgcagatccaaataatttattggttatttccttaatatgaaccaccagtgtgatatagttgctgaaaaatatatattggcttagtgaaattagtgatcagttccttaaaattaataatcctatagtattctgttctggtctaatagctgggtattcttctcaattgcaagtgcatatttaaagagtggtttgaaaatactaggatatgcccaaagaggacagtcagaatggtcatgggactggaatcaagttctaggaagaacaatttaagtttcaattactcagtggatttagtctacagagggctaaagggaaataggagagctcccatcagatacttaaagtgttcttaggtaagtgaataaacttgttatttgttgctttagaaaaagaatctaaggttaactggcaaagtttacttgaaggtaaaggtaaattttgtccaaacagacttttaaaaatctgctaccatggcctgacaatgctcttttggtagggcattctccagcacttgcagaaattcaagcagaagttggataacctacagagatgcctaatttcaatattgtaatgtctcagggaatagggagacccaaggagagggacagagaatgggaacaactggttggtggaatagtcaggacacacaattttttttttttttttgagacagggtctctctctgtctccaaggctggagtgcagtggcgtgatctcggctcactgcaacctccaccacgcaggttcaagcgattttcctgccttagcctcccgagtagctgggactataggcgtgcaccgccacacctggttactttttgtatttttagtagagacggggtttcaccatgttggccaggctggtctccaactcctgacctcaggtgatctgcctgccttggcctcccaaagtgctgggattacaagcgtgagtcatcgtgcccggccaggacacataacatttatcaagtaagtttgcagtgttatgggcatggtttgtggcaccccaagacaattacagtagtaacatcaagtatcactgatcacagatcaccatagcagacataatgataatgaaaaagtttgcaatattgcgaatactaccgtagtgtgacgctagagatgtgaagtgagcacatgctgttgggaaaatggtgctgcgagacttgcttgatgcagggttgccacaaaccttcaatttatttttttaaaaaaggcaatatctgtgaagtacagtgaaactaggtattcctgcattttctctgttctaatatatcgaccatattggatattggaattaagtatgatcagttcagctagagaggatgctttatgttcagagaccagctatgctctgagcctcagcttctgctgagggagcagccctcatggtagcttacacatttgtgatcatgtcctctagggtgtgacttttgccaccctggcctcagctgactgatcttaacaaaggtacttgtccaaagcagtggaatagcagttatctcactaggcttttgaaggccattttcaagaattcctgtccttcattagaggtgttttttaactagaagggatgtgccatgtcatgaagaatttcaatctctgtgaaacctggcgttcttctttctgtatatatctttaaaatattctcctgctcccagcatttggggtgacctgagtgagtctgtctgtttcaaccagaattgctaaaccgtaagtgtaaagtaacattttcttgccaaaagggtgatagagttaagcctgtatttagacctacagtttttggtggtgtagtggagtaatatacttgcaaatattgtaagatgtttttaaatcacaagggagaattttccaactttcagtgggtgtgggatataaaaggtgacatggagtttggttagatttaaccttgtaacaagtctctgagttgttcctactgaggcagtctgtaatgtcctgcagcgtttgacttcatatgtgtagactggtgtggaaaaccctgttctcctttctgtgcagaaggcttgcagatctatacccagagagcaatccagtaatccccttctccttggcatttggctttgggtgcttttcagaattagtaatgtttctttatccattgctggacacctaagttgtttctgttttttgtctattacagataatgtgtctataaacattcctgtacaagtgttctgtttgatcacctgttttaaattcttttggggatatatacctacaagtggaattgcctagtcatatggtaactctgtttaatcatggaggagcttccagacccttttccaaagtggctgtaccattttatattcctgctagcagtgtatgggtatgtagatttctctacatctttgttaacacttgctattacctgttttttattctagtcatcctagtgggggtgaagtggtatcttgtggttttgatttgcagtctgctgataactaatgatgttgagaatcttctcatttgcttattgacatttgcatattttctttgatgtctgttcagatcctttggctattcttagattgggttatttgtcttttttattattgagttataagagtttttatatatcctggatacatacctttatcaggtatgtgatttgtgactttttttcccattttctgggttgtctttttactttcttgataacatcttttgaagcacaaaagcttttaattgtgttaagttcaaattacctattttttgttgttggtgttttagtgtcacatctaagaatcctttgccaaatctgaggtaaagaaggtttatccctatgttttcttcaaagagttttatagttttagctgttgaatttaggtctatgattcattttgagttaatttttgtatttggtatgacgtaaggtcaactttattgttttgcatgtggttataatggttgttccagcaccatttgttgaaaagattgttcagtccccattgaatgatcttggcacacttgtcaaaaatctcagtattcttaatctgtgttcttgcaaaggagatgaaatattttatctgaaaaagccctcatatttcatgcaaaaatgccttgcaaatacctggtagtcaccaggttttctgagtatatattaacttgtccggcttctaaaattgccagagctacttttgcaactgcttctaagtctttgcatactttaatgcttaaaaacaaatttaatagcaggttttacacttggttttagaatgtaattatgaacacattgtcagtattaccaacttgatatgtttccttttttaaaaaataaatgcttccttaaaagaaatacttccatttattttacagaatacagttgaattaaataatacatttttgcatttaagcagaaacactggaaccccttaaactcttaaagcaaaggatatgcgtatagtgtaaagcgttatgcattttgagtattgctgaaatcaaattaggaaggagggatttgtgatagttatacattgataattataacttgattgatagtagaagaaaacacaaaacatttgaatgcaaataatttagtatatatagctattaaagatgtttgcttctcaaacacagtgaaaacaatgcatagtgtagaagcattctgtacgtaacaaatactttaagttctcactttcttcaagagaaataagctgtggctgtgttatatacatgctaacggcagccatttaatctgtggaaatcctctaatggtggttagaattcttatatgataatttgggatatatggagagcactgtcaagtgaaagtggtaggtaatgggaaaagagcatcaggagtattggccagtcatggccaggagttggtaaactaggtgtaattttaccaccatttggcactttttcttataaacaaattctaaatggtggttaagcttcccaggccagtgcttacaattgtagtatgtagcaccaaacccaagcattctctacagtaatgtacccaaagagggggaaggttcatttgtgatatcagggattcatcccctgctagcctaccatgacattgaaaagtaatcataaccttaaaaactaatagctcagatattaaaaaaaaaaattagatgtctttttcaaaaatctccaagcaagtgcacaactctccaacatttgtatgaaacctacatcacaaggtgatttgtcataacaataaaaggagttcttcttactgttatcctcacttcaagtcatgatatataatagcttctaaaatccctgagcttggtaaggcaactagtaatttgcatgtcttgtttttgtttctatttatgttaataccaaaaagtttgaaagttaataaaaaatcagagcctgctttagaaaatacaggcaacttggggtaaaataaataataattacatgttgcaacaaaagataatcttgcattattatttattttctttatctgttatttaaaaagattcccatctttttttctgattcaaaaggaaaactcctggaactattaatataagaaacataacaacaacaataactaaatactgaagttagaaaaattaatttgcctgtggtcacctagctaggaggtagagaagcaaaccttaagcagtgtggttccagagcccaccttcttaccttctcccctctgctagtggaatacaaacctctgcaaatttcacttactccttcttcttatctccctgacaccaggctaagaacacagaaatgtttgcctgcagtatgtatagtttatagaactttatcttatgaactgaactctaagtggtggtgaagttcccctgagattcagctataaacatttccattaaaaatgtttatattaaatagaaaaagcatgtattactactttcaagctttgggaatacattaatttgcatttttgcaatatgctacttaccttaggcttgctacatccaatataaaaccacagagactgactaactcaacctaaaacaagcatccctagctgtaggaaagttgctatgtaggaaagttgccacatggggataaaattacacctctattttttaaatctttcttaaggatttactatccatgtaagacatgtttatattctctaaatgttcagttctttgccctactgattgctttaagacgtaatttggtttcttgccactgctctatctttaggcatattatctttttttgactatagttcagtcagaacatgttttcatgtagttcctatagctcagatatggtactacaaaatagagtgtgaaatttggactagcaggactgcctttacctctatggtatctgataacatttggtatctaattcttttgccagtggaccatctaatttctgttattttggttagtgagtttgagtggacctaatggtataatttgaaaaacaaacaaaacatattctcagtctttatcaaccattatatttaaaatggagagcttgccagtttaataggtctttatggttatttaaaattttatataattactgtgactgcattggagattaaagtggaccaaactcaattgtctccaagagattatcatcattgaagatggagtaagagtaggttatttagtaacgtatatgaaactcccaaaaatcagatgctgtgatagtcacttgggatacaagataaagagaattttctgatgtcaaataatccacactttagttgggagatataatgtgtgataaatgctttgatgctaacaaaacaagaataacatgttcttcatattgcagaaacagaacttcctgagaagatgaggcctgaactatcttagagcctcagttcccctaaatgcagaatctgaggcagaaggcatatgtgttgttatacttcacttctctcattttataggtagggaaattcggacacagaagttaatttttctaagtttactcaggagtgacaggacttggaataaaattgtttcatggaattgcttcaataagggtaaggataatgtgagaaataatttctcatagcaattgcttaaaagtgctgctggcaatataaaatgaaacaaaaaaaggaccagacctctcaatgtcattttggctgtaagctaagaaactagaatttcttgttttctatattatttaggttcattacatttattattaattatctgcaggaaatttttaccaaattatattcacaaattatgtttgtttccaaagaaatctttctctagaatctatagagtgtactcgataatcaaacagatgcctacttaggaggtaagttggcttgggcatgattgctttagttaagtttctaatttactaaggactgatttgggtctataaacataagtgagtttcttttagatttgagtaagactgttacgacccttgccatgatatgaatttttcaaaatcatgatttattgaataattcctagtgattattaagcacgtatcacagttataaaagtttcgctaaatacacttgtcttagagtcttgttgagagatttttaatggcttttcctagctcctttttaaaaaaagtggggcatttagaaactgtagtactcttccaggtgagtgaatttgttagtatttattaaattcatatgattatagtaactctgagaattatggagtaggggaaaaattgaactcaggggagggcctctcagcttggggcatttcttgtttaatcaaattgtctagtgtaagtgtatagtcttgactgaaccaagcagagctattgaagagtattttaattacattttatagagcagcacaatatttattctttttcttctgaggaaatatagttttgaacataaatttctttattgcattttcttccaacaacttggtctttggatttagatttggatttgaatcctgaccatgtcacttattatatgactttgggcaaattactaaaacatctctaagtcagtattctcagcagtgaaagaaaagatacagaacccaagtcataaagctcttctgaggattacatgaaataattaagagtctggtatcatgctaacctagatgaattttctttctctctttgaatctgtagccttcaatttcccattggcttccttgatagaactataaatgtgcattttcttataaatgtttaatatattcaaaataataccttatatctcatgaaaaagtgtgaaggaactaatggtgaaaatctgctactgtgttatataaaaatactggactggaaagattctaatcatgtctcttgtcatcctttgtaattttgaaaaacttagaggaaatttaagtctagtttgtcatatttctttttgctaacataattgaatttgtccaaatggacaaaagtgaaattattctatgagccagtcttgaataagttgtagtgcctggatcagtactgtccaatagaaatataatttctgccgcatatgcaatttaaaattttctagtagccatattagaaaaaaaggaaaaaccaagtgaacttaattgtaatacattttattttactccatataaagaatcttatttcaacacctaatcaatataaatgttgcaggaagtcagggaccccgactgttcatacaccccctccccttttgaaatccttaataaaaacctgctggttttgaggctcaggggggcatcacggtcctaccgatatgtgatgtcatccctggtggcccagctgttaaattcctctctttatactgtctctctttatttctagccggccgacacttatgaaaaatagaacttacgttgaaatattgggggtgggttcccccgatatataaaaattagagatattttacattgttttgctaaatctttgaaattgaaaatctaatgtattttatacttttagcacatctcaattggactacattttaagagctacatgtggctggtggctaccatatttacaggtagcacaggtgtatagcacatctataaaatgcattactacaacagtagatggcttttgcacactgtaggatgtgtgtgataaacgaatgtcatttattattgccggtctaaagtttgtctccagttcttagcagtcacttaatggtgagaatttacctgtcattgcaatctgttcaataaatgatttcgccagttttcattgcccattcccaagtatttaaaaatttcaaaggcctcaaatatatctacttcacattaattatatctgtaggaatgacatgaaaaggtttgtattttgaaaagctgattctggcttattatgaagaatagattggcatggggtcggaggatagggagggaagaccagtaaggagttcattgccattgacacatgagaaatactggcagattgatctctggggtggaggagggatttttttgtttgtttgttttttgttttgcttgtgtgcattttaaagatgatcaagacttgaaatgtgaggtatcttgctgggaagaagcagttgaacatatgagagaaaaggataattgacagggtgatcctaagaaaagttaggaggagattaagcttagatatgaagaagattttcccccctaccttgggggaaaggcttcctccttgcttttccttccctcctcttttttgcttcccttttcctttttttcccctaacctctagacaatgtgggaggtaaggaaaaaaaaagctgaggcccttctgatgatctgcaggacattgtgaaaacttctgtaacacaaagtcatttctcaccagttaaaataacagtaaccatatttattggctctgtttttgctttggtgactcattggcaactctagtaattgctgttcccctcagatgctttacctgctgctctctgctcccttttctggccaccttcctataacttagcttctgtttgtcactctttctaccatggctgttgtcagcttctactgctgctgttatagttcccaattttatgtctcatattcagtctcctcaaaaatgggaataggattggattgattagcagttagtcagtaccgagttgcttctgttgggcctgccaggtttcctcgtgtccaattctaaagatagttgcctttggcacagaggccagtttcttattcttagttatgtagccaagttaatagggtcacgtgacacaaagattgggcaaagaactgcttctggttgctttccttagaacatattttaaggaaacacaggtgggtattttttgtcctattcattacctaatatttgctatactttttacaattctcagttagccataggtggagagcttttttgcttgatccttaacttactgttggtggtaatgatgatagcagcctcacctgtcacttatttgagtctttcccatgtgtggaaactatattaagcactttacatgtagtaactcatgaattatatgatacattttactgatgaaaaaactgaggtacagtgaaatacgaagtgacttgttcaaagtttatagcttcttagtaatggaactggaatttgaatacaggcagccagcaatccgtagcataacatttctgaactatgggtgaccattgtgattatcaaatttccccttaattttgaagatgagaaaatcgagagagtttgagtgacttgcctgatgtcacagtattggtcgttaccaggtgctcagtttctgattcctagactagtgcttttttctgctacagaacaagtacccaggacatagaaggttttggatactaatcatgaaacccaagcctgtgttagcagatatcatagtaagtgtatatataatgtatagctgtacaataatcatccatgtagatttttatgttattagactactatttagcttaaaaatgacatatgtacagagagaaataaacaggagactgagcttgattagttatataagttgattgagtcaatctccttatttccagcaggtgaaagcactgtctcccaggttgcatctttcaggttatgtgtggcagtgattaagaaatatccaatacaatgcatggtgtaggagagcatttggaatacagtgaaggttcattcctctggagaatttggtagagaaacctagtattgaagatataaactaattgtgctagatgtaaacttttattctcttgtttggaaaaacatttgttttcatatccatattgatattttagtgaaatatgaagtaaacactgtgaagtaacactgtaaagttaagtggcattactagagtattgacagagtagccttggcttaactaatgatgtaaagatataactctaatgtctatgcatagtcagatccacatgatatttaaattaaactctgaagaatatctttacttgctacttagaagttaataaaatacagaagccaagtatgatcctctaagtcaacaaaataagactatctgagaatcttttccttattagaaatataaattctcaggcatcatcccagacctactgaatcagaaacaaggtacgttcagagtgacgctcagcaatctggattttacaagccctccaggtgaccgcaatgcgtgctgaagtttgagaaccacagccaaagaagaaaccaaattatcagttgaaataattttattttgattatgttggagaagaagaataacattttcctgccacagttttggaattattaataaggaattaggaattggaaagtcctagtttaatttttgtctcagacatgcactaattgatcttaaggaagtttcctgaccttgtttaaggccacagcttctttctctgaaaaatagaatgatacagtctaccaggaaagatcatagcaaagattggaaataaaagtaaatgtaaaagtaaatgctgaatacttagtaggcgtcaatatcatttatcgttacttaattctttttcagttttgttgtcttctcccaggttagagactatggcttcctcaacactacagttgctaaagctaatttgaaacattaattatgtaataattcagagatatcagttctttaccttcctaaatctagtgtcattcttggtatattgtgtacatgctttaatgctttgtcatctaatactgcattaggagagtgaactcagttcacttgagaaaatgattttatcaaattgcctgttaacttctagccaggattaaatttctagaatctagaaggaaacaagtgcactttagtcactgtagttgaaagtagaaaattggaagaatgattttagtctctttggaactaagttataccttatttatttattggcttttaaaagtatttaaggtgaattttagcacactcaagataattagatgtgtgtatttgtaaagtgagagttggactcgtacttctgtggcactgagagaatgacgttgatagcgtgaatgttggctaagcaggattcatctttctgatcctacattctatctccctccttttttctttttgagttaattttgttttgtaattacgaaaacatttcatggttccaaagtagaggctataaaacaatgtaaaattaagtctagcttcgaagtctatcatttttattagtttttggattactcttccttttaaaaaacataaacacacattcatttttatctgccttttgcaccaaagcttaacatttgtttacactcctctgcaccttgcttttttcactcagcccatagcacttttatatctccttataccattttacaactgcataatgatactcagctgcatagtactttatcatgtagattgtcatggtttattcagtcatcttctatttatatatatttaggttgcttccagtcgattaattagtgtgatgcttccatgtggttacaaatagaattttgctgatatttctttggagtaggttcctagaagtgagactgtgggtcaaaggataaatgcagatgttattttgctaggtattgccaacttgccctccataaaggttgtaacagtctttattcccattagcaatgcatgagaatgcctgcttccttacagctttgtcagtagagtatgtcagacttttagattttttgctaatttgataggtgagaaatgattaaatcagtgtagtcttaatgagtgtttcttttatgaatgagattaaacatctttttatttacactttttgaactatctttatgcttattttttttcaagaagtatttattggttactactgctgctattatcttgaagaattactctttgggtatttccccacagaggtggtaataatactcgttgaagaaacagaatatcaccaggcatgtatgattaagaagaaaaaaagatcactgatcacagatcaccacaacagatatagtaaaaacatttgaaggccgggagcggtggctcatgcttgtaatcccagcactttgggaggccgaggcaggtggatcacttgaggccaggagttcaaggccagcctggccaacatggtgaaaccctgtctctactaaaaatacaaaaattagccaggcatggtgacacatgcttgtaatcccagctacttgggagactgaggcaggagaatcacttgaatgggggaggtggaggttgtggtgagctgagatcgtgctacggcacttcagcagcctgggcaacagcaagactccgtctcaaaaaaaaaaaactgtttcttgtttcaaagagttcacagtctaattgggggaagaaaaggcttgcatgaagattatcatcgttcagggaaatcgatgttgatggagctctcataagtgctgtgggaacattgagcgtggagtggagagacttgggtagagggaaggtatcagaaagatcattgcttagcatatgaggtaatatttagactgagcctgtaaggaagaggaagagattgctaggctgaccctgctgggaaaactattctaactagaggaagcaacgcaaaggaagagtataactgatatttgaggactcactggttactggttttgtagatgatggtgagggtaggcattgagactacagctggaccatctggatttgatgaaagtgcttgttgatcctaaactcacttctaaattaggttaactttagcaatgctaagttgaaaattttgattaaaatgacatctttctattttctcaattttctcactgacacatgccttctctcttgataatcttcttgctgcttacacttttgggtaaattttggaggggaaccctgggaaagtaagtggagtgatttcattccctctttcccattttactgttgagcaagactaaagcctttatgttttgtctgtgtcatacttttaatttatccttactacttgctttatgccaaatttgaggctccttattcagtaggttgtttcatttggttaagggagaaagatgtttctcatatgaatttataaggctggaaaaataggcaggctagatggttagaagccttgtatctcattttaaggaatttgtgttttgttttatagtttgtgtagagcctctaaaaatctgaaatggataaaggacagaggaaagaggttggaggaagggaatggcaagaatagctttgcatttttgagaggtaaagaatggctgtgttgaggaaggtgaattggagaaggtacatgtagactaaagagcaaaagtctccagaccagcagaagcagtatcacctgagaaccttttagaaatacaggttttcagaccccaccccagacctactgaatgagaaattctgggggttgggtgcaacactctgtgtcttatttgattttgatgcatactaaagtttgagactagaaattcgaaggttagcctacatgacagtttggaaaatgcttttcatgtgaattatgtagttgacttttgttgatgttcattatgctgagatgttcattataaatgcttttcacatgaattacatagttgattttgttgagatattcattatatgtatatactttatacacacacatacatatactacaattttgtgattcaggtttttaaaaaatttcagtaggtttttggggaacaggtggtgtttggttacatgaataagtttctcactggtgatttctgagattttggtgcacctgtcacccgagcagtgtacactgcacccattatgtagtcttttatccgtcacccaactcccaccctttcccatgagtccctgaagttcattgtatcattcttatgcctttgtgtcctcataacttaactcccacttgtgagaacatacaatgtttggttttccagtcctcagttacttcacttagaataatatctccaattccatccaggttgctgcaaatgccactatttcattccttttcatggctgagtagtattccatggtgtgtgtgtgtgtgtgtgtgtgtgtgtgtgtgtgtgtgtgtgcgccacattttctgtatccactcgttgattgatatgaatttaggctggttccatatttttgcaattgcaaattgtgctgctataaacatgcctgtgcaaatatctttttcatataatgacttcttttcctttggattgatatccaggagtgggattgctggatcaaatggtagatctgcttttagttctttaaggaatttccaccctgttttccatagtgtttgtactagtttacattttcaccaacagtgtaaaagtgttccctttttaccacatccacacaaatatctattattttttgattatggctgtttttgcaggagtaagttggtatcacattgtggttttgctttgcatttccctgataatgagtgatgttgagcatttttcatatgtttatgggccatttgtacatcttcttttaataattgtctattcatgtccttagcccactttttgatgggattgtttttttcatgctgatttgtttgagttccttgtagactctgggtattagtcctttgtcaaatgtatagattgtgaagattttctcctaccctatgtgttgtctgtttgctgattatttcttttgctgtgcacaagctttttagtttaattaagtcccatctattatccttttttgttgttgtgtttgcttttgggttcttggtcataaagtctttccttaagccagtgtcaagaaagatttttccaatgttatgttctagaaattttatggtttcaggtcttagatttaggtctttgatccatcttgagttgatttttgtataaggtgagagatgaggatccggtttcattcttctacatgtggcttgccaatgatcccagcaccatttgttgaatagggtgtcctttctccacattatgtttttgtttgcattatggaagatcagctgacggtaagtatttgggtttatttctgggttctctattccattccattggtctgtgtgcctgtttttataccagtaccatgatcttttggtgactatggccttatggtatagtttgaagtctggtaatgtaatgcctccagttttgtcctttttacttagtcttgctttggctatgtgggctcctttttggttccatatgaatttcaggattgtttttctagttctgtgaagaatgatgatggtattttgatgttaattgcattgaatttgtagattgcttttggcagtatggtcattttcacaatattgattctacccatccatgagcatgggatgtgttttcatttgtttgtgtcatctatgatttctttcagcagtgttctgtacttttccttgtagaggtctttcacctctttggttaggtatattcccaagttttttttctttttttttttttgcagctattttaaaaggggtggagttcttgatttgattcttagattggttgcttttggtatatagtatggctgctgatttgtgtacattaatgttgtacacaaatgttttagtttcctgaaactttgctgaattcatttaccagttctaggagctttttggatgaatcttgagggttttctaggtatatgatcatgtcatcagcaaacagcaatagtttgacttcctctttaccaatttggatgccctttgtttctttttcttgtctaattcctctggctaggacttccagtacggtgtagaatagaagtggtgaaagtgggcatccttgtcttgttccagttcctaagggcaatgctttcaagttttccccgttcagtgtaatgttggctgtaggtttgtcatagatggcttttattaccttaaggtatgtcccttttatgccgattttgctgaggctttttcacaaagggatactggattttgtcaaatgcttttttttgtctattgagatgatcaggtaattcttgtttttaattctgtttatgtggtgtatcacatttattgacttgtggatgttaagccatgcctgcatccctcttatgaaaccacttgattatggtggattatctttttgatatgctgttgaatttggttaactagtatttggttgaggatttttgcatctctgttcatcagggatattggcctgtagttttctttttttgttatgtcctttcctggttttggtattagggtgatactggcttcatagaatgatttagggggggattccctctctgtttttcggaatagtgccaataggattgataccaattcttcattgaatgtctgatggaattcagctgtgaatccatctggccatggacttttttttgttggtaactttttaattaccatttcagtctcactgcttgttactggtctgttcagagtttgtatttcttcctggcttattctacaagggttgtatatttccaggaatttatctgtctcctctgggttttctagtttatttgtgtaatggtgtttgtagtagccttgaatgatctttgtatttctgtggtattggttgtaatgtctcttgtttcatttctaattatgcttatttggatcttttctctttttttcttggttaatattgctaatggtctatcagttttatttctcatttcaaagaaccagctttttgattcttttatcttttgtatttgtttgtttctatttcatttagttctgctctgatcttggttacttcttttcttcttctgggtttgggtttggtttgttcttgtttctctagttccttgaggtgtgaccttagattgtctatttgtgctgtttcagactttttgatgtaagcatttaatactatgaactttccttttagcaccacttttgccatttcccagcggttttgataggttatgtcactattattgttcagttcaaataattttttaatttccatcttgatgttaatgttgacccagtcatcattcaggagcaggttatttaatttccatgtatttttatggttttaagggttccttttggagttgatttccaattttattccactgtggtctgaaagagtacttgatgtaattttgatttccttatatttgttgagactttttttgtccctatgatgtggtctatcttggggaatgttccatgtgctgatgaagagaatgtatgcttgtatgttctgcagttgttgggtagaatattctgtaaatatttgttaagtctggttgtcctagggtatagtttaaatccattgtttctttgttgactttttgtcttgatgacctgtctagtgctgtcagtagagtattgaagtcccccactattattgtgttgctgtctatctcatttcttaggtctagtagtacttgttttataaatttgggacctccagtgttaggtgcatatgtatttaggattttgatatattcctgttggactattccttttatcatcatatgatgtccctctttgtcttttttaagtgctgttgctttaaagtttgttttgtctgatataaaaataactactcttgcttgcttttggtgtccatttgcatagaatatctttttctaggcctttaccttaagtttatgtgagtacttatgtgtcaggtgagtctcttgaagacagcagatagttggtaaattcttatccattctgccattctgtatcctttaagtggagcatttaagccatttacaatcaacgttattattgagatgtgaggtactgttctattcattgtgctatttgttgcctgaataccttttcttttttcttttttttttcattgtattgttttatagggcctgtgagatttatgctttaaggagattccattttagtgtattttgaggatttgtttcaatatttagagctcgttttcatagtttttgtagtgctggctttgtagtggcaaattctctcagcatttctttgttggaaaaaagtatgtatccttcatttataaagcttagttttgctggatacagaattcttggctgataattgttttctttaaggagattaaaggtaggacctcagctcttctagcctgtaggatttctgctgagaaatctgttaatctgatagatttttctttataggttacctgatgcttttgcctcacagctctttagattctttcctttgtcttgactttagataacctgatgactatgtgcctaggtgatgatctttttatgatgaatttctcaggtgttttttgagattcttgtgtttagatgtctagatctctagcaaggccggggaagttttcctcaattattctttcaaatatgttttccaaacttttagatttctcttcttcctcgagaacaattattcttaggtttggttgttaaacataatcccaaacttgttggagacttttttcattttttaaaactctttttttctttgtctttgttggattgggttaattcgaaagccttgtgtttgagctctgaagttctttcttctactagctcgattttattgctgagactttccagtacatttttcatttctctaagtgtgtccttggtttccagaagttgcgattgttttttatttatgctatttcactgaaaatttttccattcatatcctgtatcttttttttttttttttaatttctttaagttggcctttacctttctctggtgcctccttgatcggcttaaaagttgaccttctgaattttttttctggaagtttagaggttttgtcttggtttggatccattgctggtgagctagtgtgatcttttcggggtgttaaccttgttttgtcatattactggaattgttttttttgtttcttcttatttgggtagactatatcagagggaagatctggaactcaagggctgctgttcagtttcttttgtcccacggggtgctcccttgatgtggtgctcctccctttcctgtacggatggggcttcctgagagctgaactacagtgattgttatttctcttctggatcaagccacccagtggagctactgggctctgggctgttactggggactgtctgcaaagagtcctgtgatgtgatccatcttcaggtctgtcagccatggataccaacacctgttcccgtggaggtagcagcagagtgaagtggatatttttaagtacgctggttttgtgttggttggcctccagccaggaggtggcacttttaagagcacattagctgcagtagtaggaggaggatcaggcggtggcaggaccatagagctcccaagagattatgtcctttgtcttcggcgttcctcggctgtcccaggaacctgcagcagcaatccaccttcttcaaagggtctgtggattctctcggatttcctggtatgttcctgcatagtttttggagcaagaggttcacgatgtaggtctccacgtgctgctctgtccattaagtgggagctgcaagttagtattgcctcctatctgccattttccctctcactgtgtgatttggttattttcatgaaagcctactattaaaagatttgaaaaattggaatggtgtgatcatgtattatacttggaaaagggaagacagtctatgatcatgtggtgaaataaactacagtagagatattggagtagaataaaacaagagttacttaatattgaatgctctagatgttggctgtatgacattgatttgtaatgcagtatgaaatcttcagtgggacaaactgaagctgttataaaaagggggaacgtgaactctttgtcgaggccaaaggaaatgatggtgggtctacctgagatgcttttgtgtagtcagttccacacagctattaagaggtggtctactttttatcttgatgtaatagcttgcagctgatttgaatctaactcagtttttgttttcctttgagaatgtgaaggttgtatgggtttaaatttcaccattgttgaaatgagacagtaaatctgagagccttcttttattttcctctgttagccttgctgcatgaccacaagtatagataaagcaaatggtatgtaaatatcaaaattattttttaaaggataagtaatcttttttttctcctttgaattttattctaggatccatcagttacacaagtgacaagaaatgttccaccaggacttgatgaatataatccattctcggattctagaacagtaagattattcttgcttttaaatgtttaaattgaaattcagtaggaattctattttaactatgatttcttttttagtggattgcttacacttaaataaaacaaattgttaatgttttatttagtattcagcaaacttggatttttttaatatgtagaaatattagtagtaattgaagattaccatgatgatcctagtgaaatacttcaaattttcttttatgttttacagattaaatcacaataatctttctaaaatgtaaacttttccacattacttgaaatactaggaattagagaaatatttcttggtatacatgttgtctgcctgataatgtggggtgatttttttttacgtggaaactgtgtagaactgtaccatgaatgtttgtatgattgtcatttgaattagattattctgaatagtactagccttctgttctggcagagtagaacctctggaactttacccagactaggaaagcatatttttcccctcaaaatttagtatttttttcttttaaaaatttatttattgtagagacagtgtcttctatgttccccaggctggtcttgaactcctggtctcaatccatcctcccacctcagcctcccaaagtgctgcaactacagatgtgagccgtggcgcctggcctcaaaatttagttttgatttataaaatgtacaagtatgaaaaaaatcctcataaaacagtgttttgctactctagatgtatatgagaagcatctaggggactttattacactaccccttatggccctcatctcttagagttagggcaattttttttttaaagttcttttgatgattttattgtgacctagatttgaaaactgttgaggtagattctgttgagactatctccagaatttctgtggcaaataatttcatctcctgtatttgggtctgcctccaatacttttgttaccttgccctgtgcatctcttctatttggctgttcctgagttgtgtcctttagtaagctgctaatagtaagtaaactgtttccatgagttctgagagcgcttctagaaaattatcaaatccaaggagagggtcatggaaacccccagtttatagaaagttagtcagtatgggcggcaatctgtgacttgtgactggtgacttgggacttgtgactggtgtctgaaatgagcccttaacctgtgggatctgtgatagtccaggtaggtagtatcagaattgaactgagttgtaggacatctagatggtgtccaaagagttggggaattggttggtgttgggggaaaaaaccccacacatttggtatcaatagtattgttggtaaaaacagtccaaaagtaaaagcattaaaataagaatgaacttttaaatttctctttatttcaaagccctcatttaacagcctttgcttatatgtagcaaattaattccaggttgggatcactaaagtgctctttgagcatgtaaattacaggttaaaacatgtgaaatggccaataagctgaccagttttgatatataaaaatggtggtttcatatgattcaaccttataatgaattagtgctgtgaatatgtgagagtgcaatttggtagtagttgttgaagggaaaaaaagaagagctggcaaattatattccactgtatgtagttcttttaacttgatttctaggaggtggagatgggaacaagaccatttttaaactttgtcgataaagaatgaaaagagatttttttttcttttttttttttttattgatcattcttgggtgtttctcacagagggggatttggcagggtcataggacaatagtggagggaaggtcagcagataaacaagtgaacaaaggtctctggttttcctaggcagaggaccctgcggccttccgcagtgtttgtgtccctgggtgcttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtacagaacaaaatgaaaagtctcccatgtctacttctttctacacagacatggcaaccatccgatttctcaatcttttccccacctttcccccctttccactccacaaaaccgccattgtcatcatggcccgttctcaatgagctgttgggtacacctcccagacggggtggtggccgggcagaggggctcctcacttcccagtaggggcggccgggcagaggcgcccctcacctcccggacggggcagctggccgggcggggggctgacccccccacctccctcccggacggggcggctggccgggcagaggggctcctcacttcccagtaggggcggccgggcagaggcgcccctcacctcccggacggggcggctggcctggcggggggctgacccccccacctccctcccggacagggcggctggcctggcgggggctgacccccacctccctcccggatggggtggctgcagggcggagacgctcctcacttcccagacggggtggctgccgggcggaggggctcttcacttctcagacgatgggtggccaggcagagacgctcctcacttcccacacggggtggcggccgggcagaggctgcactcccggcactttgggaggccaaggcaggcggctgggaggtggaggttgtagcgagccgagatcacgccaccgcactccagcctgggcgccattgagcactgagtgaaccagactctgtctgcaatcccggcacctcagaaggccgaggctggcggatcacttgcggttaggagctggagaccagcctggccaacacagcaaaaccccgtctccaccaaaaaaatacaaaaactggtcaggcgtggcggcgcgcgcctgcaatcgcaggcactcggcaggctgaggcaggagaatcaggcagggaggttgcagtgagccgagatggcagcagtacagtccagcttcggcttggcatcagagggagaccgtggaaagagagggagagggagagggagagagagggagagggagaccgtggaaagagagggagagggagaccgtggaaagagagggagagggagagggagagcgaaaagagatttttatataaatgtttgcaaaactttactagcaagaaatatgtttagcatttttatatagtagcagctttagattactcttatcagttgtagtattcttcatcaagctgtctactttgtgccatgtgctttgcctgtattatcttattgaattctcataatattcaaaattgatattttaaatttccgttttactaataaagatctgagacacaggtcagctagcaagtaagtggcagaactggcttattaactcgtgttatctgtaaagcttttgcctttttcattttgctagtgctatctttggagatagttgcttaagaaatagaaaaaatagtcctggtctttgaaagatttctcacctaattggtgtaattaaaaattacacagacacaaagaagatatatccagaacaaataaaacaaaatataaatcatgattgtaaatgttgagactttatagttacaaaaagattttctgaaagtgaatagtcttgagcaaggagctaggcaatagtgagaagccaatttacaatgaaacacttcccttagatttgatgaacagtgatatggtgtcagaaccaggaaaattcttatgataattgggtgcattttcctctgcactgttaacatgatggaaaacacagtttaaatattaaatattcctttgtttattatataatgtgatttcagaaatttgtccatttttgtggctgtgattattttccaaagagattaggtgtagttagataattgatttaagtggtatattagcattagaccttggtcctgttttagttaattggtggtattcgtatttttatcataggacagtgtttgtgaaactgaagcttcttgattcttgtatcaggatatggtgagctacttgaggtcaagaaggaagatcttctagcagaatgcctgagtgtgtaatcttgctaagatttagaaagttcctgccctgttcttctttttattaaaattgttttcttctgtacttaatttttctgtttgaatggaaaccttaagttatttaaggaaggctacagtatggaaatcttgagtaattatatacatatatatatatttagagatagggtctcactctgttgcccaggctgaagtgcagtggcacagtcgttgctcattgcagccccaaactcctgagctcaagcgatactcctgcctcagcttttcaagtagctaggactacaggtatactctaccacatgtggctaattattttctgtagagaagaggtcttggtaagttgcctaggctggtctcaaactcctggcctcaagtgatcctcctgccttggccacccaaagtgctgggattttaggtgtgagctacagtgcttggcctgcataattttataacttatatattcaccattttacacattcagagaaaggagttgtaacaagacactttataatatagactaagtcattttattgacagtgtcatgaaagcctcttgagcacttaaatgtggctagtctgaattgagatgtactataaaaatggaagatagtcttgagttatgaaataattttttttgtttgaattcaaaatgcatttttctactgaaattatgttgtgcatggtaggtaggttttctggcctaccctctaaaatctaatgcataaatagagaaattatccttaagaattgatgtatgtttatggggaatgtttttcttttcaattaagtaacagttgaaaatgcctattgctgcttgattctcactagttttggccactggtgagggcatttgtggctttagacagaattttttttggtgggtattgaaggtaagggatagggacacctgtgtgtgggagaagtgcagcactgctgacaaatccttagagacatttcttggggcctagtttactgtcatgtttcttttcgttagggattgtctgcctggttctttttctgtttcgctagttgatgccatatatgatttctgtcacatagagcagagagaagaaccacaagagaaaattccaggtactgacagtgtgagggggtatgcccagatggtcatctctgaccataaagggacatggataattggtttatgtaaggaagtactgcctctaacataattcaggacatgaagtagactgagtctaaagaggacctgcattttaacctaggccctgtcactaagcagttggtaactttaggcaaaccatataacctcttcgaaaatcttttttttatatatatatatattacaatgaaggcagggaggaaaatgttgagttaaataattttatctttttatagacacaggttcttgctttgttgcccaggctggtctcaaactcctggactcaagagatcctcctgtgttgtcctcccaaaatggattacaggcatgaaccaccatgcctagctgagttaaataatttagtattagtatctcttgaaaattaggactaaagcatctagctgcaggggctgactggatataattgtacatagtagtttactcatctttaatactgccaaagcattctgtatagtttaacacctgtctttattttctctcgctgtgcacttcttttttctttctctttgccttctgcttctcactgttttgtattcttggagctcattatctgtcccttctggaacctctttgtttccagtctcatttaatgatactgttgacttacatcctagtatcgttggctagaaatacccgatttgtctttggcgctaacagcttcttttcctacatctaatcagttgccacatcctgtcacttatacctgctggagatattacctgtctgttcttttcattctttcttacctgtcctaagtcaggcactcatgtgaaataatagaatgacctatctagttatctacttccagccttcctcttcaaatcgctttttatactgtgactggacttattttcctaaagcagaggtcagattaggtcatctaccttccttagaaatgattatgcattacctactcagtagtttggcatgtgagaccatccacggtttgacttcagactttttgtttttattttaatttttttcgtagaccatttttttaggctttcagaacaattgagcagaaagtacagagtaccagtttattttctccagactgtctttttactcttatcttctaatgtgccatttgctctagccaaagtctaattaactcatgaacccccgaccctattgagactgactccccattgtatagagtcaagagagactgtgggtgatcataaggcttggcttctctaggtatgtttatccccttcaatggatccagatgaatacttcacactggatatattcattttctgttgctgtgtaacaaattaccataaacttagctgtggctcaggagttcagatacagcattacttactgggtcctttgctcagggtcttacaaggctgtggtcaagctgttgtcttggctgcattctcatctagaggtttaattggggaagaatctgcttccaggcttatatagattgctggcagaatttatatcctggtggtcgtatgactgagggtcctagctttttgctggctatcagctggaggccaaccattgattgtagatgctgtccacagcctccagaggctgtatagtttcttgccccctgggcctctccaacatggccacctattttggcaagccttcagagaatcttactccagtctgcgaagagggagtttatataatgtaacgtaatcaaaggagtgacattccatcatttttaccatattctcttggttagaagcatgtcacaagtgctgtatgcactcaagggaagggcattattaaaaagatgtgaacatcaagaggtaagaatccttagggtacactttagagtctacctgccacactgggaataagatatggtatattaggactaagtgtgtttccatctgtctctttatccccatttaaaagggtcaaagtagaacccccagaatacctatccctccctatccttgaaacatagaggatttttagagtgacagaactactctatatgatactataatgatggatacatgtcattatacatttgtccaaacccatagaatgtacaacaccaagagtgaaccctaatgtaaactgtggatttgggtgatgatgatgtgtcagtgaaggttcataagttgttacaaatgtccactctggtgggagatattgataatgggggagactgtgcatgtgttgggacagggatatatggaaaatctctgtaccttcctttccatcttgctgtgaacctaaaactgcattagaaaaataaagttaaaaagttagtgaagcaggaaaccaaaaactgaccaggttcagttcagtttttgacatgttggatttgcaatttccaagacatccagatagacatgtttagtaagcagttgattgtatgaatctggtgttcatcagagaggtctgggctggaagatatacatgtgggaatcattggcccttagatggtatttaaaggtataagactggatttaatcatcaattgagtgaacatgtattgcagagaagcaagacctaaactcctggtgcactcgaatattggaggtggaagggcaggaggagaaaagaaataaaggagactgagaagaaacaacttagtgttctgaaagccaagtgaagaaagtgtttcaataatgagatagtgataaactatcaatgctgatgatagagcaaataaaattaagacagaaaatttatcattgaatttaacaatgtagaagtcattagctatcttgaatagtgtagttttggttgagtgttgggagcaaatgccttactaaagtatctttaagaagaaagaactgggaaaagcgcaaatagacaactcttcataggatttttgcagcagtggagagcagagagttttttttagggaagaggatgagagaaatgggggctggaaagggaaaggaggttaagataaagttttgttatagttacagtaatcaagacaatatggtactggcatagacatgcaaatcagtggaatagaactgacagcccagaaataaacacttaaatttatgatcaactgatttttgacaagagtgtcaggataatccaatgggaaagaataatcttttcagtaaatggtgctggaataactggatgtccacatacagtagaatgaagttggactcctacctcatcccatacataaaaattaactcaatcatagacctaaaggtaagcactaaaactatacaactcttagaagaagacataagagtaaatcttcatgacctttagttaggccatggtttcttagatgtgacactaaaaatacaaacaacaaaagagaaaacaggcaatttggacatcaaaatttaaaactttttgtccaagagcactatcaagagagtgaaaagacagctcacagaatgggaaaatgtttgcagatcacatatttgataaaagacttgtatccagaatatatattaaattattacagttcaatattaaaaagacaaccaggctgggtgtggtggctcatgtttgtaatcccagcaccttgggaagctgaggtggatggatcatttgaggtcaggagttcaagaccagcctgaccaacatggcaaaaccccatctctaccaaaaatacacaaattgaccaggagtggtgagtccacatggactcagatgtttctccttagaagataaatggccaataagcaggtgaaaaaatgttcaacattgttagctgtcaagatgcaaatgaaaaccacaaggaggataccacttcacatccattaggatatctataatcaaagagtcaggcaatagcgagtattggcaaggatgtggagaattggaaccttcacacactgctgatgggaatgtaaaatggtgcagctgctttggaaaacagtttgctagctctagacatttgttaaacgtggagttaccatatgaccctgtaattccactcttgggtacatacccaaaagaagtgaaaacatatgtccacatcaaaaccagtacacaaatgcaacccaaaattggaaatagcctatgttcctatcaactgatgaatggataaataaaacctagcataaaaataaatgaagtagttactacaacatagttgaaccttgaaaacattatgccttcaccattatcaaacaattggtgaatctatattgacacaccataatcacccaaagtctatagtttatcctagggttcacctctttttttttttttttttttttttttttgagacagggtctcactttgttgcccaggcttcagtgcagtggcatgaatgtagcttactgtgacctcaaactcctgggctcaagcaatcttcccaccttggcctcccaaaatgctaggattacaggcataagtcactgtttctggcccaaggttcactattttttttttttttttttttttttttttgagacagagtcttgctctgtcgcccaggctggagtgcgatcttggctcactgcaacctccacctcctgggttcaagtgattctcctgcctcagcctcctgagtagctgggattacaggtttgcgccaccacacccgcctacttttttgtatttttagtagagacggggtttcaccatgttggccaggctggtctcaaactcctagcttcaggtgatccccctgcctcaacctcccaaagtgttgggattacaggcgtgagccaccgcgcatggccccagcgttcattcttgatgttgtacattctgtgggtttggacaaatgtgtaatgacctatatccattattataacatcataccgaatagtttcattgccttgaaaatcctctgtgctgtacttattcatctctttgccccttcccagaccttggcaaccactaatctttttactgtctccatagttttgccttttctacagtgtcatatagttggaatcatacataatgtagcctttcagattggcttttttcacttagtagtatgcataataaggttcctctgtcttttcatggcttattagctcatttcattttaatgctgaataacatactattgtctggatgtaccacagtttatttagccatccacaaactcaaggacatcttaattactaccaaattttggcagtgatgaatagagctgctataaataactgtatgtgggttttttgtatggatgtaagttttcagttcctttggataaataccaaggaatagactgactggaccatatggtaacagtatgtttagttttgtaagaaactgccaaactatctttcaaagtctgtactattttgcactccaaccagcaatgaatgagagtttctgttgctctacatcctctccaacatttggtgttatcagtgttttggattttggccatcttaattggtgtgtagtggtgtcattgttttagtttgcatttccctgatgacatatgatgtggagcacctttttatgtgctcacttgccatctttgtatcttcttttatgaagtttctgttaaggtcttctgtccatttcttaattggtttgttattgttgaattttaagggttcttgtatcttttggataacggttctttatcagatgagaatattttctcccagtctgtggtttctgttctcattctcttgacattgtcttttgcagagtgttaattttaaggaagtccagcttttcaattatttctttcagggatcatgccattgttgttctatctaaaaagtcatcaccatacccaaggtcaattaagttttctcctgtgttatcttcgaggagttttattgttttgcattttatatttaggcctatgatccatttttaaatatttgtttgtttattttagtgacagggttttgctgtgttgctcaggctggtcttgaactcttaagctcaaggaattctgccttggcctccctagtagctgggactataggcatatgcttggcttctgtgatccattttgaattaattttgctctagcaccatttgttgaaaagactgttccattgtactgcctttgctcagttgtcaaagatcagttgactgtagttatgtgggtctatttttgggctctccattctgtcctgttggtctgtttttctaatcttttgtcaatactatactgtatggattactgttactttatagtaagtgaactctagtagtgtcaatcttccaactttattcttctctttccatattgtgttgactgttttgggttttttgcctttccacataaacttcaacattagtttgtcagtgtccacaaaataacttgctgggattttgattgggattgcgttgaatctgtagatcaagttgggaaaacctgacatcttaacagtgttgagtcttcctatccatgatcatggaatatcttttattcttctttgatttctttcatcagttttgtagtttttcacatatagaatgtatacatatttcattagatttatgcctgttttactttgggagatgtttatataaatggtatgggtttaatttgaaattcgacttgttcattgctgttacatatgaaagtgattgacttttgtatattaactttgtgttgtgcaaccttagtataatcatttattagttctaggaggtttttgtcagtaccattgaattttccatgttgatgatcttgttatctgtgaacaaagacagtcttatttgtttcttcttaatcttcataccttttttttgggtcttattacattagttaggacttctagtacaatgttgaaaaggagtggtgagaggggacatccttgcctttttcctgatcttagctggaaagcttctagtttctcaccaataagttgatgttagcattgggctttttgtaggtgttctttatcaaattgaggaagttcccctctattcctagtttgctgaatggttttattatgcatgtgtgttggattttgtgaaatgctttttctgtatctactgatatggtcatatgatttttcttttttagcctattgatgtaatgaattacattaattgaattttgaatgttgaaccagcctaggatacctggagaaaatcccacttggttttgtatgtgattcgtttcatatatggttggattcaatctgctgatattttgttggagatttttgcatccatgttcatcagagaatattgatctatagtttttttgtagtgtctttggtttgatatgagggtatttctagcctcataggatgagttaggaagtctttcttttgcttctttcctccgattgagactgtatggaattagtaaaatttctaccttaaatgattggtagaattcaccagtggatccgtctgggcctgttaccttctgttttggaaggttattacttattgaggcaatatctttaataaatagaggcctatttagatagcttgtttcttcttctgtgagttgtcacaaattgcattttccgaggcattggtccatttcttgtaggttatcagatttgtgggcatagagttatttatagtatgtcttggttatcattttaatgtctatgggaccttagtggatgtctcttccttcatttctgatattagtaatttgtgtcctcccttttgttcctccttagggagcctggctagaggcttattgagtttatcgatcttttgaaaaagccaggttttcattttgttgatttttttctattgattttctgtttttaatttcgttgacttgtgctcttatttctttccttctgcttattttggatttaatttgctcttctttttctaatttcctaacatggaaacttggagtatggattttagatctttcttatcaaatatatgcactcaatgctatacattttcctctaagccctgctttcacagcatcccacaaattttgataagatgtacatttttttttccacttagctcaaaatactttaaaatttctcttgagatttcttctctgacttgtgttatttagaagtatcttttttaatcttcacatattttgggatgtttcagttttcttcttgttattgatttctcatttaattcccttgtttgagagtaaatactatatttgtttttttttttttaatttgttaaggtgttttttatgttacagaatgtcttctgtcttggtgagtgttccatgtgaacttgagaagaatgtgtttctgctgttggatgaagtggttgataggtgttaattatatccaatcaacggatggtattgttgaattcagctatgttcttaatgatttcttgcctgctagatcggtccgtttctgatttgaggggtgtttgagtctacaactataatagtagtttcatctgtttctccttgcagttccattagtttttgcctcttgtagtttgatgctctgtcattaggtggatgtacattaaggaatgctatgtcttggagaattgacccatgtgtcattatttaatgcccttctttatctctaataactttctttgctttgagtctgctttttctgaaattttttatcagtgttagcatggtatatttttctgtttacttctaatccatatgtttatttatatttaaagtgggtttcttatagacaacatatagttgggtcttgttttttgatcatctcataatcttttaattagtgccttgagaccgttgatgttcaaagtgattattgatttagttgggttaatatatatcatattgattgctgttttctgtttgttgcccttgttctttttgtcttctactcttggtggtttgttttgttttattttgagactgtttcactctgtcacccaggctggagtgcagtggctcaatccccgatctcagctcactgcaacctccgccttccaggttcaagctgtttcagccttctgagtagctgcgattacaggcacctgccatcacacctggctaatttttgtatttttcgtagaggcagggtttcaccatgttggccatgctggtctcaaactcctggcctcaagtgatctgcctgcctcggcctcccaaagtgctgggattacaggcatgagccattgtgcccagccctcttggtgagtttaatagaacattttatatgattataatttatctccttcctggttgccctagagtttgcaatatacatttataacaaatccagacctacatacaaataactatactgtttcacaggtagtgtgagtgccttataataagaatatgattcctccctcccatctttgtatcattgctgtcattcatttcgctgatatataagcatatataaacatatatatgtatatatatacacacacaagatatttgcagaagaacccataattgaatacattgttgctgttattattttgaaccaactgttttctcttagaccatttgagaataagaaaaataagacgtggtgtctcatgcatgtaatcagctttgggaggccaaggtgggaggattgcctgaggccagggattcaaaaccagcctaggcaatgtagtgagatcacattgagatcctgtctctacaaaacaaaacaaaacaaaacaaagaacaaaaattagccaggcatcagcctggtgcagtggctcacgcctttaatcccagcgttttgggaggctgaggcgggcgaatcacttgaggtcaggagtttgataccagcctggccaacatggtgaaaccctgtctctaccaaaaatacaaaattagctgggtgtggtggcatgcgcctgtagtcccagctacttgggaggctgaggcaggagaattgtttgaacccaggaggcggaggctgcagtgagccaagatcgtgcctaggggacagagtgagactctgtctcaaaaaaaaaaaaaaaaaaaaaaaaaaaaaagggatggtgggcatgcctgttgtcctagctactcaggaggcagaaggattgcttgagctcaggagtttgaggctacaatttgctgtgatcatgctactgcactccaacctgagtgacaaagtgagaccctgtctcaaaaaaaaaaaaaaaaaagggttttaaacttcgtctatttcttgtatgctcatgcttgctttatgtggatccaagtttctgacctatattattctcattctctctacagaacttacatatatttaaaaatatttaatatttcactgcagccttgacctcccaggtggatgggactacaggcatgtgccaccaaggctaatttttttatttttttagagacggggtctcactatattgcccagcctggtctcaaacgcctgggctcaaacagtcctcttgcctcagcctcccaaagtgtcgggattataggtgtgagccactgtgcccagccttacaggttttttttttttttttttttgctaggctgacatgatgtactgggtaaaaggaattgctgtaattaggtctttagttgtgtggtggcaaggtgttcagaagcactctatagtcctgtgattaggtctcagtcttttattgagtctatggacttcacaaatgtttcgaagttgttttcttctttcttaggtgggacagaatggctagagttggctgcagttgggtatttcccttcccccaggtgagttaggctctgataagccccaacaggttaggcactggttaaatagtttctcctgaggggaggccttgttaagaacagagtgctctggtgtttttcaaaaatggttcttccccactccacttgttagaagaaggaggggatttttttctccatgtactatgagttgagttcctggagataaaacaaaagtgcgaggggactcaccacatgaatgggttcccctgtagattttaactctcagtgttgtctatgctgagcctccaacaatttcttaattacagttaaggtttttctaccccagtaatggttcttgcagtggtttctgctagagagcttttgctctggcaaattgttactccttgtattgacctatttctgcagtcatgggtcagcaatttgccctgtgtcctcacatctcttaacgatccagaatgaattactgattttttagtttgttcatcttttcacttgttgttagggtggagtggtaaattctaaactccttatacatgaaactggaaactgaaagtcccctttacttgctttaatttttttcagagtaaaaaccatgagtctttaaaatagcctttaatctgatccctaatattctttgttcttcatcttgtcgcaccctctccctgtgtattcctgtctagcacgctgattcctcacatattccatgcattctcctgactttgcactggttgtcacctctgcttaaaatggtcttccccccaggtagataatctgcaagacttactttctcacctccttgaagtctttgttcaaatattgacttccccaatcacctttataaacttattctgtcagcctgtactcatgacctcttcactctggtctttttgttgttgtcccgtaaaatgattgccttttaagatgctctagaatgtatttgttcaatatgtgtattgtttatcttctgttgctggaatgtagctttatgggagtaggggtgtttgcctattttgttcattaatgtatcccaattcctgtatatgtttgtggcccattgtagttgaccaatgaatgtttgatgaatgtatgaatgaatggatatggtcacatttgttcttttatgttcctttatctatttgaaaactcccatactggtatatttcttctttcctattacacacgtccttccccagacaattatcctaatcttcaaaaaccttattttaaagtgattagtctaataaagttatgtctgtttgtcctgattctgagattagtatgtgtaaactttcagcactcttaataacaagggaatctgtgttaagcatagccacagtcatttctttgctgaatcaacggctgttaaagtgagtgaaagctgcagaaagtttcaggatccttttggcagtttaagtgaaagaaataaaacagtgttttatagaagctgtaaactttgttgccttagaggggagttctcaaattttaaggtgtctaagaatcaccatggggagtttgttaaaaatggtagtttgttaaaagtacaaattctctcttctaatccctaaggttctgaatcaataggttcatagaagggcccagagtttgcattttcagtaagtacctggggtttctgatacgggatgtctgtgaatataaattaagtaacattcttttagaccctacatacactttggctgttttttggtttagagatggaagagaaagagctggagaaagcaagaagaaatttctggaataggtgtttagaatatggaagaaaacctggaaggagaaaatatatttgcttatgcatgacaaagacaactcatgaacttcctgtgccttgaagagaccttgggtagtcgtttatttaaaatgaatcacccttggaatttccagtgcagagagcttactatattatagagcagtccatccactattgtataatcatgattattataatgttcttaattctcttgagccaatatatttttctataatttttatctgtttgtcctagccaaactgaagaggcaaatgtagtaaggtaattcgtgttaaaatataaaataattataacccttatttttctaagagatatttaagcatgtagtctattcccagtttgttaaatttcatccatccatgggatgaggatatacagccttgctctgccagactttgtttttgattctgcctccggggtcagttctctcattctcttccaggtctgttccagttttgttctttgtctccaactctgcacactctgcttttctcagtacttcaagtttttcccaggtacagccaaagtagtggcagacacagttctaggtttgtcaggagaggagcttactgtagtacatttggttgcagtagagtattttctttttccctgccaataggttggctttccttctgtatttggagttttggtccatgtaaaatgaagatgatatactatggagtgcccagtgagatagagaggtcttcctttttgcatctcaaatttttcttctcctgtcatttttttcttgttgttatccctaaagtagaagttctgttagtgagggtctattggtagtacttttttcagtatttattgttattatttcatcttggttctcaaacagctgatctgactggttttagagttctgcattatcagttattttctctcagccatttagcacattatacttgagcttgcattgttgctgttgagaagctagctcagtcttaggatcttaggtgaaaggatacacagtggtttataggtgaccttcctttgtgtgggaattatccttttttttttcttgcagtttttaaggtttgctctttcattgtgatgtatctgagtgttactatttttaaaatttggcttgtgttttagggttttgaatctgagaattagtgtcttcatatactgtttaaacattgactctcccttatcctgtttttttttttttcccctctggacctcttaattgtatgttagaccttctcaatcatcatgtcttataatttctcatatttacattttttggatctctgtgctgtgtcattagattcacttccattcctttattatttcatctttgtgtagtttgctgttcaacttgtctattaaatttataatttaaaagtcattattatagttttcatttctagaatttcatttaagaagctggccaattctgatagtctcttgttagtcaaacttgtattaccctcttaattctttattaaacacacctgttttgtatctgataattcaaatatattcaggtcttattttgtaatttgctatttctgtggacccttgtggtttgtttcctcatagatttaaatcataagccaaagttacttggaactttatctgtgttaatttcttgaagcctggtgtattagtcagttctcatgctgctaataaagacatacccgagaccaggtaatttataaagaaaaagagttttaatggacttgcagttctacatggctgaggaggcctcacaatcatggtgggaggtgaaggacaagcaaaggcacgtgttacctggtggcaggcaagagagcatgtgtaggggaagtcccctttataaaaccatcaggtatcatgagatttattcactgtcatgagaacagcataggaaagacccacccccatgattcagttacctcccaccaggcccctcccatgacacgtgggaattatgggagctgcaattcaagatgagatttgggtggggacacagccaaacccatgtcacctggttttaatgtttgttcctctacttttgccaaatgcctgaggccactaccagcctgagatccttttcactgaaaattggatgttggattatcttgtccatgtgggtagtggaattctgacctgagatctgcaagttggtaggtttttggtttttgttttgttttgttttgttttggagacaggatcttgctctgttgcctaggctggagtgtagtggcatgatcttggctcgttacaacctgcctcctgggctcaagctatccttctgcctcagcctcctaagtaactgggactccaggcatgtgccaccacacttggtaaatttttaaattttggtgtagagctgaggtctcactatattgcccaggctggtctcaatctcctggccttgagtgatccttccacctcagcctcccaaagtgctgagattacaggtgtgagccaccatgcctggccattggtaggtttatgactgggaattctcagggaagatttcccttttttcctcccttctacatccagaattaaggacaagacatggaggtattcccatcatttatttttcttctgtgaaattgcttttttcttactcatccactgaaacggtcattttttagagactcctggctttatgcagggatcttgtcaatcccttaccatccttgtaccagctccaaagctttgtctctagtttactagtgcagatggatcactagtaatttggtgaatggtttggtatcaaggctgttctttctttggatttagtagttcctgctttcttgcctcccaggatttcttgttgcgttagttgtgtatttacaatattatttaaataaaatttggtctagtattttaggtattatgtactagaaggggatctctacatatgggtgatctgctatgttttaagaagtgaaagtcttgagtggcttgttttatatttatatatatatagatagagacagagacacatatagatacacacacacacacacacacacacacgcatacacgctcatctgtcccagagtgaaaagttggaaatgaactgggaaccatcatcacaataggtatttagtagtgatgaaaagaggtcgtcctccagaattctacttggcttgagttggctaatccactatgttgtggctgaagaaaatactgggtctttaacatctacagatgtgaagaaattatcaggataatagctattagatttatatcagtgctattagagatttgtggctctccaacatttctcatcattgctatactgcaagcaactatggccttaaatatatcgcattaccagctctaaccctaccttcatccttatctactagtttattatacttaatacttccttggttatttaaagtaatacagcatttatagcaaggtttcagctgggtacattcttgggtaatttcttctgtgtttttcctgaaatatgctgctgccaggctaactttgccagacattttattagtatttggtcattgttttattgttgctgcttattacaccaagaagacagggctttggggcgatgcttttggttttttgctgggggaagatctttattactgatcaagatagcagttctaaatgccatgtgaacttgggacaatatatgtgagaattatatctcacttaaggtgccgggaactctttttcttttttttttttttccaactttttaagttctggggtacatgtgcaggatgtgtaggtttgttacataggcaaacgtgtgccatggtggtttgttgcacagatcaacccatcacctaagtattaaacccagcattcactaactattcttcctgatgctctccctttgcccacccctaatccccatccccatctcccgacaggccccagtgtgtgtttttccccaccatgtgtccatgtgttctcaatgttcagttcccacttatgagtgggaacatgctgtttggttttctgttcctgcattagtttgctgaggaggctggcttccagcttcatcgatatccctgctaaggacatgatcacattcctttttatggctgcatggtattccatggtgtatatgtaccacattttctttatccagtctatgattgatgggcatttagattgattccatgtctttgctattgtgaatagtgctgcagtaaacataggtgtgcatgtgtctttgtagtagaatgatttatattcctttgggtatttacacagtaatgggattgctgggtcaaatcgtatttctgcctctagatctttgaggaaccaccacactgtcttccacagtggttgaactaattgacactcacaccaacagtataaaagcattactttttctccataacctcgccagcatctgttgttttctgactttttaatagttaccattctgactggtgtgagacggtatctcattgtggttttgatttgcatttttctaatgatcagtgatgttgagcttttttttcatatgttggccccatgaatgtcttcttttgacaagtgtctgttcatgtcctttgcctgctttttaatggcatttttttcttgtaaataagtttaagttccttatagactctggttattagacttttgtcagatggatagattgcaaaaattttctcccgttttgtaggttttctgttcactctgctgatagtttgttttgctgtgcagaagctctttagtttaattagatctcatttgtcaatttttgcttttgttgcattgcttttgtagtttttgtcatgaaatctttgcccgtgcctacaccctgaatggtattgcctaggttttcttctacagtttttatagttttgggttttacatttaaaggaccatacttttctaattggagaagttagcattgattagccttagtttttctgcccattaataagagatactgggtgtgggggaacaagcatttggaaaagagaatttgtgattattttagtgacaaaagattgtaatggagattttaaaaatacaagaaaatgctcttaatcccactgcccagaaataatccctattaacattttgatatattttcatcttattttaaaataggaagttcgtgtcatgttgtatatacagctttgtttcataactttttttaatcacttatttgtccaagcttcctcatcttattgcactcttttagaacttttaaatagctgtattgtatactttcctatagctgtatcagtttaaccatttcttctgttgtgttggacatttggggttttgcttttgtaaataaagctgtagtgagcattcttggcatacatacatttgcaaatatcttggattatttccataggatatttttaaagaccagatattcatagtacatagggtataaatacttctatggctcttgaaacataatgccaaattgtgctccaggattgctacatgtactagtgtataatcccacttttcagtgtgtgagaatatctattttaccacatctttctcaaaatgtggtaatcctatgataatcattttaaaaataattatgtaaaatgtgcatttctttgattactaatgaggttgaaattttttgtatgtttatttttcttttgtattttgtaagctgcctgttcagagtttttaaaaatgcagtttttttcagtaacatgtttatctgataattttgtattgatttgtacctagtgaaatgtattaactaattgttgtatatgttgcttattatttagattttgccatctaatcttgattatgaatgctttatatcatcaaatttctaaatttttatgtggtcaaatatattaccttttcattatgatttctttcccctcatcttttctgaatgtttagaatgacttttcttcacgccaagagcagataatgccctatagtctatagagtgtattttagtgtctttatagttgttttttgtcttgttttgttttttttttaacattcaatttttaatccatttggaattcttttgagatacagggattttgtttttcctcccccaatttaaataattctcccaacagcatttgctgacaaccttttgtatttccattgacttgaaatgctatcttgatcagtgctttaattttcatatgcaccaccattgtgtatattgtgtaaattccaattttggtattgtcagagtttgtttttctatctcatggttttgaaatgatatatgattgtttttgcacttcttgattactagtgctgttacacctcttttcacatgtttattgacctctttctattgcttgttcagatcttttgctagtttttcgattagtttgtattttcatggatttgtaacaattctttatatattctgggtagcaattttctgttatatgcattacaactatcttttcctagtccatgatttgactttttactttttgtaaatttcagtgtaattaaattcgtcaattttgtgtggtgtgtgttttccattcttaatttgacagatacttactgagcatctactgtttcagggactattttgggtacttgggataggtcataaacaaaatacacagtatttctagagttcatattctagaagctcaagaaatattcataaaaatattcacatgtatttttccctgaaagtgtttaagttttgctttttcagttttagatcatgaatttacctcgaattaatctttgtatatgatgcgaagtaagaaatgtttttttttcctatatgagtaaccagttatccaggcaccgtttattgattaacacattgtttcttcactgttttgtagtgacacctctgttagatatcaagtttctgcatttgtgtgggtttgtttctgtgtctgttttgtttattggtacacttctctgtccttgcatctgtattacactcttaattactgtggttctataataagccttgatatcataggtcttcctactttgtttttcttcaaaatggtttgacctgtttttagttcctgccttttttttttttttgagatagactctcactctgtagcccaagttggagtgcagtggcataatctgggctcactgcaacctctgcctcccaggctcaagcgattctcatgcctcagcctctccagtagctgggactacaggtgcacaccaccatgcctgtctaattttttgtattttagtagagacgaggtttcaccatgttgcccagggtggtctcgaactcctgagctcaggcgatctgcccaccttggcctcccaaagtgctgggattacaagtgtgagcctctgcacccagccggttcttgccttttgtatatgcattttagaatcagctgaactacagttatatctttggttatgcgtggcttccttttcagggctgctgttagctgtgtcagagtaaaatcctgctatatattggtggtgtcttctggttttaatagttcttaagatccttgaacgtccttgtgcagcttctttcttttttatatttttcttatttatgacctcccccttccctccctcttctctttctttcctttcttcttttcttttctgttactgtttttgcttctattgttcttttcatgttcccatccttgttttttgtttttttcttatggtcattctaaagagtactttaaaaatatatttttattaaagtagtatatggtgcatgtgtcgagggaagcaaataatacagaggcatataaaacaacaggtgcaagtccgtctgatatcaggtggccgagacttcccagatattttatgggggcatgtataaatctgtgtctgttgaaaaaaaggtcatatacagactgttctgtagcttgctttattttttaatttaatttttattttattattattattattttttgagatggagtcttgctctgtctcccaggctggagtgcagtggtgcgatcttagctcactgcaacctccgcctcccgggttcaagcgattcttctgcctcagcctcccaagtagctgggactgcaggcgcccgccgccacacctggctaatttttgtatttttaggagagatggggtttcaccatattggccaggctggtctcgaactcctgactttgtgatccacttgcctcggcctcccaaagtactgggatcacaagcataggacactgcgcccggccagcttgctttattttatttagtattttaaaagacattcttctatcgctaatttattctcatggctgcattgtatgtatatacagtaatttaaccaatcccccattgatggacttgtagatgtctacttcctgatcttgcagctttcagacactactgatcctcactggcaaagtggaagttgggtaatttattttctctctccttacgccttcccttttactcttttaaatttagtggggttctaccaagaactttcctgtatactcttcagagcactggcatgtagctttctcaagagggaagagttggcagtaaaccttggtgtagttcttttgtctggttctatctgtattttactattaaactcaaaagttctttttttttttttttgagatggagtcttgctctgttgcccaggctggagtgcagtggtacagtcttggctcactgcagcctccacctccccggttcaagtgattctcctgcctcagcctcccaagtagctgggattacaggtgcccgccaccacacccggctaatttttgtatttttagtagagacggggtttcaccatattggccaggctggtcttgaactcctgacttaggtgatctacacgccttggcctcccaaagtgctgggattacaggcatgagccaccatgcctggcctctattaacatacggtatcctggaggagagtgtttgtcatatagtgttataagtagcagtctgattgtagagttgaaaaatgaatgagttggagaaaatggagatggagaatttaagcagctctttgccacacacttgactatgagagagcagggaatgaagagatgcagattttgggatttttcattttattggtgttatactttttgaaagaagttaaagttggatctctgtgttacataattttccttctcttaatcctcctagcctccaccaggcggtgtgaagatgcctaatgtacccaatacacaaccagcaataatgaaaccaacagaggaacatccagcttatacacagattgcaaaggttagttcatgttagttgtataaattcatattggccattataatatcaataacatttgctttcagagcaaaataaatctttatatggttacatttctgttgcttaatttttaactcactttcaagtctggatttgctgtcttgtcacccttcaaatactcattcctctttttgtcagcttataccatttgctttattccattattaggaattattgaatttatgtatcatctcagtggataaatttttattgcctttggtcccactttttaatgcacactaccattaaggtaaaaatgatggaataatagatattattgggagagcgttgcaatggtaaaataacagtgttaggaggtagaagatggcaaaaatctgagaagaaaggagattaataagatgcctgatagcatgtaagggcaaattgagttataaagaatttcttaatcacatcttttgacctcattctcctataacatttaagatattagaaaatattcttgcattggtggccttatatatcatttaatctgattaataggagccaattcagttgcccttttttctattgttcattttcctcaactgttcccattgcctctgttcttcactcatttaggcatagaggtcatcttaatttcattttccagattacctaaagattgtgactacttttactaagagaagttttcctctcctaatggacccaacattcccactgagagtttctggaacccaaagaccaaatggaccaaatatcctcataatattttctgtaactatgatcttcagtaaattcctgtactttggaagtgtgtttgaattaggtttctctcatagtagagaagtaggagttagcatataaatgttaaagtattttatacttctgacagtctattcacatattgatattttttatttaggaacatgcattggcccaagctgaacttcttaagcgccaggaagaactagaaagaaaagccgcagaattagatcgtcgggaacgagaaatgcaaaacctcagtcaacatggtagtatccaaagaaatttgaaataaaaataacttttaaatactttacattatgtctatactagctcctaggtcatttggcctgtggataaaaccctaccctgttttcctgttctaacaaggagatcagacacagcagattgcctgtttgatactctgtagccttctaatcttggctgatttgcatagtcttttgttgatagcttagaacagtgttagcctcatcacacagaaaatgaatgtgaatatgataatttttgcttactctgaggccaggagcctttgattctgcagttaggccctccttggttctgtggactctttatgagtacatttgcatgtaccctacatttgacttttacctgatttattcaggttaatttcagattatctgccccagtcctcgcaagtattttgtcaaatcatgttagaaaaattggaagcctaaggtattcatatgatgccaaagaaataagtggtgaattgttgcagtgaattctattaagtttgtgcctgccaaagcacttcaaaggagtctcttagggaaagctagcagtctctgagtaagaagagataaaagagctagataagtcattgttaggatgtctgggatagtgatgcaatgcaaagctagaacaataacaatatacagaactatttctttttaacttagaatgtgtaagtctagggcctcatgagaacacatttatcctgggtcattttcttgcttgcagcatcagaggtagcatctatagaaggagaaactaaaagttgaactgggaccaatgtttctgaagtacctgtaactaaaatccatcctatttctttagcactggcaaatacaaactatttctatgagagttatgttagtaaagacagtaacaaagagtaggaaattaacaattagactgcagtatgttagcacattttagtacttttcccctcttaactcatacttaaatcatcaatacaatcctgtgaggggtgatagagtttttattctcattttacagatatggaaactaaggctcggaggagagagtaagttgcccaaggcgaccttgccagtaagtggctagccacttctggttccagagcctctcttctttacgagtattcactgccgcttctcaaatagtatgagattggtatgagaaatgaactatatgaaatttgaatagtatgataaatggaacacaggagactcattggggagaatcagaaataggttattgttctttctataaaaattaccctggtctgggaaaagtaggtaaaattgaatttttaaaaactgtgggatataacatctaaaatcgggaaatggccttaggtgctgtttttacccgctattttcatgttttgacttctttattttaattttttatttcccccaccatttctcaagtcttatttttaatctggtttctttatgtagacacatttttttccctttacagtttgaatttgtttttctctgcatttttaaaggttctataattcttcagcttccttatcatgactgtttcatgttttctttgttgtagggttttcgtacatgtatcttttggatattattttttcccagattttgagtattctaaatttgattctttggtattggtttaatcttggacttaacagaaaacttgaaaaaattagaagctagtctttctccacttgagataggaattataacagaattatatttgaagatttaagatgctgaggagaaaattgaagtttaaaaactggatggccctttcatgccagccagactctttggactgtgaaataaatctgttttagggtagaagcactggatatgtgctttctttttgtttcttgttttttctgtacataaatggttcctgctaaacatggtatgatatgacactggaaaattattttactatctaatgtgctctaaggtgatgatattctgagaaaattttttaaaaatctaaagcttgtctttcagagttctaggaatacaaagatatagttctacagtttttctgaacttttgttaacataatagagtttttctttattatgaaacaaaaaataatatcacatttgttataatataaataaccttttctttttctaaaaaaaatttacaggtagaaaaaataattggccacctcttcctagcaattttcctgtcggaccttgtttctatcaggatttttctgtagacattcctgtagaattccaaaagacagtaaagcttatgtactacttgtggatgtgtgagtatacaacaatttacatctttgcttagaatttgtatttttgttgtcaaaatccgcatttttatttcaaggatagtatagcaaaccagtcttctttttctatagataaagcttaataatcatgatttcagagtgaaacatatcctatttaggtacttcagaattgtactatatgtgacaatgtaagtccttggctgagaaaaacttgtatgttgagaactggcattcttttgaggaaaagacaacttctctgtcatgtgggtaaaattttataagattctttttccttgaaagatgttatctagacatgatttgcttggaaaaaatagtgcatactaattttatgcagaggaaggccatttaaaagaattctgttaaatgtaggcgttttagctatttttaaaagggcataaaattattacataaactaagtgttctttttatagctttgagtacagtttactttttgttttcaattgcgatacttttattattgaaagtgcttaattaatacaggacattttgttgaacggaacattagaatatacgtttggggctctgatgcttacatcactttgagtataataactcatggaatactgaaacaaaatgtcaagccgttaacagttttactctgtgtgcacagacctcccacttactctctgtttcatttttattccaaacagtagtctcagcctcattttgataccctgtcagaaggggaggtagctattgagggttctcacatgcacaacatctgggttaatggataatttgtagggtacattcttgatggaggaaatttacttgtttttactttatgattaatgagactaccacccttcccttaatggatgagataattttccttaaaatcttttaggagcattcttcatgtatgtcaagttgttttggaatgtgagaagtgtttcctaatggatagtctatttttaactcttcattagtatttttcgagatattcttgatctaatatcttttgctgaatcctcagtgtcagtagtatatatttttaatattaaatgtctgattccatatatgtacatgctaaccaactcttatttaatcaatataatatatgcatttatattttatatatgtttatttttttaaatgggcagaaattgtcctagcattttattttattttgagacagagtcttgctttgttgcctaggctggagtgcaatggcacgatcttggttcactgcaacctccgcttcccgggttcaagtgattctcgtgcctcagcctcctgagtagctgggactacaggcacatgccatcacgcctggctaatttttgtattttcatctatacttggaataattttcatgaactttaaagtgtaattatacatatattttatctttctttcagtggattaggaaataacctaatttgaaaattgaaatttaagttagaatgttcttaaggtctaaaactttttaaggcagctggatgctatttaatgctgcagagtaataattttctatttcacaatcttcaattctgtttttaagatcttaacacaaccacccttattttgaggccaagggttttgagtaaatttattatgagcaagcattcctgagagttaaaaatcctaatgggactagagtaatgagtgagagtgtctcttttgtgatagaattgaatgggattttaaagtgggaaaagctcctgcatttctatggctgaaaaattgaagcttacagaggttgagtgattggcttaatattagatgactacaacctaagtgacttcatctggagctctttttaaaaaaaaacaaaaaacaaaactctagagcttgtttacttatctggtgggttaggtaagagcaaatttaggcatcccagaatgtgtgtgtgtatcctgtttcattaattattaacttatttgatttgtaaagaaatcttaaagtttgagatttaaaaaactagatccaataggttttcccagttgttaattttaattcaagtaatttgttggcatatttttattgatttgataatttacattaaacatcattttagcttatataagaatgtacttactataataaattcagcctgtgaataaatttttaaaaaatcctttgaaacagttattaattacaatgggtcaaagtagttctttaggatcatggtatagttagatgttactcagattttttgtttttggtctgtcagggaaagcaattattaacagcatatgatgaatttgtcaacatctatttgtgttaaccaaaagaaaagcctgccacagtagctaaaatgtatcatgttgtgtgggggagtgaggaggggacttaataaatttaatcctctaccaaaacgcaagtttttttcaggattttacaaatggacagctctatgaagttgaatgaacaatccttatacattgactatatagtcactagaaattgctactgtattagtatttttagtccagtgtttagtctgcagccccattctgtaaagatatggtttttcctcctaagtcctgggtcttttcctggcagacactgcttttcttcttgggcttcagatcaagagacatcacgtttccttttcgggaagaagcccttaaggtagtgcgcctctggtttagctacatcattgcctgtgaggaggagagggccaacagaatttttgccaaacagtacatgtattaagactcgctttcctgtgtatactctgttttcaaatcaaatatgtaagatacaacagtgttttgaaaaatataaatggaaacatggagtagaatacatttgctcttaggaagtatttttttatttacaattttttgttggatgaattcataaattgaatgtaaatctttctttttctattttgttttctgattccacagtccatgcagtaacactgtttctaaatatcttcggatgcttggcttggttttgtgttgattctgcaagagcggttgattttggattgagtatcctgtggttcttgctttttactccttgttcatttgtctgttggtacagaccactttatggagctttcaggtaaaatgtgtgtactttaaaatacactctttaaaacctgtgaagtaaataattcgtagtatacattaaagggaaaattgatgcattttcattaaaaaattcttgtattgttgtgtaacataccttcaggaaagttcaatatagcatgcctgtgtattcattggattttgtaagtcataaaattccatttttttctcccatttgataaaagaccaaacatgaaaattgatggaaaaataagaacagtcttagaagttaatatttataaaatattctcttccatatgttatacttcaaggaaaattttgctgtttgcccaccccacctcccaaatcaaaatcccaattggtgcttatggtttttttttttttaaattaacctaagtaaggtaaatatacatgcaatatttaaaatgagccatttgcacctagcaacttggattattttctttataaatccattttaggttttttcaaaggcagcaccattttaaaaacgatttatgctactaggttaagtataatgctttacatagtatattttaatcagtggttagggttaacatttccttagcgcatgttctgtgggatattaataggtgctgggggagaaaaaaagagctcataagcttagtaaatttgggaacagctggataataaggttaagcaagtttcttcatttcaggatttcttacactctttaagtacctagtatgatttgtgccttatgacttgaccatgcaaccattatttttctgtggagtactttgttggactattgctttaagaagtattgggaaatactgattgaaatgatagtcctatatgggttcatatatttaatagtttttttaaactcatttttatttgagtaaattcttgtgaataaccatttcaactctcgtgaataaggggtaacattactaggatatatgcgtgtgttgtttaaaggatatattagggaaattagaggcccacatttaagtgttcagtatgttttgccattgcaacctaaaatctctttagttaaccagaatgtgtaacacacgcgcgcgcgcacacacacacacacacacacacacacacacacacagagttagaaacccagatctgtaaacagatgagggaaaaacagaagagaacaggagatgggagaacattagggaatttggagagaaaatgtatcagacaatgaagaagtaaattattacttagaaatggcataaagagaagaaatgatgagaggaggagtgaagggaagaaatgatgggagaagggaaaggagaaaagaacctttggatacattgaaatatgggagattggttgccaaggaacggggagagcttctcctgtagagatgggttggagaggaatgaaaggaacatagttactccttgcatgatctgagttattgctgttattttcttcgttatctaagcatggctcacaaggctttttctgttttttgttagtttgttttgttttgttttttttggacatctaacctctgcctaatgacctccatcacattaccaatatgttatcgatctgtgatgatgctggctggtgggagtgaggatatctttatgaaacttttcaaaaaagtgacctgagactagggaatttggattttaaaccttctgttacttatgtagccaaaataaatgactaaaagccagctttgtgccttttatttcctgaagtcacttggtatcttttttttttcccccattttggcagttgaaataaaaatgcttggtggaacatttttacttgtggcattattgatccctaggctgagtttttagctgcatctcagtcttttagagtatatacaaatatattaataatctggttttcactgtgcagagtagaaatgagaggaatactttttttttttttgagatggagttttgctcttgttgcccaggctggagtgcaatggcttgatctcggttcactgcaacctctgcctcctgggttcaagcagttctcctgcctcagcctctcaggtagctgggattacaggcatgcaccaccatgcctggctaattttgtatttttagtagagacagggtttaaccattttggtcaggctggtctcgaactgctgacctcaggtgatccgcccaccttggcctctgcccacctcggcctctgcccacctcggcctcccaaagtgctgggattacagacatgagccactgcgcccagcctcgagaggaatactttttatggggaaagttgaattaaagtatttataatcattaatataccttcctgttatgtatctttggcatttccttatattgatatatttacaggactttgttctccgtaaggtaaactcattgtaaaaatctcaaggaaaattatatagtgaagtttcaaatgtatgtgtttttaaaagttaagtttattaggtatcaggattaaacatgaagttgtcattttgttatttatgtagtttacaaagattgtaacttggggctgggcatggtggctcatgcctgtaatcccagcactttgggaggcagaggctggcggatcacatgaggtcaggcgtttgagaacagcctggccaacatggtgaaactccatctctactaaaaatacaaaaaattagctgagtatcgtggcatgtttctgtaatcccagctcgaggcaggagaatcgcctgaacccgggaggcagaggttgcagtgagccaagatcgtgctactgcactccagcctgggcgacagagtgagatcctgcctcaaaaaaaaagaagaaaaacaacaaaaaaaccccaacttggtcctgaattttgtacttccacaaatcactaggcattatgcaaatacatcaaaatattaggtaattattaacaaggcagcattattgttgaatgttgttgagtaactattagaaacagactgagaaagagtatttgcataatgcttagtgatcttggcttccccacttaaaaagctgtgcggttctgagcacatgcagtaaaactcagagcctcagtttgttaggtttaaatgagggatatttgtagagttgaaagaaggattagagataatgtatgcaagttttgcattatagatggtgaataaatggtagctgtaattaatttttaactttttttggaccctcttagattttatcatttacattttatgatctataagtgaactgtgatttcttatagattatattttacagagccattatttgtagctttgaagacaattttcaaagtagtactttctcccactttttaattatgatgtatttaatgcataccaaagaatacctgaaacacaagttaaaaggcataataatgagtcatctatgaactgtgagcccactggtcaatttaagaaatggaacattatcaataccgctgaagcactggtatgtttccatttccctgctccataggtaaccattaggttgaattttgataatttttgctcattctctagcataattttagtttttcatatatatttgtactcccaaacctttttttagcttgtagagaatatttttaaaagtattttaatatttataaaagtgatacatctttgtatacaggttattttatatgcagttttaagtagctgtgcaaatacttttttggtaaaataaagacctgttttaatccttttctaccaacagttcttgccgctgacttatgtgggcatttacctttatattttaaataatgatcatatactgccattccttgattttgtttaagtagctttattaggatatattgtatatactataaaattcacccactcttatgggaaaattcaatgatttattttattttattttactttaagttttgggatacatgcgcagaatgtgcaggtctattacataggtgtacgtgtgccatggtggtttgctgcacctatcaacccatcatccaggttttaagccccgcgtgcattaggtatttgtcctaatgccctccctccccttgccccccacccctgacaggccctggtttgtgatgttccccttcctgtgtccatgtcttctcattgttcaactcccacttagagtgagaacatgaggtgtttggttttctgttcctgtgttagtctgctgagaatgatggcttccagattcctccatgtccctgcaaaggacatgaactcatttcttttttatggctacatagtattccatggtgtatatgtgccacattttctttatccaatctatcactgatgggcatttgggttggttccaagtctttgctgttgtgaatagtgctgcaataaacatatgtttgcatgtgtctttatggcagaatgatttatattcctttgggtacatacccagtaatgagattgctgatcaaatggtatttctggttctagatccttgaggaattgccacactgtcttccacaatggttgaactaatttacactcccaacagtgtaaaagcgttcctatttctccatggccttgccagcatctgtttcctgatcttttaataatcaccattttaactggcatgagattgtatctcattgtggttttaatttgcgtttctctaatgaccagtgatgatgagctttttttcatgttggctgcataaatgtcttttgaaaagtgtctgttcatatcttttgcccaattcaatgatttttaagtaaattaatagagttgtgcaatcattaccacaatcagttttagaacttttccatccttcccaaaatttccctggattcatttgcacacaattctcattcctttcccctagctccaggaaaccactgatctgttgcctgtgtctaaaaatttctcttttctgagcatttcatgtaaatggaatcatagaacatctagtcttttgctgttttcttttacttagaataacgtttttgaggtttattcgggctgcagaatgtgttagtaattcatttctctttaattgttaaatggtattccattgtattgttacatcacattttatttatgcattcaccagttaatggatatttggctcttttcaacttttggctttttggataataccatgaatatgcatgtgtcttagttcatatttgttgctctaaaggaacacctgaggctgggtaatttataaagaaaagagatttatttggctcgtggttctgcagagtgtacaagaacaatggtgccagcatttgcttctagtgaggacctcagattgcttctccttatggtggaaagcaaacgggagcagatgtgagtagagatcatgtggtgagaatgaagaagccagttgggggagaggtgccatgctctttttaatagccagctcttttggaaactaatggagaacttattccttatcatgagtactgcaccaggccattcatgagggatcatgagggatcgatcattcatgagtgataccctcataacacaaacacctcctgctaggccccacctccaacattgggaatcagatttcagtgtgaggtttgggggatcaaaaatccaaactgtaacagcgtgtacaagtctgtctatggccatatattcatttctcttgaatatatttttaagagttaccataacaatattcctaggagtagccttactgggatgaaactttttttttaaaacgtgtctaaatttttaagaaactgccaaactgttttctaaagtgggtgtaccatttcacattcccatcagcaacgtctgagggttctagtttctctgcatcctcactaactctcatcttttgtcttttgattattgccattttagtgggtatgtagtagtatcttgtggctttaatttgcatttccctagttactgatgaagtttgagcacctttttatttgcttattagacgtgtgtcttttttggtgaaatgtttgttcaagtttattgtctattttaaaaattctgttgttgacttcttactattaagtttatttttaaaatatattttgttgtaagagttctgtattggagatataagttgttttgttttgttgtttaacagtttgcagatattttatcccagtgtgtggcttcttagtggtgccttaagaagcacaaaaacattcaattttaagagtctaatttaactatttttttggtcttgtctggttagtatcatgtctaagatccttttgcataacccatggccataaagattttctcttatattttctcctagaagtttgtggtttatctcttgtgtttaggtgtataatacattttgagttaatttttgttttttgtgtatgaaggttattggtctttatttgtgtaagggtctaaatgcatctttttgctgtggatatccaaatattcctccactacttgttagaaagactatattttgtaaattatctttttgtacttctgttgaaaaatcacttgtccatatatggagaggtctatttttggacttttcccattgaattgtttggacacttttcttgcaaatccattgaccagtgatgtaggatttatttttggactcagttctgatctattgaactatgtgcctatctttataccaatatgcctttcttgactaatgttaatgttgctttatagttagtcagtctttcgactttcttctttttcagaattgttttggctattcagagtcctttgcatttcatttaaattttggactcagcctgtttctacaaaaaataaaaaataaaaataaaaaccctgctgtgattttgatagggattgagttaacactgtaagccagtttggggagaattaataccctgacagcattgattttgtgaatatggatttctctccatttatttatatttttataatttctctcagccatgttcttcagttttaattgcacaaatcttatacttctgttgttaaatttgttactaagtattttatcctttttatgttattttaggtggaattattttaatttcctctttggattgtttgttgctagtagttagaaataaagttgtctttcatatattgatcttgtatcattctaccttgctaacctccttcactaattctagtagtttgtgtgtgtgcatgtgctggtgcacatgcatgctcaagattccttgggattccatatatattatgataatgtcttctgcaaataaaaatgtttgcttattccttccaaagtagttatctttaatcaatccaccttccttttttcctccttttgctttattaaactggctacagcttctaggatagtgagaatagaagtaggaggagtaacatccatgccttattcccaattttaagagaaagcattcaccattaaggatgatattgactgtagatttttttttttttgtagatgccctttgttggtctcaggaacctctcttgtgtttccagtttgttgagttggtttttttttttttttttaatttttttttatcattaatggtgttggatttttccagatgcttttctgttgccatgatctgtggagataatcatgtgatctttgtccacttactctgttaatatggtgagttacattgattgacttttgtaaaccaaccctgcatttctggcatactttccatttggtcattttgagttccttctgggagttgcaatgagggtgctgatttttatgatttgccctaccttggttgaaatacgtttccaagagagttgcagggaatgagagcagttctaggcaagaatgccacagactcatgctgttcttaccagagttcagtagtttccatgaatagatgtttctcagtttgttatgttgtgtgcctttggacagaatactgaaatggttatttttgagtttgatccatatttattgtattttgagaagcggatttgttgacttcctcattctgtcatgctggaagtgaatttccatttcttgatttttaagttttagttgtcttgtactcatttgctgctatggagaataaagcttcagcttttctaaagcttatgttgccccttttccccaacacacatgcatcttttctccccacagtccttctgttacatgtaacaatgattttaggttagactagtatttggagttctttatttattactatgtaaatagtatttacagtatttatttataaatacagtatttatttataaatacagtatttatttataaatacagtatttatttataaatacagtatttatttataaatacagtatttatttataaatacagtatttatttataaatacagtatttatttataaatacagtatttatttataaatacagtatttatttataaatacagtatttatttataaatacagtatttatttataaataaatagtatttattactatgtaaatagtatttacagctgcactttctagtatatcgtgattatattttgttttttgtacagctgtattgctacagtaaatgccttattttgatctgttgctttattttacacacatacacactccttccttcccttctgattctttccatattttctggcaagattgaaaaactatggttcatcctttctgtttatataaccagaaaaagagatttttttttcccaaagcgaagtctcaaactcttcatgaggaaaggtaatattctttatataactacaagaagaacctagtgcttatcagattctcttacgtttatatataaatatatactgttttagagtctacaaatcatgttcagtactttgtattatttagtctttatggtcttttgggcaaattattaggaactgaggttttaacccagatcttcagactagaagcttaggatgttatgttcctactttattatatttacattatcatttagtttgcagtgaatccaggtacatcagtgatttccacacagtaagttaactgactttggaatatttagtaacaatgtttatttcttgactagctctttaactagtgtagttagtatttgttacaaagttctctgcccactgagtgttgagaatgtggagaagataaatagcttgttaactttgtatgcagcttatttcctaatagcttttctgagtatgatctaaggactcttggggccttcctttcagagagcttaggttcctcccttttctaaccatatacatatgtgaagcagatttcttcattttcaaccaaaacaacgtattgtataacagattgagtgcagatacagatataagaaaccatatagatataacattgctaggaattttaaaactctaaaattaacactcctgcatgcacttgaaagaatatatagcctgctcttgttgggtaaaatgttctaaaatgcttcaaaatattcaaaatgcttttgtacttttttttttttttagcattttgtaaaatgttcaaaatgcttttgcagacgcaactataggttgccaaccaaaaaagctactttatatatgaagttgacaagtctatatattaagttgacagtctcttttaattaatgtgcttatgccatttatatttaatataattacttatctgcttggattaaaatctgtcattttaccatctattttctgtttattccaactattctttgtttcttttcctttctttttgccttttttttttttttttggatcagttgagtatctgttaatgactgtcttctcccctatttcttcattatttatatctcttaaaactgttttttagtgatgccctaatttttacaatatatgtctctaatcatagtctctgtattcaaataatattattctgcttcatatgtactgtaaggatctcccagcagagtactctcagttcccccttcccaacctttatacagttttaaaatgtattttatttttatatatgctagaaacacacagtacattacctttaaagaatttttttaatttgaatgggtacataggaggtgtgtatatttataggatatatgagatattttgatacaggcatgcattgtgtaataattacactatggaaaaaggggtagtcatcccctcaagcatttatcctttgtgttacaaacaatttagttatactcttttagttattttaaaatctacaattattttgacaatagtcaccctgtcgtgctatcaaatactaagttactcattctttctaataatttttttgtattcattaaccatctctacctctccggtgccctggcttctgcctactacccttcctggcctctggtcaccatccttcttctatctctatgtgtcactacttttgctttagattttaattttaatttgcttttaattttaaaagaattaaatataaggaaaaatgaattttacattggcctttattaataccatttcagcacttttcatttgtgtgtgtgggtgtatatgtggagatccatgtttttgtatcatatcataatctttttgccagaaaatttttctttaatatttttggtagaacaggtctgctaataatcagttctctgatttttgtctgaaaaagtcttcattttttgttcatctttgaaagatattatcaataagtataatatgggttcacaggtatttttattgtttttactttctttcgtactttaaacacatcattttcatccgttctggcttgcaaagattctggctagaagtccactataattcttatccttatttttctgtatttagtgtgtcttgttttctctggctgtctttaatattttttctgtatttcttgttttggggtgtttgaatatgatgtgttaaagtacgtgtgtgcaatgtgtgttatgtatatgtgtgtgtttctgtttatccttagtgttgtctaatgttcttggatctctggttttgagtcttcattaattttggaaaattctcagtcattcactgtctctttacatatttcttttgtaacttctttatcgtcgctttctgtaatttttattacatatgtgttagaatttttgatattgccccatgtctcttagatgttctattctttatttccattcttttttacttttgcatttcagtatatataatttctattttcagtttcactgattctctcccaccctcagttttgctgagtatattggtgagcttctcaaaggtactcttcatctctgttatgatatttttcatttctaccatatccatttggtaatttcctatatcttatatatatgctaagatgccccatctcctcatgcatgttggccacctttttgactagagtctaagaacatattagtcaattattttaaattttttgtctgataatgccaacacctgagttatatgtgaatatggttttcttgattgctttgtctctacatacttgacagtgtgtcttttttttcttgtttctttttatgcctcataatttcttgttaaaaactagacatcttttgaagacggtagagactgaaataaataggttttgtgccttaagtgggaggtgagatgggatagcaaatcccatcctcctcagggcacagctgaagacccactggacatggcttttctgttgtgctaggcttttagtgtatggatggtgtgctgctgtggtgggggcaggtgtcaggtaattcagtcagaaattgatctgggtttgggtttttgctcaccatgactgccctcagtacctcagagacttcaaattactttggtgttaccttatgtttagagtgagtcctgcttttccagaagctttttcttggtgtttgctccattagcttcgggtttcccctttgtgcctgcccctcagagagggcttctcttcgcacactcttcccccaggagtagagtgctgttacttgttactttatacttggagcatggtgggcatgttggggagttaggggtggaggatattcttgttctggttcagcctcagccttaggcagcctgtgtctctggagtggagagatctgcccttctcagtgatcctgccccaccaccatctctaaggtctctgtaatagatatattcctgtcccacctccagggttagaggattttttttcctgtgccctttccccagctgcagtgggtctttagctgtgccctgaggaaaatgggctttgctatcccattttacctcccacataaagcttttgtttggaagagttaaaggggagttttggtggctgctctttgcctccccaagacctgtaccctgaatgaggccagcctcctgtctttcttctgagcacctggtgagatctgtggagaagagcctgtgagtgagtgatgatacccatgtagctttggctcctgggggttctgtactctctctaaccaacctttcatcttagagcaatgcatcacaagctttagctgaattcctttttgcttgtctgttccaggtaaacaagtgctagtcttttatctctctttgagttatttttggggttgtttgccctttgatgggtgttaagctgtgattttgcaaatgaatgtttgttatgagagttagaaacagtggtcttttccacttttctacgtcctaagctgaagccttcccctactacatctgagagatataggaaagttccttcttagacacagatacatttacttggtggtcctcctcttcctcctccctctcctcccttccttccttctttcttccttccttttcctcctccttcttcagaagttttaaaagcactttagtttttctttttacaatctataaggtttttaaaaaattttttaacattttgtttttacatctatgagttttctttttaaaggtaaacctgtttgtgaagataatcctcttgtgctatatggcatcatttgcacttcagagtaaatcactactgtcagatatctccttctgaaaaactgtgatgcagaaggaagtgttagcttccagtttgaaaatccctgttactgttacagtatttgaggtttataataagtataaaaataacataagaggaatgagattacctttttaaaaatactttttgatgaatcatttctggattctggattctgtgtgtattctattagctggatattttgtacacatctgatttttaaaaggaaatatggataaatggtagcattattctagaacagcaacagtaggtatgtcagaaacatgtatggtgtatctaagagtagtttagaggtagaacagagcaggatgaaacatgtttacttatttcatacatatgtaaatataagttatatatagtgttgacttaaatcatgagatctataaatatagaaaaggagagctttatttcttacagaggattacagcctgcaggcttattaacatgacctacaatatgaaggttttttttaattttttattatactttaagttctagggtacaagtgcacaacgtgcaggtttgatacataagtatacatgtgccatgttggtttgctgcacccatcaactcatcatttacattaggtatttctcctaatgctatccctcctccagcccccaacccctcattgtgtgatgttccccgccctgcgtccaagggttctcattgttcagttcccacctatgagtgagaacatgcagtgtttggttttctgtccttgcgatagtttgctcagaatgatagtttccagcttcatccatgtccccgcaaaggacatgaactcatcctcttttatggctgcatagtattccatggtgtatatgtgccacattttcttaatctagtctatcattgatggacatttgggtttgttccaagtctttgctattgtgaatagtgccggagtaaacatacgtgtgcttgtgtctttatagtagcatgatttgtaatcctttgggtatatagccagtaatgggatggctgggtcaaatggtatttctacttctagatccttgaggaattgccacactgtcttccacaatggttgaactaatttacattcccatcaacagtgtaaaagctttcttatttctccacatcctctccagcatctgttgtttcctgacttttgaatgattgccattctaactggcgtgagatggtatctcattgtggttttgatttgcatttctctgatgaccagtgatgatgagcattttttcatgtatcttttggctgcataaatgtcttcttttgaaaagtgtctgtccatatcctttgcccactttttgatggggttgttttttccttgtaaatttgttttgagacttttgtagattctggatattagccctttgtcagatgggtaaattgcaaaaattttctcccattctgtaagttgcctggtgactccgatggtagtttcttttgccatgcagaagctctttagtttaattagatcccatttgtctattttggcttttgttgctactgcttttggtgttttagtcatgaaatccttgcccatgcctatgtcctgaatggtattgcctaggttttcttctagggtttttataattttaggtctaacatttaagtctttaatccatcttgaattaatttttgtataaggtataaggaagggatccggtttcagctttctacatctggctagccagttttcccagcaccatttattaaatagggaatcctttccccatttcttgtttttgtcaggtttgtcaaagatcagatggttggatatgtgtggtgttatttctgaggcctctgttctgttccattggtctaaatatctcttttggtatcagtaccatgctgtttggttactgtagccttgtagtatagtttgaactcaggtagtgtgatgcctccagctttgttctttttgcttaggattgtcttggcaatgcaggctcttttttggttccatatgaactttaccgtagtttttttccaattctgtgaagaaagtcactggtagcttgatggggatggcattgaatgtataaattaccttgggcagtatggccattttcacgatattgattcttcctatacatgggcatggaatattcttccatttgtttgtgccctcttttatttcgttgagcagtggtttgtagttctccttgaaggggtccttcacatcccttgtaagttggattcctaggtattttattctctttgtagcagttgtgaatgggagttcactcacaatttggctctctgtttgttattggtgtataggaatgcttgtgatttttgcacattgattttgtatcctgagactttgctgaagttgcttatcagcttaaggagattttgggctgagatgatggggttttctaaatatacaatcatgtcatctgcaaaatttgacttcctcttttcctaattgaatacccgttatttctttctcttgcctgattgccctggccagaacttccaacactatgttgaataggagtggtgagagagggcatccttgtcttgtgccggttttcaaagggaatgcttccagtttttgtccattcagtatgatattggctgtgggtttgtcataaatagcttttattattttgagatatgtcccatcaatacctagtttattgagagtttttagcgtgaagcgctgttgaattttgtcaaaggccttttctgcatctattgagataatcatgtggtttttgtctttggttctgtttatgtgatggattatgtttattgatttgcgcatgttgaaccagccttgcatcccagggatgaagcccacttgatcatggtggataagctttttgatgtgctgctggattcagtttgtcagtatgttactgaggatttttgcatcgatgttcatcagggatattggtctaaaattctctttttttgtgtgtatctctgccaggctttggtgtcaggatgatgctggcctcataaaatgagttagggaggatttcctgtttttctattgtttggaatagtttcagaaggaatggtaccagctcctctttgtacctctgatagaattcggctgtgaatccgtctggtcctggactttatttggttggtaggctattaattattgcctcaatttcagagcctgttattggtctattcagagattgaacttcttcctggtttagtcttgggagggtgtatgtatccagtaatttatctgttttttctagattttccagtttatttgtgtagaggtgttcatagtattctctgatggtagtttgtatgtctgtaggatcggtggtgatacccctttatcattttttattgcatctatttgattcttctctcttttcttctttatcagtcttgctagcagtctgtcaattttgtagatcttttcaaaaaaccagctcctggattcattgattttttgaagggttttttatgtctctatctccttcagttctgctctgatcttagttatttcttgctttctgctagcttttgaatgtgtttgctcttgcttctctagttcttttaattgtggtgatagggtgtctattttagatctttcctgctttctcttgtgagcatttagcgctataaatttccctctacacactgctttaaatgtgtcctagggattctggtacgttgtgtctttgttctcattggtttcaaagaacatttttatttctgccttcatttcgttttttaccccatagtcattcaggagcaggttgttcagtttccatgtagttgagcggttttgagtgagattcttaatcctgagttccagtttgattgcattgtggtctgagagacagtttgttgtgatttctgttcttttacatttgctgaggagtgctttacttccaattctgtggtcaattttagaatatgtgcaatgtagtgctgagaagaatgtatattctgttgattttgggtggacagttctgtaggtgtctatcaggtccgcttggtgcagagctgagttcaagtcctggatatccttgttaaccttctgtcttgttgatctgtctaatgttgacagtggggtgttaaagtctcccattattattgtgtgggagtctaagtctctttgtaggtctctaaggacttgctttatgaatctgggtgctcctggattgagtgcatatatatttaggatagttagctcttcttgttgaattgatctgtttaccattatgtaacagccttctttctctcttttgatctttgttgatctgaagtctattttatcagagactaggattgcaacccctgcttctttttgctttccatttgcttggtagatcttcctccatccctttattttgagcctatgtgtgtctctgcaggtgagatgggtctcctgaatacagcaccctgatgggttttgaatctttatccaatttgccagtctgtgtctttcaactggggcatttagcccatttacatttagggttaatattgttatgtgtgaatttgatcctgtcattatgatgttcgctggttattttgcctgttaattgatgcagtttcttcctagcatcgatggcctttacaatttggcatgtttttgcagtggctggtactggttgtttttttccatgtttagtgcttccttcaggagctcttgtaaggcaggcctagtgatgacaaaatctctcagcatttgcttgtctgtaaagtattttatttctccttcacttatgaagcttagtttggctggatatgaaattctgggttgaaaattgttttctttaagaatattgaatattggcccctactctcttctggcttgtagggtttttgccgagagatctgctgttagtctgatgggcttacctttgtgagtaacctgacctttctctctggctgccctttacattttttccttcatttcagccttggtgaatctgacaataatgtgtcttggagttgctcttctcaggtagtatctgtgtggcgttctctgtatttcatgaatttgaatgttgacctgccttggtaggttggggaagttttcctggataatatcctttagagtgttatacaacttggttccattttccccgtcactttcaggtacaccaatgagacatagatttggtcttttcacatagtcccatgtttcttggaggctttgttgatttctttttactcttttttctccaacacttcatttcattcatttgatcttcaatcactgataccctttcttccacttgatcgaattggctactgaagcttttgcatgaatcacatagttctcgtgccgtggttttcagctccatcaggtccttttaaggtcttctctatgctgtttattctagttagccattcgtctaatcctttttcaaggtttttagcttcgtgatgggtttgaacatcctcctttagctcggagaagtttgttattacggatcgtctgaagccttcttctctcaactcgtcaaagtcattctccgttcagctttgttcccttgctggtgaggagctgtgttccttttcaggagaaggggcgctctgatttttagaattttcagcttttctgctttggtttctccccatctttgtggttttatctacctttggtctttgatgatggtgatgtatagatgggattttgttgtggatgtcctttctgtttgttagttttccttttaacagtcaggactgtcagctgcaggtctgttggagtttgctggaggtccactccagactgtttgccttggtatcaccagcggaggctgcagaacatcaaatattgcagaacggctaatgttgctgcctgatccttcctctggaagcttcgtctcagaggtgcacctggccgtatgaggtgtctgttggcccctactgggaggtgcctcccagttaggctactctggggtcagggacccacttgaggaggcagtccgtccgtcctcagatctcaaactccatgctaggacaaccactactctcttcaaagctgtcagacagggacattgaagtctgcagaagtttctgctgccttttgttcagctatgccctgcccccagaggtggagtctacggaggcaggcaggcctccttgagttgtggtgggctccacccagttcgagcttcccagcagctttctttacctactcaagcctcagcagtggtggacgcccctctcccagccttgctgccaccttgcagttcgatctcagactgctgtgctagtagtgagcaaggctctgtgggcgtgggaccctccgagccaggcacaggatataatctcctggtgtgccgtttgctaagaccattggaaaagcacagtgttagggtggaagtgtcccgattttccaggtaccatctttcatggcttcccttggctaggaaagggaattccctgacccctttcacttcccaggtgaggtgacaccctgccctgcttcggctcaccctccgtgggtggcacccactgtccaaccagtcccagtgagatgaaccaggtacatcagttggaaatgcagaaatcatctgtcttttgtgtcgatcatgctgggagctgcagaccagagctgttcctatttggccgtcttcaaacggatcactataaagttttgatagttgatttagggtttgaagttatgttaacactttattgaagagtttaggggggaaaatgatgtttcaaagtatatgattaaaatagttaggaaatttcaagtgtaagagtgataggaccatcaagagaattaatattaaacttttcaagtggtattagtaaaaagctggctgggtcagggcacgctggcccatgcctgtaatcccagcactttgggaggccgaggcaggcggattacctgatgtcaggagtttgaatccagcctgaccaatgtggcaaaaccccgtctctactaaaattacaaacaaaacaaaacaaaaattagccaggcatggtggcacgtgcctgtaatgccagctgtttgggaggctgaggcaagagaattgcctgaacctgggaggcggagtgagccaagatcagtgagccaagattgagccactgcactccagcctgggcaacagagtgaggctctgtctcaaagcaaaaaggtgactgggtgtggtggctcatgtgtataatcccagcattttgggaggccaagaggagaggattgcttgagcttggtgctcgagaccaggctgggcaacatggtgaaacctgatctctacaaaaagtacaaatattagtcggttgtcatggcatgtgcctgtagtcccagctactcgggaggctgaggtgggaggattgattgagcccaagaggttgaggctgcagtgagctgtgatcatgctgctgcactctagactgggtgacatagtaagaccttgtctcaaaaaaagaaggaaaaaagcatgataaatagtttcatgatgtggtattctagatgtttgaaaactcaaacttgtactgtttagtattctctgttcagataggtatcatggaggcttatttgcagaaaaatgtttgagttttttgtttgtttgtttgttttgagacagagtctttctctgttgcccaagctagggtgccgtggctctatctctgctcactgcaacctcagcctcctgggttcaagcagttctcctgtctcagcctcctgagtaggtgtccacaaccatgcctggttaatttttgtatttttagtagagacagagtttcaccatgttggccaggctggtctcgaactcctgacctcaggtgatctgcctccctctgcctcacaaagtgctgggattacaggtgtgagccaccgcgcccggctgagttttgttttataagagcatagcctatgtaatagcttggaaacagtccatttgtgacctaggacctaatcaatgttgatttccgttttccttttatttaatttttttgttcaaaggtaatttgaaaatggttatctactggctgattttgtctgtttaagctttctacattgagtatcaattcaaatgtgagattttagttgttatattctcctatatataagaaacactgcattgagcatttggggttattatactttagctagtggtgttctattccttgataattaaatttcttggagatgatggaattgaaatattatcttagaggtagttttatcacttggttaagaattttagcttaaggctgggtgccatggctcatgcctgtaatcccagcactttgggaggccaaggcagccggatcatgaggtcaggagttcgagaccatcttggctaacacggtgaatccctgtctttactaaaaatacaaaaacaaaaatattagctgggtgtggtggtgggtgcctgtagtcccagctatgcgtgaggctgaggcaggagaatggcatgaaccctggaggcagagcttgcagtgagctgagatcgtaccactgcactccagcctgggcaacagagctagactctgtctcaaaaaaaaaaaaaaaaaaaaaaaaagaattttaccttaatagatgcacagataagtagcagcatttctgttaccagctatgtatttggattatttgacctctctaaatctgtttgcttatccgtaaaatggagtcaatattagtgtgcctcacgtgggtgttgtaaggtttgaatgggcaatacatgtgtttgacatagtgcttggcaaataatgttcaaaaaatattagctattattaagtctgttaagtatagaggattcagagtttgcaccaaggttgtggtctaggtttgatattgttcaggtttaaaacttcatgtaatgtgagctttttcattgacccctgtgcttttgacaaagcataggtgggaagaagagagttcagagtctctttcattccagtcctgtgcttttttagccagactagtgagtggttttgcttttttttttttttttttttttttgagataggatctcattctgtcacccaggctggaatacagtagcacaaccattgttcattgctgctttattttccaggctcaaatgatcctcctgcctcagcctcccaaataggcaggactacaggcatgtgccactacacctaatttttcttatttttaatagagatgaggtcttactgtattgccccacgctggtcttgaactcctgagctcaagcgaacctcccaccttggctcctaaagttctaggattacaagcgtcaaccattgtgcccagctcttaatagattttaagagatagactctattataaatttagaattttcgaatcttcttccaaaaaaacacatatgcaaattttttttgcactgttgtggtaaggggcagttcatagtgctgcctttcaagcctactaatagactccctattctggagaaagaattcatttcagcataaagttactaaagagggaatatggggctggtttagacagttttggagcccccaaataagacaagaaaagcacctgtacttcttaggtttctgtgttagtccattttcatattgctatgaagaaatgctcaagactggttaatttataaagaaaaagatgtttaatggactcacagttccacatggctggggaggcctcacaatcatggcagaaggggaaggaggagcaaaggtatgtcttacatggtggcaggcaagagagtgtgtgcaggggaactgccctttataaaaccatgcagtcttgtgagacttactcactttcatgagaacagcacaggaaaacctgcccccatgattcagttacttgccaccaggtccctcccatgacatgtgaggattctggaagctacaattcaagatgagatttgagtggggacacagccaaattctatcagtttctttttattctaatgcctgtacaccatcaataatttcttgtattacttgattctagtagtcttgattgttagcaaccatgttccagaaattttcagtatcttatcaatagcctaatgccacttctgtgagcaggacattacttctgtgagcaaaacagtttattttgatacagtattacatgagtgtaatacaggtatcaacaagtaatgtttatcagttgctttctgtgtgcctatgcattcccagctaagcactttacctgcagtattttatttatataaaagcatgttccactgttacccccattttgcaaatggaaaatctcaggcttaatactttgcccaaagttacacaactttaagtgggagagtctggattcaaacccaaatctgtaaattcatgttctcttatctgctatgttgagttgccagagttaaatacatttagtggtgtgctttagttaacttgtgtccccccatcttagcccttgaaataatgaaatactttgtcttttcccatcccagcaaatggtagttgtaattaatatctctggtattgatttggcatgtgaaataaactttacaagatcaaataagcttattttctgagatttattatcatacttcagggaagaacttttctattaaaattgtgctgcagcttgactgtggaagacattaaaccaaaaactacttgcttatttgaaattcagttttccagtaggctttgatctgaaagagccaggatggcaagtagtagagagcttttatttatgtgttctgatgagaaaatacattacttaggtggatttattatgaataaatatccatgataccgtaaatactttatcgtaaactgaggcagattacaatttaattcacataggttaaatcaatgtatagtgtttttatttttaaatctatatttctgttctttggtttaaaatggctatgttcaagctgatttaaacagtctgctttctggtctcttcctgcacgcaagacccaccttctgaatgccaatagaagttcttcttcccctgatgatgtatttttttttttcctggaccttttctgattctggctaaggtacagctctcctgggtgtcttctggctattccagagctcctcagcttttccttgcccttccctcaagcatctgaaaggaacttgatattcacgtgatgattgtattgcttcattttgttttgaatttgactgattttgcatttgcagtaatttggacagctcaggtaaaggaagatttgtgctctcttggagataagagtctaggtagttaagtaagtgctgggatatggagtttatgtcttagagaactttgaagtgttttaaaataattattcgtattaacggtcagtgtgcaatgaaatgaattttattgtctccttattcagaaatagaaaagttggtaaaatgaaataaatacaatctttgagaatgatatttaacctgcttaatatcttttatttagctttatttaaaataaaactagacaaaagtaaactttgaggttttcatttgatcagttttgtacactaactgtgcatttgtgtgtactaactgtacatacagaaagaggaaggtggactagttttaacatacctccatttgtatttgaaagcaatattttagaaatagtttttgagtaggacttcttaatttttaaaacatattcagtatcttctaatagatttcttaactagaaattacagttaggcagtttcagcttctagaatgtgtctaagaatttggaacaaggtaatggacatagctgttgtgaaggctgtagacattattcagcccctttttagagcacatactttatatatttataatgtaaaatattttaatagtctggtttcttggcacacaaaatagtaaaaactctaagtgaaaaaaatataatattaagttatattcttcattctttgccagagggacagggaaatagaaatatactttagaagtgtctgtttcaaaatagtaaaagaaaaattagtattaaaagtgatgtgttctatagtatccctggagatatgagtcatacataggatttctattcagtattataaaaatagcattttatattgtagattttgatattggttatttttcattaataattttttctcagctgtatggtcattaataccagctttggtgtaatatagtactgctgcaataagatgtggaaccatttagtttaaatctgactgacatagaaaacattattaatgaaccattaaaatttgctcttttgtgactcaggggaaatggctgattctagagtaggggtctccaacccctgggctgtgggcttgtactggccagtgacctgttagaaactgggccacacagcaggaagtgagcaccagctagcgagcattaccacctgagctctgcctcctgtcacatcaacagtggcattagattctcataggagcacaaaccctattgtgaactgcgtgtgcaaaggatctaggttgcatgctccttatgagaatctaatacctgatgatctgagatagtttgatcctgaaaccatcccaccccaccatacgtagaaaaattgtcttccacgaaacaggtccctggtgccaaaaaggttggggaccactgctttaatgtattcatgttaactcattgccatgttttatactggttgtagaaatgtaaaaaccttaaaatagtcaagacaactttgaaaaagaacaataaagttgatggactaacaccacctaatttgaagacttactagaaaacttcaaaatagtataatattgacaaaaaggtagacaaatagaagagtgggagagaatggcaagcccagaaataaacccagccatagacagactactaattttgagaaaggtacaaagggaacgtaatgcagaaaggacagtctttttaagaaatgctgctagaacaattggataaccatatgcaaaaaagaacttcatacttgatatgatattttaaaaaattaactcaaaaaagaacatagacttgaatgtaaaactgaaaatagaaaactcctagaaaaaaacaggaaaaaaaaaatctttgcattcttggctttggcagatttctcagaaacaacagtaaaatcaagatatataaaagaacaagcgtgaatacactggagttcgtaaaaaggcaaaactccttttcaaaagaaactttcttcttcttcttcctcctccctcctccccctctccctcccctcccttctttcccctccctcctcccctgccccccttcccctaccccttcctcccccttctccctcctccctcttctccctcctgcctccttcccccttcctccctccttccccctctttccctgtcctccctctcctcccctcctcccccgtcctctcctcctccctcctctcctcctcccctctccttccccctcctccccttctccccgttccccctcctctccccctccccctccctcctcctttccccctcccccttccccctactccactactgctactactacttcttcctcttcttcctcctcttcttcttcctccttctcctcctcctcctcttcctcttcccttttgtttttttttgtttttttttaaaataaagatgggtgtgtcaccatgttgcccaggctcatgtcaaactcctagcctcaagcagtcctcttgcctcaatgtctaaatagctgagattacaggtgtgaaccattacaccagctcccaaaagacactcttaagagaatgaaaagacaagcaacagacggagggaaaatctttgtcaaggatatatctgaaagaggacttgtatttctagaatatagttttaaaaactctcacaactcaacgataaaggaaaaagcaatctaattacaacatcagaaaaatattttaattagttcatgaaagaagatctatatatgacaaaaagcacataaaaagatgctcaacaacattacttattaggaagatgcaaattaaaaccatgtaagatattactgtacagctattacaatagctagaattaaaaagactgtaacaagtgttaatgagatgtggaggagctggaatactcatgtactgccagtggggatgaaaagtagaacaaccaggctgggcacagtggctcatgcctgtaatcccagcactttgggaggccgaggcgggcagatcacctgaggttgggagttcgagaccaacctgaccaacgtggagaaaccccctctctactaaaaatgcaaaattagctgggcatggtggcccatgcctgtaatcccaactactcgggaggctgagacaggagaatcgcttgaacctgggaggcagaggttgtggtgagccaagattgcgccattgcactccaacttgggcaagaagagcaaaactccgtctcaaaaaaaaaaaagaaaatgtaaataaaaatagaacaacctgtttgtaaaacagtttggcagtttcttaaaaagttaaacgtatacctatgatatgttccagccttcccacttgtaggtatttacctaagagaaaaaggaaatatatgttcatgggaagacttgtacatgactattaataatagctttattatgaataataacaataataactttatttataataataaaaaactagaaacaacctaactgtcccaacagtgaatgaataaactgtggtatatttacacagtggaatactactcagcaatgaaaaggaatgaacttttgatacatgccacaaaactgggtgaatctcagaatagctgtgctgagtaaaataagccagacaaggaaaaaagactacataatatatgatcccatttatataaaattctataaaatagtcaaactatggtaacagaaaaacagtgggtagggtggggctaccaaggggctcaaggaaactttggggatatgctcatcatagtgattggggaatcaagtatataaatatgtcaaaaattattaaagcgatattttaaatatttgcaattcattgtgtgttgattgtaattctatgatgctgtttaataaaagaagaaaacgagtaagtttttttgtcaagagggattgtggtgcagttggaaattgaaagtttgtccttgtgaggttagaataacgatatctagtgttagcatgacgagttcacataagttattacaatgttgttaacttgaggcctcaggtggttgccacttttttttgtttgtgcttttaaggtttgaatgtcattctgcaggtaaatgtaaagataatgagaaaaatgacgtttttccccttctttctctccccctaacccccttttttctttctttctttttttttttcaaaggagtgacagttcatttagattctttgtattcttcttcgtctatatttgtcagtttgctgtacatgtactccaagctgcaggatttcataactggggcattggtaagtttttttttttactagttttcagctttaatctaatattgtaatataatttttggcttcctaatctagttaacacagataaaccagattagaaaaattaaataaaaagcaaaaattgttttaaaaatacaattttaaaatgtcataaggcataaactttggacaaacctgtgtctttgaagattatgttcccatctataaaaacagcacattttttctagtttaaataaaacatgtatgtaagggcgctaagaggaagactgcaaaagagactgaggtggtcagagagatagagggaccaaggaatgtggaagggacaggaaagagcttcagggattctaaggaaaagggatacctattatgtataaagccctattttaggtatacaaacagatatatttttatatacgaatatacatggacacttgtctttgaaaggtagaataactgcacacacgttatatacatatatctttaaacaatcgaatcattctcatggctcattcagtgggggacctcagaaatggagactatctggacccaggctaggaggtaatagcagatttaggtctctctttacattctgatgcaaacattccttgagtgaaatggtgggtggaagagtacacatctctaaaattatctgttcctctcttctttcttttatactgacttgcattcagctgtattcttacatgtcagaagaatgtgtgatgcaactttgttccactgtgtacattaaaccaaaattgaaattagcatttaattagaatgtgttgaggacttacatttagtattctgctactgaagtggagaagtgattggcagacaactcctggcagttctgcagagctcctaatgggcataaatacatgcagaaaatttatatagatatttaaaatcagttctcagataaagtagtttttattattattttaaatagtgtctagtttttggtattttagggaaaggaaatgttttaaatgtttaattaaaaatatactgcttactttaacagcacgaggtttttttaattctcgtgaaagtgaggtaatttctttcgctttttagcacagacatagggaaaatgctaaaattgagcataacagcatgtatgtgactaaatagcgtaaaaagagtctgctaatgagggtgcatacagaattgacctgttttaagatagaccctcatgtagttcagattttttaggttaaactttttacttttaggtaatcatagattcacatacaatcataataaataacacagaaatctcaggtaccctttatcctgtttcacccaatggtaataatcttgtagaactatagtaaaatataaataccaagatcttgacattgatagtaaagataaagcacattttcatcaccagaggattcctcatgttgctttttcatagccactctcaaaactccccttttcccactccttaacccctggcaatcactaatgtgttcttcatttttgttgttttgtcatttcaagaaggttatagatgtggaatcatagtctacaacctttggcttttttcccctcagtgttattttctggagatttatccaggttgttatgtttatctgtagtttattctaatttgattgattgattgattgattgattgagacagagtctcgccctatcacccaggctggagtgccgtggcatgatctcagctcactgcctccacctcctcggttcaagtgattctcatgcctcagcctcccgagtagctgggattacaggcgcctgccacccagcccagctaatttttctatttttagtagagacaggatttcgccatgttgcccaggcaggtcttgaagtcctggcctcgtgtgatctgcccgcctcagccttccataatactgggattacaagcgtgagctaccatgtctggcctcctttttatttttgagtagtattctatgatatggatgtatcacaggttatttaactgttcaccagttgaagggcatcagtattgtgtccagttttggactattacaaataaagctgccatgaaatttgtgaatagatttttgtgtgaacataattttcatttctctgggataaatgcccaagagtgtaattattggattatatggatgttgcacatttagttttcttttctttttttttttattatactttaagttttagggtacatgtgcacattgtgcaggttagttacatatgtatacatgtgccatgctggtgcgctgcacccactaactcgtcatctagcattaggtatatctcccaatgctatccctcccccctccctccccccaccccacgacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgccattgtgaataatgctgcaataaacatacgtgtgcatgtgtctttatagcagcatgatttatagtcctttgggtatataccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactggtgtgagatgatatctcattgtggttttgatttgcatttctctgatggccactgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagacgagtaggttgcgaaaattttctcccattttgtaggttgcctgttcactgtgatggtagtttcttttgctgtgcagaagctctttagtttaattagatcccatttgtcaattttggcttttgttgccattgcttttggtgttttggacatgaagtccttgcccatgcctatgtcctgaatggtaatgcccaggttttcttctagggtttttatggttttaggtctaacgtttaagtctttaatccatcttgaattgatttttgtataaggtgtaaggaagggatccagtttcagctttctacatatggctagccagttttcccagcaccatttattaaacagggaatcctttccccattgcttgtttttctcaggtttgtcaaagatcagatagttgtagatgtgtggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggatagccttggcgatgcgggctcttttttggttccatatgaactttaaagtagttttttccagttctgtgaagaaagtcattggtagctttatggcgatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctgggtattttattctctttgaagcaattgtgaatgggagttcactcatgatttggctctctgtctgttattggtgtataagaatgcttgtgatttttgcacattgattttgtatcctgagactttgctgaagttgcttctcagcttaaggagattttgggctgagacagtggggttttctagatatacaatcatgtcgtctgcaaacagggacaatttgacttcctcttttcctaattgaatgccctttatttccttctcctgcctaattgccctggccagaacttccaacactatgttgaataggagtggtgagagagggcatccctgtcttgtgccagttttcaaagggaatgcttccagttcttacccattcagtatgatattggctgtggggttgtcatagatagctcttattattttgaaatacgtcccatcaatacctaatttattgagagtttttagcatgaagtgttgttgaattttgtcaaaggctttttctgcatctattgagataatcatgtggtttttgtctttggctctgtttatatgctggattacatttattgatttgcatatattgaaccagccttgcatcccagggatgaagcccacttgatcatggtggataagctttttgatgtgctgctggattcgttttgccagtattttattgaggatttttgcgtcaatgttcatcaaggatattggtctaaaattctcttttttggttgtgtctctgccaggctttggtatcagaatgatgctggcctcataaaatgacttagggaggattccctctttttctattgattggaatagtttcagaaggaatggtaccagttcctccttgtacctctgatcgaattcggctgtgaatccatctggtcctggactctttttggttggtaaaatattgattattgccacaatttcagatcctgttattggtctattcagagattcaacttcttcctggtttagtcttgggagagtgtatgtgtcgaggaatttatccatttcttctagattttctagttgatttgcgtagaggtgtttgtagtattctctgatggtagtttgtatttctgtgggatcagtggtgatatcccctttatcattttttattgtgtctatttgattcttctctctttttttctttattagtcttgctagtggtctatcaattttgttgatcctttcaaaaaaccagctcctggattcattaattttttgaagggttttttgtgtctctatttccttcagttctgctctgattttagttatttcttgccttctgctagcttttgaacgtgtttgcccttgcttttctagttcttttaattgtgatgttagggtgtcaattttggatctttcctgctttctcttgtgggcatttagtgctataaatttccctctacacactgctttgaatgcatcccagagattctggtatgctgtgtctttgttctcattggtttcaaagaacatctttatttctgccttcatttcgttatgtatccagtagtcattcaggagcaggttgttcagtttccatgtagttgagtggttttgagtgagattcttaatcctgagttctagtttgattgcactgtggtctgagagatagtttgttataatttctattcttttacatttgctgaggagagctttacttccaagtatgtggtcaattttggaataggtgtggtgtggtgctgaaaaaaatgtatattctgttgatttggggtggagagttctgtagatgtctattaggtctgcttggtgcagagctgagttcaattcctgggtatccttattgactttctgtcttgttgatctgtctaatgttgacagtggggtgttaaagtctcccattattaatgtgtgggagtctaagtctctttgtaggtcactcaggacttgctttatgaatctgggtgctcctgtattgggtgcatatatatttaggatagttagctcttcttgttgaattgatccctttaccattatgtaatggccttctttgtctcttttgatctttgttggtttaaagtctgttttatcagagagtaggattgcaacccctgcctttttttgttttccatttgcttggtagatcttcctccatccttttattttgagcctatgtgtgtctctgcacatgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggtgattttgctcgttagttgatgcagtttcttcctagtctcgatggtctttacattttggcatgattttgcagcggctggtaccggttgttcttttccatgtttagcgtttccttcaggaactcttttagggcaggcctggtggtgacaaaatctctcagcatttgcttgtttgtaaagtattttatttctccttcacttatgaagtttagtttggctggatatgaaattctgggttgaaaattcttttctttaagaatgttgaatattggcccccactctcttctggcttgtagggtttctgccgacagatctgctgttagtctgatgggcttccctttgagggtaacccgacctttctctctggctgcccttaacattttttccttcatttcaactttggtgaatctgacaataatgtgtcttggagttgctcttcttgaggagtatctttgtggtggtctctgtatttcctgaatctgagcgttggcctgccttgctagattggggaagttctcctggataatatcctgcagagtgttttccaacttggttccattctccccatcactttcaggtacaccaatcagacgtagattaggtcttttcacatagtcccatatttcttggaggctttgctcatttctttttattcttttttctctaaacttcccttcttgcttcatttcattcatttcatcttccattgctgataccctttcttccagttgatcgcatgggctcctgaggcttctgcattcttcacgtagttctcgagccttggttttcagctccatcagctcctttaagcacttctctgtattggttattctagttatgcattcttctaaatttttttcaaagttttcaacttctttgcctttggtttgaatgtcctcccgtagctcagagtaatttgatcgtctgaagccttcttctctcaactcgtcaaagtcattctccatccagctttgttccgttgctggtgaggaactgcgttcctttggtagaggagaggcgctctgcgttttagagtttccagtttttctgttctgttttttccccgtctttgtggttttatctacttttggtctttgatgatggtgatgtacagatgggtttttggtgtggatgtcctttctgtttgttagttttccttctaacagacaggaccctcagctgcaggtctgttggaataccctgtcgtgtaaggtgtcagtgtgcccctgctggggggtgcctcccagttaggctgctcgggggtcaggggtcagggacccagttgaggaggcagtctgcccgttctcagatctccagctgcgtgctgggagaaccactgctctcttcaaagctgtcagacagggacatttaagtctgcagaggttactgctgactttttgtttgtctgtgccctgcccccagaggtggagccttcagaggcaggcagtcctccttgagctgtggtgggctccacccagttcgagcttcccggctgctttgtttacctaagcaagcctgggcaatggtgggcgcccctcccccagcctcgctgccgccttgcagtttgatctcagattgctgtgctagcaatcagcgagactccgtgggcgtaggaccctccgagccaggtgcaggatataatctcgtggtgcgccattttttaagccggtccgaaaggcgcaatattcgggtgggagtgacccgattttccaggtgcgtctgtcacccctttctttgactcggaaagggaactccctgacctcttgcgcttcccaagtgaggcaatgcctcgccctgcttcggcttgtgcacggtgcgcgcacccactgacctgtgcccactgtctggcactccctagtgagatgaacctggtacctcagatggaaatgcagaaatcacccgtcttctgcgtcgctctcgctgggagctgtagaccggagctgttcctattcggccatcttggctcctctccgcatgtttagttttctaaagaaacagacaaactgttctctagaatgcttgtgctattttacactcccaccaacaattatgagcaatttagtctccacttcctcaccagcatttagtggttattactttttattttagccatcctaataggtgtgtagtgatatctcattgtggttttgaacatcttttcatgtgcttatttgtcgtctttatgtcctcttagtaaaatgtctctgcatgtcttttatccattttcttaatttttgtattctgttgagctttgaaagttatgtatattctagatgtgaatcctttgttggatatatggtttataaatatcttctttcataattcagcagaattgaaaataaacatttaaaaaaatgtaataataggccaggtgcagtggctcacgctataatcccagtttgggaggccgagtcaggtggatcacgaggtcaggagttcgagaccagtctgaccaacatggtgaaaccccgtctctactaaagatacaaaaagtagccaggcgtggtggcacgcacctgtaatcccagctactcaggaggctgaggtaggagaatcgcttgaacccaggaggcggagattacaatgagccgagatcatgccactatactgcagcctgggcaacagagcgagcttctgtctcaaaaaaaagagtaataataaattcaaaactcataagcttaaaaaatgtacagcttaaaaaatgtacagtctggaattaaacacttgagactctggagtttggtttgcttttgaatttagactatgccatttataagctgtgtgacctcgggcagattactgaatgtctcagttcctcatttgtcaaatggggatttaaaacagcatctatcctattgggtgggttgtgagaattaaatgcactaatacacataaagaacttgaatattgcctggctgataagtgttgaatatgtgttagatattatgctatttttaaaaagtttacatcaacttttgcctaattacactttttattactttttagtggttggatttcatcccttactggtctcaaccaaaatattcctgttggaatcatgatgataatcatagcagcacttttcacagcatcagcagtcatctcactagttatgttcaaaaaagtaagtgaaattttatgtctaaatttttatagtgaacgtgatgtaaagttctcattttcctattttgctataatttggtgtaacctgaagccattttatcgttattgtatgagtttgctctctgaggattactttttacaattaaaagttatgcataagtacattttagaaaattgcatcacattttaaacttcagtaaaaagggaatattttaaaatcattttaactgaaggctttcatgagttaaagagtcagcctcatttttaaaatttggatttttaaatatactctaaatttcttttttttgatatgaaggatattagcctgttaataaatagaagtaaaattattatgtgatatgtacattttattcatatatatctcttaggtttttgttttgttttttaattttttattataaattcagagggaacatgtgcaggtttgttacatggttatgttgcataatgctggggtttgggcttctattgaacccatcacccaaatagtgaacatagtacccgatagtttttcaagctttgctcttctccctccctcccttttgggtccccggtgtctgtttccatctttatgtctgtgtgaaccctttgtttagctcccacttctaagtgagaacatgcagtatttgattttctgttagtgtgttaattcacttaggataatggcgtgcagctgcatctatgttgctacgaaggacataatttcattttttaggtggtgtagtatttcgtgatgtatatgtatcacattttctttattcagtctactattgatggacgcttaggttgattctgtgactttgctattgtgactagtgctgcaataagcatatgagtgcaggtgtctttttgataaaatgatttcttttcctttggttagatacccagtatagggtgattgctgggttgaatggaaggtctatttttacttctttgagaaatctccatactgttttccacagaagtagaacaaatttatattcccgtcaacggtatataagcattccattttctctgcatccttgccaacatctgttgttttttgagtttttaataatagccattttgactggtgtgagatgggaattattgtggttttgatttgcatttctctgattggtgatgttgagttttcttccatttgttggctgcttgtatgtcttcattcaagaagtgtctgttgatatcctttgcctactttttaatggggttttttttttcttgttgatttgtttaagtcctttatacattctggatattagtcctttgtcagatgcatagtttgcacatattttctcccatcctgtagattgtctctttactctgtttattctctctttctttcttttggtttcttttctccttccttccttccttccttccttccttccttccttccttccttccttccttccttccttcctcccttccttccttcctttcttgtctttcctctatctgtctctctttctgtcttcctgtctcttttgtgaaagagagtctcactctgtcacccaggctggagtgcagtggctcaatctcagctcattgcaatctccacctcccgtgttcacacaattttcctgtctcagcctcttgagtagctaggattacaggtgtgcaccagcatgcctggctaatttttatatgtttagtagagatggagtttgaccatgttggccagcctggccttgaactccagacctcaaatgatcagccctcacaaagtactgggattacaggcatgagccaccacgcccagcctgtttagtgtttcttttgctatgcagaagctctttaagtcccatttgtcaatttttgtttgtgttccatttgctattgaggtcttagtagtaaattctttgtctaggccaatgtctagaagagtatttcctagattttcttctaggatttttgtagtttgaggttttacatttaagtcttcaatccatcttgagttaatttttgtatgtggtgagaagtaggggtcaattttattcttctgcatgtggctagccagtttacccagcaccatttattgaatagggtgtcctttccccattgttcattattgtcagctttgttaaagatcagttggttgtaggtgtgtggcattatttctgggttctctgttcgattggtctgtttttgtactggttaccatgctgcttgcttaccatagtcttttttcttttttgagacagaatcttgctctgacgcccaggctggagtgcagtggcacaatctcggctcactgcaccctcagcctccccaggttcaagtgattctcatgcctcagacagccaagtagttgggactaacaagcgtgaaccaccatgcctggctgatttttgtatttttagcagagacgggatttcaccatgttggccaggttggtctctaactcctggcctcaagtgatccgcccgcctcagcctcccaaagtgctgggattacaggtgtgagccactgtgcactatagtttgaagtcaggcaatatgatgcctctggctttgttctttttgcttaggattgctttagctattcagactctttttggttccatatgaattttagaattgtattttctacttctgtgaaaaatgatgttggtaatttgataggattgtattgaatctatatattgctttggacagtatggtcattgtaacaatattgattcttctaatccatgaatgtggatgtttttccatttctttgtgtcatgtgtgatttctttcatcagtgatttgcaattcttcttatggagttctttcaccttcttagttaaatgtattctggatgtgtgtaggagtgtgtgtgtgtgtgtgtgtgtgtgtgtgtgtctattgtaaatgggattgggttctttatttggttctcagcttgaacgttgttggtgtttagaaatgctactgatttttgtatgttgattttgtatcttgaaactttttgttggttttttgagacagaatctcactctgttgcccaggctggagtgcagtggtgtgatcttggctcacggcagcctctacctcctgggttcaagcaattctcatgttttagcctcctgagtagtcgggattacagatgtggcacctggctaattttttttgtatttttagtagagatgatttcgccatgttggccagtctggtctgtaactcctgacctcaagtgatctacttgccttggcctcccaaagttcgggattacaggtgtgagccaccacacccagtctgtatcttgaaactttactcaagttagttatcaggtttaggagtcatttaggatttgtaactgcccagttgttttagctacacttcttcctgtagaattcccatgtctgttttcacagctttaaaaaaaaaatcattacatagaggaaggtaaattagtgtttttatttgtttatttaaagttttattttgtcttggatatatgtaattttgatatattttatatgtattcaaacatgatattgagaccttgggaataacacctatgttttaaatgaaaaagactttttgataggtctcactttaaagaaaataagtccttataattttttttaccatttcattacttgagactatgtatgaggaatgcatagaaataattttaccttatatttaaaaccacttttactctttcagtactttactcagacatttgtcttttatccttctcaaaaccctacgaaggttagactgtgtccgttcttccatattttctctatttgaaatttttaacttctcttctgcaccaaacacacataccattgacactcagctctctaatgttactaaatcccttttccagttttcctcctccttaacctctgtagctttctacaccacagatggctcctctgctaagactttgcaatgatgttctaattctcttgactctctggctattctttctcctccatttcttcatccagttcataaattaaggtcttaaatgtaatcggctctttgtgctatgcagtcattttctttgggaatttcatcttcccttattatttcagtttcttctctacctagatgacctagaatcttggaattggaaaagataatgcattgcataaacctttagttgcatcttcaattggtcattttcatctccagttgttgattgatgtcatcttctcacagtaatgcctcataaactcttcagtttcttagtgatagatgttccttttgaacgttctgagtaatattcaagaagcatttattaagaccacatattgtatagattccattattgtgaaatgtataaaatgggcaaatatatagagacagaaaatgtattacagcttgcctgtggcttatgggtggggtggggagtgagggtaatgaaagtattctaaaattaggttgtgtagatattatagtcacaactctatgaatatactaaaaatcattgaattgtacactttaaagggtaaaatgcatagtatacagattttatcttaatgaagcttttttttttgaagaaacacttattgaatacctactaatgagatggcactaagcactttatgtaattccattgaacatttttgtcagtgctgtgattgcttctgtcagtgcttccattacttcttttttgagacagaatctgtctgtcgccaggctggagtgcagtggcgcgatcttggctcactgcagcctccgcctcccgggttcaagcgattctcctgactcagcctcccaagtagctgggactacaggcatgcgccaccacactcagctatttttttttttctttttttgagatagagtcttgctctgtcaccaggctggagtgtgatggcgtgatctctgctcactgcagcctccaactccctggttcaagcagttctcctgcctcagcctcctgagtagctgggattacaggcatgtgccaccatgcctggctaatttttgtatttttagtagagacagggtttcaccatgttggccaggatgctcttgatctcctgacctcgtgttctgcctactgggattacaggcatgagccaccacgcacagccacttccattactttttaattcactttcttagatacctttttagtatcttttccatttccaacctcagctaatccagaaattctttttacaggttacttatattccctcatccttctcgcagtccatttaatatataattcctatattaaccttaaaaaaaccccaacaaattggcactctgcagatttttgacgtggatctgggattgggaacggcattttggtggcagtgcgaagaagggctacattcagaaacaccagcattgctaaggttgtaaaaacacactacatgccataaagccatcaaatgggccttaataacctaatgatgaaatcacttttattttgctcagccatactctgggccctatgcagaacacttcaccagtattatgccattttgtcctctcggagaatcacagattgggattatagtggtggtgggaagaagggctaatggtgacgtctcacagctccatgattcacactttctattcttgtcagactgtactgctcggtttcttcaaatacatcatgtacattcctttgttccagattttgtttatatgatgttttttaatccgtgcattaattcgtcttctctgctatttgaagacctactagtattctttcaagacccagctccgatcttgctgtgtctcccagaatgttttttgttgccttgtatcttagggaccatgtcattctctgttttcttggggaaacttaactgtctatattgcttactgtggcacctgggcataagccagtttttatgccttatggtgcatgtattctgggtacgcagctgttaagcaccccccgcgtgaacaagtcttttagcattggaattagatgagaagagcaagagttttgctttggaaccatacaactcaggttgaaattttgacagcttcacttacagctctgtgacctgagacagacttctgtaaccactcaggtttggtgtcctcaactgtactccaagctgcgtgagagtggagacctgttctgtatgctttcaggttgtaattctcacatctggaacagtgacatgcagtgattggcatgtgataggcactcagatatttgttgaataaaagaaggaatgggaagagtaaccactttcatagggttggtgtgaggattaaatgaaacagtgaatgtaaactgcatagaatagggccttctcagttaatagttttcctttctgatcttgacctttttatcattttatattcagggtctggtttagtgtctacttttgtttagtagatgcctttatcagtcagcatgctatcagaaacagaaagaatgaaaaggttaattgcggggaattggctggtgaggtcagtctgatatcaagagggcaggccggaactctcaggcagaagttgaaactctggtccacaagtgggatttcttcttcctcagaggaactccagttgtgttcttaaggcctttcaacagattggatggggcatacccagataatctagaacactcttcttaaagtcaactgaaggcagatgccgattacatctacaagataccttcacagcggcacctaggttagtgtttgattgaataattggagactgcggcctagccaaattaacatgtaacactgaccatcacagcaccattctttggagaattcctttattatttcacatgtattattgagggtgttttatagaagtagaaatgtaatacattttgagtatagtagagggttttgtggtgtgtggcagttttcactcatttgttaaacagctgttattgagcatatattacgtgccaggcactgggctgtgcatgagctcagagagatcacctgttggtgaggaagagaaataaattggtgggccccccaattcagttatttaatggccatgatagaggtaagtatagggagcagagggacacctatcaggttttggaggtctttttaagtattgcctcagctgagatataatgatggctgctcatcattatagttatctaagcaaaagaataagggacagggaagaggataagagggataaggaggtaccagagagtggggataccacgttcacatctagttgtaggaaataacatggcaaattcagggaattaaatgtagctcagaatggatgggagataaaacatggtgtgtgagctggggctaggagaattgtaggttgttggtattggaagatgaaattgaacacgtaagtatagttttatcctacagggtcttgttaagaagtttaaatcttctccaaaaagtggtagtgagccatagaagagttttaaggaggagagtaattgaattgattagatttgaattttagaagcatttattctgaaatacatttgggatttgcggggccgagcagtcgtacttggaaacacttaggagacgggctaggaagctgattagtaatgatggtggcctgaactgaggaaatgtgaagaaaatgtagtcaagagaaaacgagcaggtaaggattaatccaactgggcctggaagtaggggacaagataagactcaaggatgacacccaggtttttagatgatggaccattcaagaagagagtacaagaaaaatggtttggggatcaagatgttttccacgttgaccttgaatttggggagtttaaattaactggtggggcattaaaatataaatattgagtaggcttttgtatatatgagttaggagcaagggaagaactttaggctggatttctagactggaaagtattgacttgttgaagtaaatgaagcctagaaagtgtatggagtcagaagagggctttggggagaatactcacaacaattaagactctgctgtgggtgaagtataaagggaactttaaccatcactggcagtggttgaggaatgtgtggcacagatgatcaatagagccagggtgtggaggaagtgtttattctgtagctgttctataatgaactactctgtgcacactctgaatactttgaccagcagtttttttcctttccattttccaggtatacagtttttcaggatccaccacacaaaggaaaagttatagaatggtgctcatatgccaggcattgaaaagaaatatgactttctcgaataaaagtattgatatggatatcatgcagcatactctaatattttgttgttgttgttgtttttacctcatagttaaagaagttaccagaacttctgtttatatgtgttcacaagttcctaaacttctctgggtctcagattctttatctgtgaaataaggagtttagatgagatgattttctgtatgattttatgaagtacgatagggatactataagctaaaatataatttgcaccagctttcatattttaatagcaggcatttctcttgctgtaatagaaattaagatccaattttaaaaacctaatttttcctttttaattttctgtttcacacttggtcaaaactggcagtttaatgacaaaaaatcctttgcaggtatgtagcagtatttataaccactaggggtcatgcttttcaagaacagttaatgccctctaaccgtaatctgtgcacggttttgactctagaattgttgggttttattaagctgttcttctcttaaggtaaatgtgctctgtcctatatatttatcctaattgaagtgaataggattttggtaatttcgttggctttctgttgtcttgcataactgaagtgggtcatcattggtgctgcagggcccagtatgagattgtgctgtttgtttcccccacagtgttgttttatactccacatttcaaatattgaaagaatatatgtctcctatacatctgcatggagaagggtctagtttagtccttatctttcacaaatagatttcttgttttctttcagattatttccaaatggtgtttttacaaaagctcctctttctattagaactatcagaaagaattgagtaatggttttgggccaagcagggagttgttataaatgtgtcaaataacagtaaatgaatgcatcacaggagactatggatcagggaatccaaaacttttcccttctgttaattggtatggctagaataacttaatatggaagtaattaatagatgatatatcatttgtattccttttgggacctgattttgaatgattatcacttccatgaaatttgttcatagactgtcatgttcacattaagtagtttttaatagtgaattttttgcattttgaaagaattttagaaaaaagttattttacctctttaaaaaacaagttttctgaagtgtttcaaatcttgtttatttactacagtatatattctgcagatactcatttttgtgggagcgctgaattgggtctatgatagagaacactgtgattaagtctcattagttggtgttttatggtaaatgctttgtgaagatatcctattatatataaagtgatagttttcttaggtgaaaagtgactcttacagttatccctctatatgcaggggattggtttcagaacccacacatccatataccaaatctatgcatactcaagtcttggagtcagccctgcagaacccatgtatacaaaaagccttctgtgtacttgggttttacatcccatgaatactgtattttctatgtgagtttggttggaaaaaaatcacatattataagtggacctgcccagttcaaggattatcatctatactttcttgaaaatattgttatcattcacctctcccccttgtctcttccactttgtaactttatttatgacctaggatagaaagctgataattccactgtactatttttctatagtcacaaataggcatgctacttctctctcagaaccattcagcactgtcgtctttgctgactaggaatcaattctggatggttcacattgtctattaaaatagtcatccagttacttgtcaccttcttctaagggacacagatagagtaatacttttgaattcctagaaaaaaatggcactcttgagcagattgtttatattctgtcctcggctgatactcttagtatattcaccaaaaaaaaaaaaactttacccccaattttaattttgttacctttttcaataagtactaagctagctacttaatagatcccaaatctaggttactataactaaattattattatcttaggcatcttcaaatttggtagatttcgtagattggtgagtatttataatgctgttcatgtggcactttcatctaagtcatctttatatgcatatttttatcagctttattgaaatataattcacatacaattcacccatttaaaatatacggtttagactgtgcatggtggttcacacctgtaattctagcactttgggagggtttggggggccgaggcaagaagatgacttgaggcgaggagtttgagatcagcctgggcaacataatgagactaccctccaaccccttacaagacattaaaaaaaaaaaaaaaaaaaaaacaaaaaaaaaaaaaaaaaaacaacaacacagcccaggcatggtggtgtgagtttattgtcctagctgttggagagactgaggtgggaggatcacttgaacccaggagtttgaggctgcagtgagctatgattgcataccactacactccagcctgggctactgagtgagaccttgtctctaaaaaatacaaaataatttaaaaaaacctaaagtatacaatttaatggcttttggtgtattgtatttgttttaattgtggcaaaatatgtataacataaactttgacattttaattacatttaggtatacaattcagtggcatcaattacattcacagtgttgtacaaccattactaatgtctatttccagaactttgcatcaccccaaacagaaactctaatcattaagcaataattttattcctccctattctcagcctctggcagcctctaatttgctatgaattgcctattttagatatttcatataaatggagttatacaatattttccttttgtacttggcttctttcattaccataatgttttcaaggttcatccgtgttgcagcatgtatcagaaatgcattcatttttaagactgaataatattccattgtatctgtatactacattgtttatctgttgatgggcatttgagattttcccaccttttggctattgtgaatagtgctgccgtgaacattggtgtacagttatctgtttgagtctttgcttttacctctcttgtgtacatatatacccaatgtggaattcctatgtagtcttatagtaattctatgtttaggtttttgaggcacctccaaactcttttctggaaggactgtatcattttacattcccaccagcactttctctacatccttgccaacacttgtgattttccgtttttctcattccagccatcctagcaggtgtgaagtagttgtatactttaaaaacatttaacctctgaggtgactgcaaactaagcattttactttgtaacacaggtatagtctccttaagccatattgcacttatttggtaccttctaaaaattattattaatgaggacaattttggaacatttaatcctcagcaggtagtaataataattattcagtggcttctactgcagattactaagctgtgtcttttagggggtgtaacaatgagtagaattagttcttgcccttaggcaagtaaaagcatgtaggatataatacaaaatggacagaaaccctgtaaaagaaaaagtacatacatgctccccaaaatgtacaaaggattggcggtactctcaatagggaaagccatagctagttcaggcacaaaatggcagacagagcattatttgagatagtgcttaaagggtgcgtgagatttcgacatggtgaaactagactggcaattcaaggggttacaaaagggatatctgacccatctgtgggcaggagggttcatagagggtttccagaaatttcaaactgaaaatattaggcttagacgtccatacttttttaaaaactcaaaacaagaatttaaaaaatatatttaaaaaactcatttgtttttattttcccagcttttataaaagttgaaataattttggcatgacagggatcttaataaaagcacagtttcttgaaatggtattctatatgttttaatgaagacatatgtttgggttatttaaataaagtgccattattctttacttcccacacgatacagtttttctgtgtcatataccaccacagcatgtattgtctctgaagctgcattaaggaggcaggactcctttatggagccgcatctacattttggctgtgacacttcggcagatacttaaaaattaatttaacttatgttagtgtaactcatttatatacattctgatttgatctttaggaaaactcagaggagcagatagtgtaacaaatattctttttttatgggaagcagacttgaagttttgagtggtggccagccagctagaaagtagtggaattagtatataccaaatttaatgccttttctgtgattttcctagaactaaatattattttaggagtaatgcagttctcataagtagaaaagatagtatttaagttgtttaattttttttttgaattctctaggctattctgcatttatggaattttccactaggtaatatgcattcaggtcacatacacagtgagattttctaaagtgacagtacagataaaaaggctgtgcaacttggtgataattgtgctccatttaagcaaccatcaactggtgcatttttttaaagataaattagattttatcaaaattgaaatattttttctttttgatactttatgttctgggatacatgtgcagaacatgcaggtttgttatgggtatacatgtgccatggtggtttgctgcacccatcaacccattatctacattaggtatttctcctaacgctatgcctccccttgccccccacccccaagttgtgtaattttttaaaaaaaattatagtacttggtgtcaaaaccttgtccctgatatcagcagtatgaattattaatagataccatctgaaaccctggagggaagtaataagcttttaaagatgttcatcctgatgattagcctgtcatctttcatggggccctgaaatcaagaatccaccctttttcacatggatataatggatttaatacagtatttagcattatgcactgtatatatatgtggtcttttccctctaggtggctctctgggtctatatagatacaaactattgagaaatgtggctattcctacctttattttgcttctgtgttctgtgggactgtgaattacattttagtaaactgtgaagcccatgaacacatagtatcagctgctcaatttagtgcaagtttgaaaaaggaaataataaagcaaataagaattaacatttatttattacatgctcacaaacttgggggaagaggggaagagacagacaagtgaatccaattgcattgctctggtttggtctagtaagtaaagaaggttgataagatttctataatacacttcattttctaggatccagtcatttgtactcactttgagataagtgtctggaacataggagtagtgatttatctatatctttaattttccatagaaaacttggttttaaaagggaataaaaataattacttttatacttaatgatagtgctaaggtactaggggaaaggaatctttggatttaccagtatatgtatttgtcagtgctctttttcttcctgaccatttgacactttgatctgtagtaatatggcgtttgcttttaccactgtatcagaagcactcagggctgtgtgggttatttttgtcttgtaccgtgatagattttcatgcattaacttgctttcttgatagtttttctgacagcttttcatgtgttaacatgctttcttctcttggcatcagtgagaagtatctgtatctggttcttccctttcctctcccagtcattctttcttcttgtggatgcctcttaaatagtgtctttttaaaacaatttcaagttttattttagattcaggggatacatgtgcaggtttgttacaagggtatattatgtgatactgaggtttgggggacagttgagcctgtcatccaggtagtgagcatagtacccaattggtagtttttcaactcttctccccctcccaccttcccctatcttttaagtccccaatatctatcgttgccatctttatgtccatgtatacccaatgtttagctcccacttaaaagtgagaacatgtgatatttggttttctgtttctgcattaattaggttatatacttgattttattctctttctactctgggttctccatagacagtttcataaatgccaaggtttcagctatcatttatatgttgttttagtccctttgggctgctataacaaaaataccatagattgggtagcttaaacaacagataatgatttctcatagttctagaggctgagaagtccaagataagaaagacactgacaaattcagtatctcaggggggccaacttcctggttcatagacagtttctgtgtccttttgtgatggaaggttgtcagagagatctctggagtctctttaaaaaaaaaaaaaagttctttttggagacgtatattgcccaggttggagtggaaggctgggaccataggtgtgtgccaccacactgggccttgggggtctcttttataagggcatttattccattaatgcaagcttcaccttcatggcaaaatcacccccgaaaaggcctgcctgctaataccatcatattggtggttgggattttaacataagaattttggggggaacacaaacattcagtccataacatatgccgttggtttccaagtccatgtctttagcccattcctctcccaagctttgaaccaaacctttacctgcctgctgtggcaggcctagagtaggttgtcagtagagttggaatgaatgaacaaatgtttagaacttatcatctgccttctccccaaaccagcctatcctctcttttctctgtcttcttgaaactactttcccaaatgcaagcttgctttgagaatctttgactcattctttttcttacctcacagttaccagttcctatccaggtttggaaaaaatactgacttggatgcattggcccttccctaagcctgctttgattgcattccagtcaagcttctaatttagatccagtcacagtgcagtgtaattaccagtatctttctgtccccactctgcgaagtttgtgggcatataattaataaatgtttgttatttccttcttcaaatttgtgttaaaataagtggctgatgttatgtattgatggactcatagtttaattatgcaggttttaagacatatactgatagaaaatttttgaaccctactcctgaaaataaattccaagatttgagtgattaatcagtatggagaaacaattcccagaagtgtttctttgtgcattctttaggacttgaccatacacaaaaagttaaattgtatacagagtgcatagcggcaatatgttgaaggacataagtagtgcttggtacattaaatgataaaatgatctcatttgattataacagggcctgtggtgtatatgtagataaaatggaaatagataaggtactgttctctctgaatagtctggggtaataaattaatgtattgtttcttgttattatgtttaaaccatttcattgtaatgctgtaataatttcacttgactaattgggtgcagaggaaaatacaactttttgaagttggctaagaagttctttatttttggtttaaattagcataattatctcttctgcttggagaagaaaaggaaaacctatattaagaaaatgtttaaatacaattattgtgtgtcagtttggtggctaatattcttgatcttaggaatcatgactacaatctagtatttttatgtttgattaatgttgagattaagagctgctggaaatgaatgcgtaggttgctacttaccttctcccacttttttgtgcctctgtaggtacatggactatatcgcacaacaggtgctagttttgagaaggcccaacaggagtttgcaacaggtgtgatgtccaacaaaactgtccagaccgcagctgcaaatgcagcttcaactgcagcatctagtgcagctcagaatgctttcaagggtaaccagatttaagaatcttcaaacaatacactgttaccttttgactgtacctttttctccagttactgtattctacaaatatttttatgttcaaaacacacagtacagacagcatggatatttcctgttcacttgtgcatgggctaaaaccaggaaaacttccttgtcttattactttacctaatagtttcttaatatttcagtgccccttgcagaaaaaatattacatgctaaataaatattctccatatttttgggggatgacattcagtgaattatttcagtggtgacccactgaaaattaataatggtacttatgattaaaaacgcatttaatactaactgcagtagttctttcaagaatctttagagataaggattgcacattggaaaagtaaaccatgtttcattcctttttccctatttatattgaaagaaataggccagcagagacttagggattttaaattggcttgctttttagctgtttcagtcaccagtgaagagcctatgtgcattttgtagtagataatgtaaaatttgtcatctttttcttttcttttttttagaatagctgatattttgataacaatctctaatttgcatgggcaccacatttcttatattaaaagaattagtgttttggcttctgtactgcttatggttgtaggattcaggggttaatggaatcacagaaatgatattctgcaagaatttcttttaaataaaaagtttgggggtgcaatataagaagtttatataatatgcagtacattatccaaaagagaaggtagttaatgcagtagaaagtagtggtaataattcctttttaaaaaaatttcggtagtcatatagtaacattttgctatatgaaaactttggtatattctgtggttacaactaagattgtgtctggcagctcttttttggggatgtgtgtgtgtgatttttaacagaggtattaaaggctagcctaactgttgtctaaaaagattgtacagtatttaagggattttccttttagcttttcatctccagtggcattaaacataaaaagaccctggcattttttcacatacttgaatccctaaatgcacctgtctttcactttttgagacagactgaatatatctaaaatttccagcaataaaaaaaaaagcatttaacttgcaccaagcaagaaaatataaatacagttaactgcattaagataatcacgttaaaattgttactatgcagcacagaacttcattcttatagtattcttgggttcaacctttgaatcaattttaccactgattaaataaatgactcaaagacatctgtaagtcatgctgctgtgttttgaaagtctttaactaaattaagattgcagaatgatagtgattattcaattagattttaagtaaggattgtgatattagaggctggaaatccttattttttaaaaaatcagataggcataaatagttaaatcactttcattctccccaaacctgtagttacagaaaaagttttatgctagaggtgggatgccaagttttcactatccatgaagcagcgctgcatgtcactaggtaacacagatccatccagatggtgtttacatttgatttatttgggatcttattgacatcaggtatacttggaagacatttcttttattcttcagcgtatgaatttaaagctattttttgtaaatatttctaatcagcgataatttctacctatgttctcaaccaacttagccagtttgtttttcagagcctgtagtcttattggaaatctattttatcagtgtgctttattgagtgtggattttgcatacattcaaaacattaaccacaaaatacagcaagtgcacctatattcaccattaacttatatcccaagtccattttttcctgtacactacaaacaaaagatatattagagacttttgaaaaatgctgaaatactttgcttcagaattggaatgtttatattatgtagaaatcttcaaaggtagcattattaaatagcaaagaataattagaacccacatatctttttttgtgtggatggggaaaatgttttaaaatccagttatttaatatgagtttgagagagaaaattgttttttaaaaatatatgtgcattgaaatgatggcaatgcttatagtatgatcaagtatgaaaggaactttaaattcttatatttacttttctctcagtaaattgttaaattttcactcagcaaaagattggcatttgttaagtgttctatatttagtactaaaatcacagtcatgaaatcatagtcataaaatggtcttcacacagcagtcatccgtgtcatttatcattttgtaatattaaattatggcaattttatttcaaactaaagtttgaacaccggaaagtcattactcagtgatttgtaatttgggacttggattatttatctagagatgtttgtatattttgtcagtaactaatactgcgctgccatcatggtgactgtcatggttctacagaaatgccctccatgtgtccctctaatgttgcatgtttcagtgggttggaagttttgtatatttattgtattaacacagagtgtcataaaataaaatgctgtttactggatgtttgtttgtataattttgaacactataatagcaattcagagacagacattgttaaaggtttgatgtatatagaaattccatgtttgattttttaaaatatgtgtataagtctgtcatgtgctaaacaaaataatatgaaagacctagttaaaaattctaaccaatgtaaaatgaccatttttctgttgcattagacctttacaggtaatggaacatgagcttcacccatattaaatattttggcccctttaaggtcaaaatacagatcatctagaagttagattcaaaatggaaaacctattcatggctcagatttttcattgtgggttaaaaatgggtgtctctgtactagtattgtatttattcaattgaacttgtattctgatttctatccttgctacctattgctgttttatgtactgatgaaagtacctatttgtgtatattggatttttcacttggttagctaaagaagatgtaaaaatatctaaaataatgttcatggtgaatcttattttgagaaatacatgttaaaaaaggaacagtattctttattttctgggtgttatatttaaaaaagcaagtttggatttttacacctaatttactaggaaaatattttattctgtaattcatgttaagattatgtatggtttgcattttaaggggatttatgttaggttaattagttgtttctgtaaatcatttgtaatagcatagtgctttttactcattgctgtatctttttctgaaaacactgttgttaacatctaattcagtatccttattggtacaaatctgtgtttggcatgactgtttatatacagaatttgttacattttgagcattttttcccctgcttatgtataccttagagttaccatggctgtcatataccatttcactatatctcctttcagtttttccttaaggaaaatgtttagaggaatttgttcatttcatgtgattaagccctttagagatgaaataagattggttaattttaaaaaaattgaggatggttaaaaaatagaaaacaccttactttgatacattttaaagtacaatagtatacatttatttagagtagactaatgtgtttaaaacatgagttgttttaaatacttttttattgagctaaaaagttttatctcacatattaagtattacagaaagtgaagtattttggctagaattttagggcatattttataaagcagcatgcctgtaatattggtgggtatttttaaactttaggactttatcacagtatgtagagagctagaaataaatctagaaactttctaagccaggtattgccactaacctgtcttatataagcagatacctcttatttgaagattgtaggaaaatagagaaagactgttctccagttttctcacccccgctgtgggttttatatttacaatttaactttggggtttgggtaagacaaacatttaatgtataggattttggccaggtgtggtggctcacgcctgtaatcccagcactttgggaggccaaggtgggcggatcacgaggtcaggagatcgaaaccatcctggctaacatggtgaaaccccatctctactaaaaatacaaaaaaaaaattagctgagcatggtggcgggcgcctgtagtcccagctacttgggaggctgaggcaggagaatgacgtgaacctgggaggcggagcttgcagtgagccgagatctctccactgcactccagcctgggcgacagagcgagactccatctcaagaaaaaaaaaaaagaattttcattagtgctggccgtgtttcaaatggcaagggaacatgggaactatcatgtggcaatgtagtgagtgttaaactttgtgtttgtccaaatcctgatttatttttcagttcatatctttctgggcttgacatggctgatggtgtagctgaaaccctcctaacactaaaagccatttaatcttttctgtaataggagcagaaaatagttaatcatccacctagtaatataagattactgtgaatattatcttctatacattaaaacagttctagtttgtagaataataccatacaagttttatttttaaattctagttattttcagtgcttacttaaatgtaattctagaattcctccacaacttttaatattttgtatgccagtgattctcaagataaatcatgattgtagtagttgttactgttggcagtttgtagtagtattcaggtattttggggatgggggaaaacaccaaaaatcagtgtcttttatctggtgatcactgtggtatctacagtattctagtctcctgcacaaaaactgaacccactgggcctatgcatccctcacactttttttctagtataaaagcaatacataatgtgttgtagaacaattaaaaattcagaaagtgatacatgagaaaataaaaataaatccttaattctgtca

SEQ ID NO: 2460 - DNA, 553581 bp, Homo sapiens
cccgtgtgcagtcgccccgcgccccgcgcgacccttcgggtgagtacgtgggcccgggcgttgggcgagcctccccagccgttcggtccagccgcagcggagccctcccggccctgccgcccgtgtcccggctgccacctcgtcactgcccgcgagtgcggaagcagccgcggaaccccggcccggcccccgaattctccggcgcctctgctcctgccttcctggggatggcagccaaagaggcagggtgaagtgtcaaggagggaggggggacgcgccagccctctggctaagggcagaggagactcccgggcgaaaggctcttggtgggagtcctcaaactcccggctccagtgtgtgtgcagagatacggcgggagagcagaccttgaactttccttgcttcagcgattcctagcctaggaactgagtaaaagccctatttttcttaattaaattaacaggttgcagttcgtaggtgttgttcttgggaaaaaaacaaagacttgggtgtttgggtgtttgctaacttcatcgtgactaaataaaactattttttttcattcctatttttgaaaatgccacaggcccacaagtgtgttctaccctctgtggaacaatgaagtatgtgtatgtgtgtgtgggtgtgcgtgtgtgagagagagagagacacgggagtaaacatcacatgcttatcaggaaccaaaaaggaaaaaaaatgagtaaaagtatgttgaatataagggtatgtattgcccccaattataaatgatgtattgtctgaaatccaaggaaggacttctaggaagctacagggttttgttttggcttcagaaacaaggtcttccaatttattgaatataaaagtagttgaatccctgtaaaccccatttttttttgtaaagtattgacatttgaccatggatatactttcttttatcccccaagtctttatagtttaaaagtaattatggattttgacattttgtctcaggcatttatccctcctattccaccctccatctgatccgtgtgatgagaaactggctcttgtcagttttatctaagtttctttaagctgtcattaaaaaataaacttttcacatgaattctatttaattcattaaatgtgtttttctttggcattgtgtttggaatatgatcatggcaatttcttttcttttctttaatttctgtctttctttctttcatggagtcgggctctgtcgctcaggctggagtgcagtgccatgatttccagctcactgcaacctccgcctcccgggttcaagggattctcctgcctcggcctcctgagtagctgggattacaggcgcgcgccaccatgcctggctaatttttgtatttttagtagagatggggtttcaccatgttggtcaggctggtctcgaactcttgacttcgtgatccgcccgccttggcctccagaaatgcggacattacaggtgtgagccactgctccgggctggcaattccttattgcaaacaaatcactgaaaaggaggtctaaacatttttaaaggatatagtagtgattatattttaattttataatgtgctccggctcataaatattttgccatttcaatggagagttttctctgttcagaggacccctagacctactttgcttttggagttgctgttttaaaaacttgcattgattaagcaatttgtttacccaaggactgcaggataggaacaagggaagaaaaatcacttaaaggttgagacaatgtgaagagaaaatctaggaagtgatttatagatgtaaacctctaaattagctaaggtaccacaaatattatcctggaatctatcagaaccacttatggtggttttattgattgacttaaaaggttgctttttatttaaaagcccctgtggtcttttgtattagactaaaagtaagaagttctaactttatttctgttattattgctatttgtgttttttttttaacctgtattaggcacttgcattatgtaaaatgctatgtataatcttttcctgcctttttatctaacaatttaagataatgtactcagacctgtcattacctcaggactggtctgtgtgtatgtgtacatatgtgtgtgtgtgagaccaggtaggttggaaagtaagtataagacttttcataccccttgtgggctctgcctctccccacccccacatccccataccactaatagacaaaaacagaaatgatgttttgccacctgagattgcttttgaaagtttgtagctctttgaggacattccatatatttggtttttcacctttcttccatttatccttttgcagatttggatatgtattatccagactctactctctctggaatggagtcttccagttttttttttttttttttccctcacccaggctggtctgttacgtgttatccatacatctgtttattcatttattcatccatcagcaaatatctatagagggcctactagattcaagtcatcacttagtacttactcttacttccttcccattggaattttattctgtgttttatacttcacacaatggtaactaagagtaataactttggggttatatagaggtagtcgtgcctgtttctgtcagctggtagctttatgaccctggacagatcataacctctctgaatttctgtttcttcactggtaaatccaaatggcaggtatcaggaataattgagagaatacatggatagtgatttccaagagcccaacccctaaaagcactaaaaagtgttaattacaagtttgctgtctatatctactgcatccctcttcatctcaggaaatgcattttccatctcaggaaatgcattttctatctcaggaaatggcagttccattctggattttgcctaggtcacatctacatccaatgtattagtaaattttattagttatttttgaatgtgtccagaaccagagttgtttaaactgccttaatttctctctgcttggtccaagttgctgcatctttggcaacggcttcctcagtagcttccctgcttctgttccttgccctcctttcttacaaaatattttcaaccaggaaacagacaggcctttctgtcatataagtcagattgtgtccctcctctgcttcctgtcccactcagggtgaaagcccacatacgagggcttcaaggcctgctcatgatcagatgctaccttctgtacctaatctctttcatactcccctgcacctgctccccatccagtcatactgccctccttaacgatccttaatttgctctaaatgtgcacccaacaatggcctttccaagttttgttccctctatctggatcacactttccctagatagctgctgtcttctctcccttctttcatgcctgtcttctaatgtcaccttataatgaggtcttcaacttccctcacacctgacactccctgttaacttttccttgctttaattttctctttgaactttcttaaatactgtgtttagtttttatctgtttaatatctgtttccctcaaagaaactatcagatgcatggcaacaggactttgtctggtagttaccctagcacataggccagtgcctggcaaaaaataggcaactggtaaatgttgaacaaatgaatgaatgaatgttattatggaattaacaaatctgtacatcatcacttttatatgatgatcagcactcttttgctctgaaacttttgataattctctattttcagtaaaatacagaccaacacttttggataatctttgttggactggctccaaattatccttaactctcacaggataaccccaagcacccagtgttccagccacacagaactagtgatacatctctacatcagccccaggcggtttcctttgtgcctttgcacaaaatagaagtactgtgatttttttttttaatatcagatggctttatttttctaactaacgtaaagggtaagattttagaatttatgtccttgtgtgtggaaggcattgcatggagtgttgaagccaggtggcttggatttaaattgtggctctgatataaattaattttgttattctttacaaggtacggaactctaagtctctgttgcaatatttgtaaaatgaggaaaataatattttcttcattgggttgctatgaaatttaagagatgcttgtaaagctcatcagcatagtatctggtatatagtatgtgcttaataaatgttagccttagaaatattaatttaacacctcgtgctgaaatgagagggagttgagggggggtgcattagtattgttactggccacgtcatcaatgcagtccttggactccactgcttctcttcgctttgtttgccttagcggaagttgaatggcaggttgctccaccttctcatctcacctaaacaatgagggagcttctctttgtgagtgtaccactcagctcatccagtagatgcctactgatcacccagtatgagcccagtattgtgctgtgccctggcagtaaacagccacttctctgaggagcttatgatcaagtgagggagacaaacacatacatagataatttcactatagtgagccaggagctaagataaaagctcattctcatctgtggttatagaaatgaatttttaaaaatggaaaggttttgcagactatgtgccctgtgtaacatagtccatttgaacagcctcaagcctgcatttaaattaacagtagatacaccaaatgatcatactgattgtaaagatgttttatgtgcactacagaggtgaaaacagttttggttctctggataatattggggtacctaaggaactagaaagtagggctgagaggactaggcaaacatttgcagcctgtgtacgaagtcatgaagtgaggataagcagaggtttaattcaaattattatgtaagggtttgaaatttgggaccctctagaagatatcacttcaacttcagaattatgaggcaagaataaattccagccagcttaaatgatcaataatggagtcctgttttgttctgctagttgaaattgttagtggaaataaagaatgagctgtaagcatgatgggaaatatcttactggaagaaacacttccagctttgtggtatattagaaagattaagggctaggtgtaagtctggattcaaatcctgatgtttccacttgttatataaattaaacaggcagcaactgctctgagcctttgttttcttccctgtaatgtggcagtgatagtagcattcatggcattactgtggtaattaaataagatcatgtactagtgcaggattattgctcaatgctatagttctcttccctaaataatataaatgctggagagaaacagctgtctcagaaattttttgaatgttctaatttaacttgagcatgtggacattacatagcccacgaagcaagtttccgaacttaaaaacaacaagaaaataagtatgtgctagcctccaaaatgcgtgtatttaaaaaaagagtcaagattatatgtattggaattgatctggccgtctgcaggaaatggtgatcaggccctggagtcagcctcagaggctcagatcacagctcttctgagaggtgactttgggccagttacaaagtccatgtgagcctcagtttcctctctgtaaaatgaagtgataggaatgataataatggtatttcagtagtatttctaaatcctactgccttaattctgtgtgttcatggtgggaggggaggtggtgatagcaaccatatcagaattcttcactggcgaaagaagcaacagcagcctgtaataacagcttcttaaataatactcctttctagttctgatgggcatatgggaactatttctttttcatgactcactggtgaccagtgatgaattttttttgtagtggtggtctgtggacacttccaaaactgttgtgtgaaatcgagttcaaaaccaacctattctggcattcttacacattgaatatcatgaaaacacataaaagttcattttttttgttcttcactacttgctctgctctctttgatgtgagagtcacacatataagtttctgctgctatagcaggtgatgagcctcatactgaaaaatatgaaaacaaaaacaagactcttgaggtagtcaccattcctaggtggtccaagctacagcccctggggacagatttcagagtgttcacaaagataacaagggacttaaaattgcttagaaggcttatgaatccagggcacagtcactatttgcttggctgaattctattgccaatgtttatattgccaatgtttatattgcttttgtaaaatagtcatgacaagtcctcattaactaagattgtgggttgaattggcattcgtcagcccagaatattggattgggactcaggagccttggaggctatctcagatcttccattgacttacttcaggcttgtggcatggtctttgtgatttcagtcatgtataaagtgagaatatttattaatggatactccccccaccaagtgttcagggtttataaaggattctttctcaacacacacacacacacacacgtgcacgcacacacacaatttttttttatgcattagaagtagatatattacagagttattataattgtgtctggagaagaacatgtctccagaagacatttaagggatggcatccctgggactgggacctgggcctgctctctaggcaaggaaggtgcaaggagttgatctggctgtctgcagagaatggtgatcagcacctggagtcagcctcagagattcagatcagagctctcctgctaggtgactttgggcaagttacaaaatctgtgtcagccccaatttccaccctgtaaaatgaagtgacaggaatgataataacagtatttcagggggttgttatgacaaaaatgatacaatgatacacgcagacatccagcacagagcctggcatgcaaactgctgtaggctttgtaaaggaccctcttccccctcttccccctcttccctttctgaattctaactaaactgggagagaagaaaaatgaattggcagatggcagtcaaatttttgtctgtattatttttgatatctaagatttaatcagtgttattgctgaaaaacagacatagtttagtctgagagccaaatgggctcacaaagtccaaaccccagaattagatagacataatcatccacttacaagccctggtggacccagacagatctcttcatgtggaagttacagcttgtgttctttatgggcaggccggttcccaaagaggggagaaggaggagctaagcaagactttggaggtgggcctgaacattttcattttaagacagctatgtacttccagtgcacatattcaggttaggacctactactgtgggcatattacatattttgcagtgctctgtgcctttggatgtgccgtagccactgcctagagtggcttgccttctatctgtcccttcttcactagtaaaaaaattctactaatcctccaaccttaaacttggggatatcctttgtgaaatcttcctctttattctcattcacccaatgcaaagttgcccagtcctttctgtgggctactactctactgtagacttagctatttcatagaacttactctctattgaaattatttgataactaggctgtgaacattttaataaaagtttattcacctgtatacatttgtcaatgtttagaagaagatctgaaagtaattacaccaaattcataagcaatcataactctgaggagagggatttgggcagaggagagaatattgtttaacttttgttaatatatgctcattttacctctatattgttttgattttgtaataatcaaaaagaggaggccgagtatggtggctcacacctgtaatcccagcactttgggaactttaggtgggcagatcatttgagcccagaagctcaagaccaacatggagaaaccctgtctctacagaaaatacaaaagttaaccaggcgtggtggcacatgcctgtggccacagctactggggaggctgaggtgggaggatcacttgagcccaggaggtggaggctgcaatgagccatggttgtgccacctctgcatttccgcctgggagggcctctacatgtcatcttggtcaccatcccaattttggacagtgttctgccctctcacatcccattgtctccccatactctttcattgtttttctttcctaagtccccagatgatcagaggtatgattagatgttagggaagggacagtattcgctttcctcattctcagacttgtcttggagccatgagtaggaacaggtatcatcttttccaaatacatttttatggaactgttataaacctgaactgataaaaagaagaaagccattacttgttttcctcctctaaccctatctatcttttcttatacaggtaaactacgaactgggagttctgaagaatgggtaaagactttcgttactatttccagcatccctggtctcgcatgattgtggcttacttggtgatcttctttaacttcttaatatttgcggaggacccagtttctcatagccaaacagaagccaatgttattgttgttggaaactgtttttcatttgttacaaataaataccctagaggagttggctggaggattttgaaggtgcttctatggctacttgccattctcacaggactaatagctggcaaatttctgttccatcagcgtttgtttggtaagtaccatgacccatgaaatgtaatatcactaattatttaatttctattctccaagatacaactttgctatttctaagtgccaatgtaggaggcattttagtttgtcctcctgccttaagttgttatgcatggttgtaactgggttcttcaactactctctgttaatggtttacttttcctactgtctaaggaaaattagcacgaggtaaaattagtaccaaacttcattaaaaaaaaatagcattaggccaggtgtggtggctcacgccagtaatcccaccaatttgggaggccaaggtgggcagatcacttgaggtcagaagtttgagatcagcctggcgaacatggtgaaacctcatctctactaaaaatacaaaaaatagccaggcgtggtggcacatgtttgtaatcccagctacttgagaggctgaggtgggagaatcgcttgaacctgggaggcggaggttgcagtgagccaagattgcaccgctgcactacagcctgggtgacacagcgcgactccatctcaaaaaaaaaaaaaaaaaaaaaaagagcattagagataaaatgaatatatacctagtcattttttaaaaactttttttatttttaaaattttttttattatactttaagttctagggtacaggtgcacaatgtgcaggtttgttacataggtatacatgtgccatgttggtttgctgcacccgttaactcaacatttacattaggtatttctcctaatgctatccctcccccctcccccaaccccatgacagggcctggggtatgatgttccccaccctgtgtccaagtgttgtcattgttcagctcccacctatgagcaagaacatgtggtgtttggttttctttccttgtgatagtttgctcagaatgatggtttccagctgcatccatgtccctgcaaaggacatgaactcatcttttcttatggctacatagtattccatggtgatatatacgtaatcttatttagagaagatatgaacatgaaaatagcttttcccctcataaatagtaccaaagtgttgtagagagtttataaatcataaaaaaatgcctccatatcacagcacattttcattaaatatattttacacatattgttcattcagggagttggaactataaacttttactctctctctcttttttttttgaacattggctttaggatgtttattttgagcctatccaaccaaagaatagtatattagtaagggatctcttgataatgacagaagaagagactaaattagtttaagttaaaaaggtaacttactataaggatgttaggatatttcagagactgagggtagaatgaagtgacagggacattgggacattgggataaatgaaaccaagggtttgacatctgttatgatgcgtttgtctctctctataatatctgctttattctccttttacactgaaaatgaatttttattacctagagagactgggttgactttcctggtctcaagtttaaactctcagggaagagtgtgaagttgtctcagggtttggttcccacctctgaactaaccgatttttgcctagaggtaggtggtatttattcaatagatgttcatcgcttattacatgccagacacaattctagacagtgaatcaagcaggcaaggtctttgccttcataaaaacttacttcctacaggagagagaaagactaaacaaataaatgtatactctgtatgcaatgggggaaaagaaagtagttttgagtgctgggtcaattaggaagagaatgtaataatagagctttggacttagcagtgataagataaataggtgacttactgaaggtatttttggtctagagtttgggttagaaaccatggcaatgttttaaggaataaataaataaataactatccgtacacacacacatacacgtagtattatgtatgtatttttctctgttcctcaaattattgccatctgtttctattatataaatatataagatgtacatattttatatcgtcttgtgcctatatgtatacaatgcacacatatgtatagatgcacatagtttctagacatttggtgagaaactagaagaaagaaatggagaagtgctaaaaatggaagaagggccaagggaaaattttgttgttggtggtggggcagatagttttatttgggggataagattaattgacctgctgatatttgtgggagaaggagctagattaaagtggagataaaaagatatagatgaaagatagcatctctgaaggtttctgtggtctgggacttaagacacaggtagaaatggtggcttagagaggacaagaggagagaccctggtttctcaaatataggcatgggtgagataaagattggtactatattaggtatttttgaggtatagaaacaggaaggtgaatattcttctctctgttgaacctgataacctgatatctctttaacctgataacctctgttttactgtgaaaaagaagatcccatgataaagatggaggggcttgatgatgcaatgggtttaaggaagtggtcaaggtttggaacagtggccctagggagttgggaagtgaactgactcagaacaaatgaaagggttgctgattatcatgaagattgttagccactataaatttgaatgataccaatctggattgttgagcagtgttctttttgagagctcagtcatccagaagagaatttcagcatgattcatctgggtggggactgctcaggcttgctgtattggaaacaaaggatggaaaataaatggagagttctagtaaaagcattattcatttgattgacagggggttgtggttggacatggaaaacaggtgagggagatgatggtctggtattgggggaacctgcccccaatattttaacataggttctattttccataagtgttggccggctgagaaataaagagagacagtataaagagaggaattttacagctgggccgccaggggtgacatcacatatcagtaggactgtgatgcccgcctgagtctcagaccagcaagtttttattaagggtttcaaaaggggcgggggtgtaagaacagagagtaggtacaaagatcacatgcttcaaagagcaaaaagcagaagcactgataagggtctaacaaaggtcacatggcaaagggcaaaagcagaaccactgataagggtccaacaaagatcacagggcaaagggcaaaagcagaaccactgataagggtctatgttcagcagtgcatgtattgtcttgataaacatcttaaacaacagaaaacagcatttgagagtagagaaccggtctgaccacaaatttaccagggttgagtttcctcaaccctagtaagcctgagggttcttcaggagaccagggcttatctcagtccttatctcaactgcacaagacagacattcccagagctgccgtttatagacctccccccagaaatgcattcttttcccagggtattaatattaatattccttgctaggaaaagcatttaacgatatgtttcctacttgcatgtccgtttataggctctctgcaagaagaaaatatggctctttttgcccgacccctcaggcagtcagaccttatggttgtcttcccttgttccataaaaatcactattattctgttctttttcaaggtgcactaatttcatattgttcaaacacacatgtttcacaatcaatttgtacagttaacgcaatgatcacagtggtcctgaggtgacatacatcctcagcttacgaagataacaggattaagagattaaagacgggcataagaattataaaagtattatttgagaactgataaatgtccatattaagatgaaatctttacaatttatgttcctctgccgcagctttagcccgtccctctgttcggagtccctgacttcctgtaacagtctgggaggagtgggcaggggcctaaagatttggatgaaactcaacagctgagatgggagtaagaaaggggaaaggatttgtgggtgtggtcacatgacatgttgtaacagaagtaaaccattctttagtagtgattcccaagtagggtgtggtctttagagagtgagtcctaaagtggagtggagagatggctcattgacacagagaatatttaggaactcagttggatcatccaccaaacattaaacaagcatcatgtcctacatagtaattatatggatagaagaggataagggtggatagcgaatgggagtgggtcattttccaaaaatggatggagagtgctggggagacaaaacagtagatacctgttacaagcaatggctggatgtatttggatcccattcaagaaattttctcagcataggaagctaaggcaaatttagaccaaaatatccagtttggagaaaagtcatctgtctatattgaagattgattgagaatcacaccattaagctaatggtattaattataaacaggacatttggttttgtaattgcaacattttgttaaattattctgttgcaaacttttatctcttatactaaaatcacatttcagttatggcttagattttaattctcctggtggtataagtaatcagccctgaaaaagcactttcgatttcaagtgatttattgagtacaaattattttaaaataatgcaagtgaattctctctctcttttttttttacttacagtagaaaagattatatgatgtagtcagctttatttcttctatttggcagtttctcctttttttcttactaaaaacctatgaaattatatggaatattagagaaggaatcataaccttctgtaaatcttggtgaggactcttgatttaatttcctgatgaactccgaacttgtcacctctcattctctgatccaatttcctaataaactttgaacttgtcttcttcttctgtctctgctcatggcagttgattcttcattacttcatgaactattaatcatttcctcctaatagttatctgctcctcttgttcattatggattttgctagtggaattatttttttcatattgctaaatggcttctaccactgttctgtggtgagcaggtctgtgcaaacctatccccaaagactgaggagctgagaggctgaagaaagaggctgacacatccgttttcacaggaaacaacatttaatagggccttactaacagaagccatgtctcggtacctgtgagatgatggatccttgccctgttatcctccagacgcagggcttatacaccatggggaatttgcctaagggaaggattcatggtaagtaaaaatcttagaggccttctcagaactagggttgatcagaagtcaacatgatggattagcatttaagatggagttactttgacctgcagaaccaccaacagaataaaagctaaactcctttgattgatatccgaagctatttatgatctacttcttcctcactccaaacctgatctttcacattccacatactgcagggaaatatttgctggttctcaaacttgccatgttatctcatgtcccagtgtttttttgcgtatgtgctctcccatgcccattatgctcctctctgctttgtcaccttggctagttttccattttccttcaaatctcagttcaagcattatctcctctgtgacactttctctgactccctcccgtaagacttcagttgtcttctcttcagctcctgcttgtgactacttgtaccaaagagtcacagccatgcaatgatagggaaaataattaaaaatttaatgcaaacattaatgttcttattggcttggtatatgataaatgtttctgccctggttcccaaataattagcatttattcattattcatttttaaaaggacatatttaacaatttgtacatgcaaacttctgataggtgatgatgatggtgatgatgatgatgatgatgatgttgtgtgtatgttgggaggaatgggattgctaatgacgagcacagaaatttttgttacagaaatattggaatgccttacaaaaatgatcagaatcatttcttgagatcaactaaacagcttcttttttttatataattctctaataagataccaaacacagatattatatagaatgccactatccctttcatttaatcaacttgtaagtcttccttcatttattttgttatgggaagtctcttcttagtagattccagaaggacaatacagtattgccaatttaagggatgtgtgagaaagagtgaatgattctgtgagcacatgatttaatatacttcattggttataaatttaatttttctgtgagacataaatgttatgattttgtgactctttaggtaataacataattcaggagcaattctgaaatcagaattgatatgtttagaattttttttagtttaaaatggaatctttgggtattaggatttataaaagttaaattccattggaatgtcagtttatactcttccagtacctctctctctcatttgcttggatgattctagtttttttttaaaatgtgttttaataatgcatcctagcttttggggggattatactttagacatatccatgaatagagacatccaaaattcttatgcctacaattaggacttatattcaaggagaatttaatttcttgagcttattcaagaaataatttttattccaaaaaggaattgaaattatttgcaacatacatgcataatacagtagaagtagaaaatcaggaccacggaaaaggcagaatcaaatttgttttgatttcatgggtttcaaaaccttgcttggttttgagcttcctcagagctgagcacaaggggaaactacatcactgtcgttatcagcagtgatgaaaattgtaagttcaacagaggtctttttctttgcaccaaattgtagaacttccttgctataaattttggtaaagcatttcttttttcttgtgcttggtacaagagatgctgaatggtgaagtggcaaatgcagaaatggatttcatattcttgtgtcttaaagcaaacgttcatcaaagtgtagagtataacatttaaccagctgggcgcggtggctcacgtctgtaatcccagcactttgggaggccgagatgggctgatcacgaggtcaagagatcaagaccatcctggccaacatggtgaaaccctgtctgtactaagaatacaaaaactggctgggcacggtggctcatgcctgtaatcccagcactttgggaggccgagtcgggcggatcacgaggtcaggagattgagaccatcctggctaacacggtgaaaccccgtctctactaaaagtacaaaaaattagccaggcgtgttggtgggcgcctgtagtcccagctagtggggaggctgaggcaggagattggcgtgaacccgggaggcagagctttcagtgagccgagatcacgccactgcactccaacctgggcgacagtgcaagactccatctcaaaaaaaaacaaaatacaaaaattagctgggtgtggtggcacatgcttgtagtcccagctacttgggaggctgaggcagcaaaatcacttgaacccaggaggcagaggttgcagtgagctgagattgtgccattgcactccagcctggcatggagcgagactctgtctcaaaaacaaacaaaaacaattaatcatgaaagcaagcctgtgatgctttatttcatgaaaacatttctatgaagggcaaagtgataagggttcaagttactttgactgaatagctttatctgaggatggattttagaacatcaagactgtaataatgtatttctcagacaaactcctttcctattatttaccttctctcttttacttttgttttccaacatgtgcagagatcctctattagttgtcattttctttttaacactgcccttttaacacattgtcagatgacctccaccataaggagctgtcagtctctcaacaagaatgatgttctttgtattcattgaaggtattacttagctgaaactggagtggttggaaggcaggccacctcagaatgagttggtaggtgttgcatctgaaaatgattctaaacctgttaatactgcatacttccttttccaaacatgtgtttgcttatatagttatttgtataatgtttcattaatgtctgatttcccagctatacccgaaactctatgagtgagagattatgttgatcttgcttaccttttaattttcagtgcctaaaacaatgcctggcacagtagcattccatacatttgattgaataaataaatttgtttcttcatcctttacatgttgtctttgccagtgttaccttttttattttttgagacagagtctcactctgttgccaggctggagtgcagtggtgcaatcttggctcactgcaacctctgcttcccaggttcaagctcttctcctgcctcggcctcccaagtagctggaattacaggcacctgccaccatacccagctaatttttgtatttatagtagagacagggtatcaccacgttggccaggatggtctcgatctcctgaccttgtgatccaccttgcctcggtctcctaaagtgctgggattacaggcgtgagccactgtggctggcccagtattgcctttttattgtaagatatagaaaggtatttatttgttcatttataaaaaataagacatggtctctgatctcaaggaatttaaaatctggttaaaaagacaagatatatatgcatgaaaaattaaacactcttgatgatacaagaaaatgtgtatcgagtatcaaatgaatagtatggactgtgagtgctgtgagaatttaggagagaggatcatagtgggccaggacaggggaagaaagctttgttgcccatgtgggacctaaattgagtctcaagcgtgagtgggattaaaatagtcagatatgatgaaaggtattccttatagatttcaggtcatggggtagaaagtgtgagcaaagatggagacaactcagcttttttttggagttggggtaaaagctgaagaattcatgctcattttgactgagaacaatttatgttaggaaagaggcgttgcagtgaaaaggtaggttgggccaaaattctttggtctttaaatgccagtcttctatctttagactttatctcttccattacagtctttaagtcaacgaaaatatttgaacaatgtgtgagatgatgacaagattaatcttgaagcagaatttaaggggaattggaaagggagagatttggggagtaaaacagaagtaagaagttattttgggggctgcctgcaataattctggcttatgtttgttcagactagtctaaaataaggggtggagcaaaggcaagcagattggggtatgtgaggcgatgtgaaacctccacaactgataggatatgagtaggcaagagtgagagtgaaatgaaaggtaactaggaagattaggctgggagactggaggagtgattatcctactgaaaaaaaaaaaaagtccatagtggaatctggttagagaagaagataatgagttaaggaagtgatgacagcaggtcatgagcacataagtgatggctcatttaccttgaacagttcacagaacagtaaaggtgtgtgttactaagcttagtccaggcacactttttaaaaaattttatttttatttatttatttatttattattttttttctgaacctcactctgtcaccaggctggagtgtggtggcgtgatctcggctcactgcaacctctgcctctcaggttcaagcgattctcctgcctcagcctcctgagtagctggtattacaggtgtccaccaccacacctggctaatttttgtatttttagtagagacagggtttcaccatgttggccaggttggtctcgaactcctgacttcaggtgatctgcctgccttggcctcccaaagtgctgggattacaggcgtgagccaccgctcctggcccaggcccaccacttcttatccaaaaccttgaggccagatgtgtttcagaatttagagcatttgcctttatttaaggtcaccctgctaaataccccatcatcagacatgttaatatttctgtatatatgtatacatatttacatgaagttggataagtaaagaccacagacagactcaagtaagttcaggttaggtgttgctactaaatggattcaggtttggtcaggttttgcgaataaattagttacaaaaatcagagtcttttggatctcggaactgtggaaactggattgtggacctgtacttgactatgataagcatttctttttttctttttttttttgagatggagtttcactcttgttgcccaggctggagtgcagtggtgtgatcttggctcactgcaacctccgcctgccgggttcaagggattctcctacctcagcctccctgataagcatttcatatacatctttgcttaccccaagatagccagctgcataaaaatcatgattttttaaaaatgctgtagttaaaaaaatagaataatttgataactaaatatctgccatagatgaatacatgctaaagatgtacttttcttgtgtttatattatgcaaatcattaaggggtttgctattttctatgtacctatgtctgttttagtttgaaacaggaagtttggggacaaaagcatcctcaatatatccagagatttgggaagacaaattctagtttgtatatttcattttactgtaacaaaaaggatatctcccatacaataccaagtaactcaacaatattttgtcatttaatgaatttaataaagtgaaatgcctgtttgtcttctattttcttagctttaagcttagtttgaatttttttggtatgttgaactgcacatatgattttatcatttcaaaatagaagaggttaaaagattctgaaaagcatggtcaaggtagtcatggtaatacaggaatatcaaaacatgaagaattcgacatttaggaataaaaaactattattttaatacaatgatatgggtatggtttgacttcctttgtgttaatttgagatctgaatagctgaatagtataaataaccaacaagttatcatggtcgttgagagtatattaaaactgtatttatgactactcagggcaaatgtcaacaactgattattttaataattgtattatcagagtgctaaggacttttttggggaaattatttgaacagacgctgtctatatagccaaatgccatgtagaatatctatagttttaagctttgccccctcaaaatgttatattagatactcatgacaaatatttaatgttgtgtcaccatcttcattctcaaccagtctgtatggagttctggaatcatacttcttctaggtgcttgaattgtcaagacccagtcctttttcacagagttagtaattttagagcccaaagtgaccaacagaatttaagttagagaaaaatgttatttcaaagtttggagtgaccttctggcataaggaatttaaaaaagcagttcctcatgtctatcactatgaaacagtccctcataccccatcacaatcctcctcctccctctccaaaccactcctgtcaactataaattagtttgcattgtctagaattttatataaatgaaaacatacagtatatactcttttttgtcaggcttctttcattcagcataattttgaaattcattcatgttttatgtatcaatacttcattcctttttatttctgactggtattgtgtgactgtgtcaaaatttgtttacccatggtatctgttgatagacatttctatttttttcagtttttatatatcacaaatctatgaacactcatgaaaaaaaaataaaaaagcagttccttaaaaagacatgagatagattaggaaaggtaacctggaaaattattgatatttgatgttttaaaaaattcccaggaacacccttcttcagagggagatttggtgtgttggagctactgaactttgtagcccttttcaaaaagctgatcttattactttgtgttcctgttatgttctctctcctagagcaggaaagcaaggtaaggctggaaatcccaaggacatggccatttcctcccacacctgcttattaggtgccttcattagtttgcagtgcagtcagttgcacatccattagcgctaaagggcaatgagcttcatgcagctttcagtgtgatagaatcgtctggctgctctagttcccctaggacagaggatacaaacactgtaaaaggatacctcaaggacttaataaactaacttaggttagagcattataattaagcaattatgaaccagggtgcctttctaggtacttttttttttttttattgtacttgatacaaatgagtcattcagggaccaagggactcttttcttaccaggtccaatcattgcctccacgtccttttctcatttcctacccatgggaggtaatgctagaagtttttcacaaagggggctatcacatggaattacagaaggcagactcatatacatggtgcagagggaaaccacttcactattagtgagatgtaaccagccagggtggaatttgacagctggttaaataacatatggtaaaattgaaaatgaaaagtgcttgattacttgattcatttaaaaccatattgatagaggtcttagtttgcttattcttcaaataaaggggtaatcagtcctggctgagtagagtactgtgatttgagatgatgctgccagaattttcccctgatttatttccttttatcttttattaattcctacaactagaatcatttcttgaagatattttcactgggtttaaaatattatgctacttgagaggtgtgatgaactaacaaggatgttaacaatcccatcatagagagatctgtgcccaaaggataaataagtggtggtaggtgggaggaagtaggcgaatgtgctgatatggtaactatgttgccctgcacggttctggatagaagcacgggtcaaagaaacgctgttagaagatttagggatatgcagagggtcagactggaataaggggcttctccaaagacaggctttagttgttttactgtggtggccttgacactatatctgattttgagtatcacaggtggtccaagcagtcctattgtttttaatttggattcctatcgtggctgtgacccagagttattgttgatgggtaaatagaaatgtacagggttgatctgcctgccttcaaggtcataacagtagccagcagtaaaattggaacataaaccgaagcctcctgattcccagacaggcgccttttcaggcatcccagatggcgaactggcagccggtgtgccttgtctgccttaggaccggattgtgctaggccactccctacagttttgctctgcattgcctgtgttctggcatctttttctggcaccacctcctgcctgaccagctctcacttttggttaaagaaagtcatttagtcgcccccacaagaagtcctatagtttcagggcaaagtctgtcattgctgtggagcccagagaaactcagtacaatgcttcctgtccttgtggccatcagtaacctcattttcttggctggactatactttttccccttaatttcagaggagtgaaatctagatattcttaggctactccatgcttgttatgatactttgtgtgtcgttgaggatgtagccattgaaatggacagactagctaagagtaaccagcaaatacacacaaacctgagagagtgagttggaacttgctcttcagtatctcagggaagagtgtcttttatgtcctttccactttattcctgtttgaactgtgctgtttttcaacatcatcattgacaaatgtgttgaatacctgttatttgcaagggaaagcaccaggtgccatgagcctctgccttttaggagggaaaattatcaaatatgataattgccagcactgcagtgggagtggaagggacagtctcttttgaagggggcaagaagtcaaaccgaagagaaatcatcaaataaagcttcctagagaaataggagtttgtgggaatcatagaatctcagagtgaatggaattggtgagagctttcttgttacattttcagccaatctctgagcacctccaacaaaggcgattatccccaaagaagtctctgtgttcgattactgtttctgcatttcctgtgtgtgaacctgagctttgccattacaactccagcggaattctgttggagggaggagggccttccaagctggagaagtggcaagcgcaaagttgtggggaaggaacgggcaaaatggttgcagtgtagagtgtgaacaggccagtgtttctggatcagtagttttgggtagactggcagcaggaaagagaaacttcagtgcaaattgtgaagggtctggaattccagatttgggagcttaaaattcattctgaaaatgataggaagccatggagcatatctctcccttcttgatttgtaaatgtaaaaagttatataaacctattgtgggaaaaaaaacagaatatatgaagtcaaagaagaaaaattttttgatcaaaaagatgacgagatcaaaacagtatcataggaaaatgcatgcaggcttagttggccttgaggcagggaggtgtgccacagttgctggggtataactgacctcaagtgatcaaggcttgatttagaagtggtggcaatgagaatgaaatggaggggaaggaaggaagagaatatgtgaggaagactgatagtgcaaatacagttttcttctattctaaataacatcattttaaggactcctattccctgagtccattcccatcatatactgaacataaggcataacaatctatttctaaaattggcaacttaaattatcattagatcatcttactttattctccaagtttgctgaaagaaacaaatgtgtggttctggtggttatttgtgacactagaagagactttaagaaaaaacagatttatgctcactgatactaagctatgaaggtgttaatgtcattgagtttcttcttcttattattatactttaagttctggggtacatgtgcagaatgtgcagttttgttacataggtatacacgtgccatggtggtttgctgcacccatcaacccatcacctacattaggtatttctcctaatgctatccctcccctagtccccccaccccgtgacagggcccagtttgtgaagaatttcttttttgaagcttagcatttgttgaatttgtggatcatgctcattaatttgtctcatttgcaaagtacaggagccttaatgatataggacttgattttgttcattcaataaacacttagaattttctaggccctggggatccagcattgaacccaacaaggtccctgctgtgactgagcttacagtctagtaggaaaagatggataataaacaaataaatcattatatattatatcagagggtgataaatgctgtggtgaataataaagcagggagagtctagggaggggtccagagagttcccggaattccctccctaatgagatgatctgaggaagatgaaggaacaacctatgtagctttctgggggaagacatcccaagaagagggcagggcagccctgaaagccccagagcagtggtgtgttgagagtgtttagtgaacaaggtggcaaggaggtcagtggctggagcagagggaacagaaaagagagtaggaggagaagtggagggaggtgggacagccggtcataggttttataacaaggctttataacaagccttctctccttaagtaaaagggagacaccaataaacatataaatccgtatagctttatttagtttctaaattaaatatggtatatttaaagttggtgttttagtgacgcccttgagctcattgtcttagtttattctgagagaatgcaggatccatgatttttattctggcagttcctttactcttctcagctccccattatggctcctttatggggctgtccacctcacctccctccctccagtgggacatagaagtgaaggaagatgctttttaggaaggctgatttatttaataatttttaagagagattcttctctgtgcctgttccccatccctgtccgtagtggaggcaatgctaactttgtaatagtattttcagcagtggaggtggggagcgtggtcctggaggcagccatgtggggaagtcacagttgattgtctttaaagttctcactctcagatccccccatagagtaagaaaagcatctttctttctctagggatgaatagattttctgtccatgtcggggagggggttgtagagatggaggttcacagacctctcagattctttccctgttataaccccagccatgagtctgctagatcaggcgcatgaaaatgactcttatctgtttttttctgggttgctcccctgcttctatttagagcttaaacagattactgaactctatgctatccactgaattttgtaaacacaagtgcttaacaatctatgtttaaaagaggacagagaatttgcttaacagctgaattctagatgacagatcaaattgaatatgaaagaagaatatttttactcttcttcggaacactgtcacagtgggtggaggaagatctttagatacaatactttgagcaagtctagacatattttagctttaggtatgcaagaaagggtagtaaaagagacgttatacattcattcgagagatatttctagtgtgccttttatgtgggaggattgattctatgcactagggatacagtggtgaataataataataacaaaacactcaagatttttgttcttataagttatgtattctgatgggggaaaatatacaattgtggtcggtcattcctgcaattcatcagatatttttgtctcatcatgtctgacacgtggtgaggttgtacttgtgattagttatggctggttaggtcagagcaggggtgatgtgtggcatttctgaactagagcatttgattgcacatgccagaccctccagcttctttttctcttccttggctatcagcagttttccagacagttgcttcgctgtctgcttgagtctgccagagtgaaggcaatgtggagtagggcccttaactgatcctcaatggacatatagtatgagaaggaaataaacttttgtctttttttgagatggagtcttgttcctttgcccaggctggagtgcagtggtgtgctctcggctcactgcaagctctgcctccaggattcacaccattctcctgcctcagccacgggagtagatgggactacaggcgcccgccaccatgcccagctaattttttgcatttttagtagagacagggtttcaccatggatctcgatcttctgacctcatgatccacctgccttggcctcccaaagtgctgggattacaggcgtgagccgctgcacccagaaaataaatgtttattgtttgaagccactgagattttagagttggcataactccaagcatggcataacctaacgtcctgaatgcctgactgggagaaattaaaaagtcctgactgatatagaaatttaaaaagtaacattttagaaaaagaagtacttctagctagtgatatagtctataaacaaaacaaaacagggagctgtgacagaaaatgcctggggtggagtgcagaggatactctaactagagtggttaggttagctccctcagaggaggttatattgaaacctgaaagatgagaaggagctagccaagtgaaaatctggaagaagtgcattcaaactgaaggaatagcacatgcagaatatgagtggtgaaaacatttggtacatttataaaacatctgggaggccaagacaggagaatcgcttgaacctgggaggcagaggttgcagtgagctgagattacgcactgcactccagcccgggtgacactgcgagactctgtctcaaactgaaaaacaaacaaacaaaaaaaccaagaaaaacaaaaacattggccaggcacagtggctcacacctgtaattctagcatttcaggaggcctgtggtgaaaccctgtctctactgaaatacagaaaatcagctgggcatggtggtgggtgcctgtaatcccagctactccggagcctgaggcacaagaattgcttgaacccgggaagcagaggttgcagtgagccaggattgtgccactgcactccagcctgggcaacaaagcgaaactctgtctcaaaaacagcaacaacaacaaacaaacaaacaaacaaacaaaacttcaaggaagttaatggagcctaaagagtaaggaaggaggaggtagctaggagtttagtgatgttagacttgacagatcatggtatttcattttaagaataagccatcatagagttttcagcagaacatggatatgatctgaattagatttttagagtgactctttgaaaagatcagactattacgcatggggcatctctgactctagaagaaagccacaattctcttgatttggggactcagagcatggagttcagggctgacaaaacagttggaaagtaatagagcaaatcttagaaagggcagacccacagagggaagccccaaattttatgtataaactctcctttaattcttaactggccctgaactgttcacacttgagggagtttttaagaagcccagcaaaagcaatggctgagaggtggtgagaggtgacagcgtgctggcagccctcgcagccctcactcactctcggtgcctccttggcctcagcgcccattctggccacacttgaggagcccttcagcctgccactgcaccatgggagcccttctctgggctggccgaggctggagctggctcccttggcttgcagggaggtgtggagggagaggcacaggtgggaaccggggctgcgcccggcgcttgcgggccagctagagttccgggtgggcatgggcttggcggccccacactcggagctgccggccagccagccctggacagtgaggggcttagcacccgggccagcagctgtggagggtgcgctgggtcccccagcagtgctggcccaccagcgctgcgctggatttctcacggggctttagctgcctccctggggggcagggctcaggacctgcagcctgccatgcctgagtctccctcactccccccgcagtgggttcctgcgcggcctgagcctccccgaccagcacctccccctgcttcatggcacccagtcccacccaccgcccaagggctgaggagtgcaggcacactgcgcagggactggcaggcagctctatctgcagccccagtgcgagatccactgggtgaagccagctgggcttctgagtctagtggggacttggagaacctttatgtctagctaagggattgtaaatacaccaatcagcactctgtatctagctcaaggtttgtaaacacaccaatcagcaccctgtgtctagctcggggtttgtgaatgcatcaatcggcactctgtatctagctcaaggtttgtaaatacaccaatcagcactctgtgtctagctcagggttcgtaaatacaccagttgacactgtatctagctaatctagtggggacgtggagaacttttgtgtctagctcagggattgtaaaagcaccaatcagcaccctgtcaaaacagaccaatcagctctctgtgaaatagaccaatcgactctctgtaaaatggaccaatcagcaggatgtgggttgggccagataagagaataaaagcaggctgctggagccagcagggggtccacactgtgggaactttgttcttttgctgtttgcaataaatcttgctgctgctcactgtttgggtccacactgcctttatgagctgtaacactcaccacaaaggtctgcagcttcactcctgaagccaacaagaccgcaaacccaccgggaggaacgaacaattccagacccgccaccttaagagagctgtaacactcaccgtgaaggtctgcagcttcactcctgaggcagcgagactacgaacccaccagaaggaaaaagctccgaacacatccgaacatcagaaggaaacaactccggacccgctgcctttaagaactgtaacactcactgcgagggtccgcggcttcattcttgaagtcagtgagaccaagaacccaccaattccgacacagtgggaagggttgaacagagattttagtgctgtctactgcagtaaagacagagtttggggtttgagtcataccaagttagaaggattggtaaagtccttctaactttaccttctaacttgggcattgaaaccccagaagggtgccccttagaaataaacaatacatccttgggctataggagttgccgcaggattgtgggcaaaaactaatgtagatttggccaggtatactggctcagacctgtaatcccagcactttgggaggccaaggtgggtggatcacttgaggtcaggagtttgagaccagcctggccagcatcatgaaactccatctctgctaaaaatacaaaaattagccgggcgtggtggtgcatgtctgtaattccagctactagaggggctgaggcaggagagatgcttgaacctgggaggtggaggttgtagtgagctgatatcgcaccactgcactccagcctgggtgacagaacgagactccgtcccaaaaaaagaaaaaaagaaaaaaaaaaaactaatatagactcatacataccaagtatcaaatcaagccttcacaagttcaaagtgattagccagtaattttaaatttaatttaaagtgattagccaaatcaggccttcaccaatttgaaatgattagccaataattaataataattagtaaaattaatactcttagaggaagataataaaacaatgtatcatctataaagtccagtttaaaattaaagtttattgtacatacaaaaaaccaggacagtgtgacccatagtccagagaaaaagtagttaatagaaacagcacttagatgatccagaagctggcattagcaaagactttataacagtgttcatactttgttcatgggcaaggagatagaaaaccaccaacagtttcatagtcaaactgctgaaataaaagataaagagaaaattttgaaagcagtcagaactaaggtcacatttcacataggggaatgatgatatgaatgatggttaatttcttatcacgaacaagggaggccagaagatatctttaaagtactgtaagaaataaaaatttcaacctaaaattctatatccagccaacatatacttacaaaatgaaggtaaaataaagacactttcaggcaggaggattgcttgagccaaggagttggagaccatcctgggacacatagtgagacctcatcgctaccaaaaaaaaaaaaaaaaaagttatgtgaagcggtgcacacctatagttccagctacttgggagactgaggcaggaagattaccagagcctgggaggtcgaggctgcagtgagttgtgattgcatcactgcactccagcctgggtgacagagcaagatcctgtctcttaaaaaacaaaaataaataaaagacacttttcaaacaaatcaacaagacagttatctatagcagacctgctctacaagaaatgctaaggaaagttcttcaggctgctgatgagtgaaaccatatagaaatatcaaatatacaggaaagaatgcagagcattagaaatcataaatatagggctcaattagaaagactgttttttccttaatttttttaaaagacaaaaatgtttaggttggcgcggtggcttacgcctgtaatcccaacactttgggaggctgaggcgggtggatcacctgaggtcgggaggttgagaccagcctgaccaacatggagaaacaccgtctctactaaaaatacaaaattagctgggtgtggtggtgcatgcctgtgatcccagatacttgggaggttgaagcaggagaatcgcttgaacccaggaggcagaggttgtggtgagccagattgcgccattgcactccagcctgggcaacaagagcaaaaactccatctcaagagaaaaaaaaaaaagaaaagacaacaatgtttaaaaggaaaattgtaatattgtatgtcatgattttgtaacatgatactataaaatatatgacaataatgacagattggaggcaaatggaattacactttagcaagattcttgtattttatatgaagtggcacaatgttaaccctaattaaactgtgataagttaaaaaggcatgtttcaatctttagaacaatcagtgaaaaatataaagaggatacgtaagaaacctaaataggatgtaaattattatactaataaaataatattatgccaaaagaaggcaggaaaagaggagcagaggaagagtatacagatgggacaaggataaacagcaaagtggtagacctaaatccaactgtataattttttacgcagaaaaactaaacattccaattacaaggcagagattgtcagactgaatttaaaaagtttgatccaagtatatagtgtttataaatgatgtattttaaatataacaacagagcagttgaaatcaacaggatggaaaatgaatatatcctgtaaacagttaacaaaagaaaactagtgtgaatatgttaatatcagacaaaagtaaccaaaaagatgttttaaaataatgaaagggtcaattcatctgcacaataaaacaatcatatacctatctagagaatcaaaatatctgatactaaaactaacagagcaaaaggcataatcgtaggtagataatttattgtccttctcttactaattgacagaattagctatacagaaaaatcagtaagaatatagacaattctagcacaaacaccttgagatctgatgttcacagaacattactccagaaaaagaatacacattttttcaagtacaatggaatattaatcaagatagagcatatattgatccataataaaaattttcaaaagataaaataatacaaagtatgttctctgaccacaaaggaattaaattagaaataaaaatcaaatatacacacacacacacagacacacactctgtctgctgtctctctccttctctctctctctttctgtctctccccctctctctgtctctccctccacccaacccccgccccccgccaattctctttctctctccaaatatttagaaattaaaaaacacacttcaggctatgcatggtggctcatgcctgttatcctagcactttgggaggccaaggcggttggattgcctgagctcaggagtttgagaccagcctgggcaacgtggttaaaaccctgtctctactaaaataataataataataaaaaaaaagccaggcatggtggcccgtgcctgtagtcccagctactctggaggctgaggcaggagaattgcttgaacctgggaggcggaggttgcagtgagctgagatggtgccactgcactccagcctggcgacagagtgagacaccgtctcaaaataaacaaccccaccccaccctccaaaaaaaaaaacacacacacttcaaaatgcctatggatcaaagaagaatttagaagataaattataaaatatttctaactgaatgatgaagttatataaaaatgtatgagatgtgacaaaacagtgcttagggttagtttatattttaaatgcttatattagaaaagaaaaaagttgcaaatcattgctctgtttttattgtaaggggttgggaaaagaacaaattgaatcaaaagtaagtaggaaggaggaaataataaagcaaataagagcagaaataaaaaaggaaaaggaaaaagaaaaacaatagagaaaattaataaatccacatgttgattatttgagaacattaataagactagaaatttctagaaatattggttaagaagcaaagagagaaaacacaaattaccaatgtcaagaattaaagatggaatttcattacagatctaaagagataaaaagtacagggaatgccagtttatgccaataaattctaaaaaatccactaacgaaatataatagaaaaaaattcttgatagtcataacttaacaaaactgacataagaagaaataatccacatagctatatatttatataagaaattgagttcattatcaaaaacctctttagaaagagatttcttggcataaatggttccctttttttgtgctcttggggacttgtagctgccatccttctcttaagcaaaagggagagtcaaggcttcacttatttatttactttatttaattctattgtagcatttatgatgtgccagctactgttctgagcactttataaataataacttacctgtcagagatgtgattcatagtaaggacacgaagagaaaatttcaggaatgtttattttctacaatatatgcaagtaatgtatgcttaacagaattgttttctacccactggtgacagaaacttgtgggcaaatgggaatatgcctttaaatgtgtactctgatggcaggagcaatcagtcagtggcttactctcattttctccctgtactgtgtatgccgaatagaaaacaattgttaaaacctggaatatgaggctaaactgtaatgctttctttttcctgttcttgctgcatgattttctgcctttcaggctcatgctatttccttggatctctacattttttttaaaatttgttatttccaactttttattttgagttcaggtgtacatctgcaggatgtgcaggttgttacattggtaaatgtgtgccatggtggtttgttacacagattatcccatcacccaggtattaagcccagcatccattaacttttattcctgatcctctcccttctcccaccaccccccatactctcctacaggccccagtgtgtgttgttcccctccatgtgtccatgtgttttcatcatttagctcccagttataagtgagaacatgtggtatttggttttctgttcctgcattagtttgctgaggataatggctccagctctatccatgtccctacaaaggacatgatctcattcctttttatgctgcatagtattacatggtatgtatgtaccataatttctttatccagtcagtcatgggtggacatttaggttgattccatgcctttgcttttgtgaatagtgctgcagtgaacatgtgaatagtgctgcagtgtgcatgtgtcttttttttttttttcttttttgagatggagtctaggcctgtcgccaggctggagtgcagtggtgtgatctcggctaactgcaacctccgcctcctgggttcaagtgattctcctgcttcagcctcccgagtagctgggattataggcatgcaccgccacacccagctaattttgtatttttagtagagacgggatttcaccatgttggccaggatggtctcaatctcctgacctcaggagatccacccacctcggcctcccaaagtgctgggtttacaggcgtgagccactgtgcccggccatgtgcatgtgtctttataatagaacaatttatattcttttgggtatatacccagttatatacccagtatatacccagtaatgggattgctgggttgagtggtatttctgcctctaggtctttgaggaattgccacactctcttccacaatggttgaactgacttgtactcccaccaacagtgtaaaagtgttcctttttctccacaaccccaccagcatctgtttgcttttgttttctttttgagacggagtatcgctgttgttgccagggctggagtgcaatggtgctatccccgctcactgcaacctctgcctcctgggttcaagcgattctcctgcctcagcctccccagtagctgagattacaggcacctgccatcacgcctggctagtttttatatttctagtagagacagggtttcaccatgttggccaggctggtctcgaactcctgacctcaggcgatccacccgccttggcctgtcatagtgctgggattacaggcatgagccactgcacccagccttctttttgtttttttttttttgtttgtttgtttttgagatggagtcttgctctgtcgcccaggctggagtgcagtggcacgatctcagctctctgcaacctctgcctcctgggttcaagtgattctcctgcctcagcctcctgagtagctgggattacaggcgtgcaccaccacgcccagctaatttttgtattttttagtagagatggggttttgccatgttggtcaggctggtcttaaactcctgacctcaggtgatccgcctgcctctgcctcccaaagtactaggattgcaggcatgagccactgtgcctgggctttttgactttttaatactagccattctgactggtatgagatagtatctcattgtggttttgatttgcatttctgtaatgatcagtgatcttgagcttttttcctgtttgctgtccatgtgtatgtcttcttttgagaagtgtctgttcatggttttatgtctggaaatcaactctgaataaaatatctatctttagctgtctccacaacagtgactagtatttaattacaactaggtaagccattacagagcagttttgcaatatttgagaattggattgacttgttattgatctgatttgataatttttgttaagagatgtatgctaataagaagctaataatgtttcataaaagagtatttggaagtatttttcaaacattattgaggaacctttttccctttgttcacagcacagtactaggccctatttagtccagcaatttttctaagtattgttctgatagcaaaaaaatatacatatcagttgatcagttttctgggtgctctcttaccttaaatggtagatgctcaaaggttatggatgtgagtaatcatagctcactgcagctttgaccccctgggttcaggtgatcctcccgcctcagcctcctcagtagcttggactacaggagtgagccaccatgctcagctaattccttttttactttttaatttgtagagatggggtcttgccttgttactcaggcctgtcttgaattcctggcttcaagtaatattcctgcattggtctattcctgcctttttagcggagtgagatgtgactaaggcatttcaaagcactctatcttcagaactacctgctacctatctcaattgcaggttcattattttctatttttggcttatatcctgtagtaatcaaagattggcttgaaaacaatattggcacagaccatcattatgagcacgaatactattctaaaaataaatgaaaaaggcgtctgtacctctaactacagaaaagctatgatgaaggcattttgactgttcggccagtggaactcagtgacatagcaggtattaagaaataacttttctgtaagatactttcttttgggcatctaatttgctcatttttagttgagaatttcaaatacttattttttcagagcttttgtatgtattttaatgttaccagagaattagcttattcaagaatggaagatcataaatcattacatgacatattgtacaggaagacattgagcataatttgttgataatgcccactcacaaaggtatttttgaatctttccatcttccagttatgacagttaagataatagtgtgctttcccactctaccatcaagtagtgtgtcgtgccttgtggtacaaagaaattgtcatgaaataaaattcaaccagtctttgaattcttaataccttaatagcaatatgaaatttctgtaaaatccacagattatagctttcttttttcccctcttgattcttattttgtggcaaagagagaaagataaaaaatgatgatgcaaatgagatgttttatagcactggaaaatatcttgaaataaaagataagtcagactctaaaatgtaggggcaatatgaggatgtaggaagatcggtagagaatttcatcaaaggtgccatgagaaataaaatcttaggaagaggatgctcaatagtgatggatgcttgaggagagacagaggattttgcaaactgattaaaggtgatagaaataatagtttctaattaaaactgcttctaattaaaactccttttaatggaaggataatacttagtgaatttgagttctcaaagtactgacttacagtttaaatatgaaagtctcatttttcttctaatagggttagtagagtataattaggcaaacttaagtgttgtgcagcacagagattattttaaaagttaagtatttgagaatccactttaatcaaaaccttttagtatgtgagaatataattacattttacaaatatatttgaaattctctttactatatgatggaaaggtatcaaattcatccaacattcagaggtttagtaccctaatgacgttcttatttaacaattaattttaataccaaaatgcaataaaacacatttagctatcttcttgcttgtcctggatattaataaaaatctgaggcttatgctgaggcaggaaaacattcgttaattttatgtcattaaaaaaagaaaactgtactcacttttgttctaatcttaaattttgtctttctttctgtacagtttctacctatttttactgtatctttccagttagttttaattttttcgttttattttattttattttttccttttatatttctcaaaatttcattctgagagccttttaccaagaaggttctcagaagaatactttgataagttctcttaaagctttgctattttatttttgtcttttgcattcctttttctctaccttaaagctatctgcatatacttgttttctctttcatttcttttattcttccaactgccttttgatcatttattattaaagccagtgagttataattattttttgttgtagcttgcttttaatctgagctgaaaaatccatgttttttttcatttgttatattctagtcttacattttaactcccttcttttcatttatttattctgttctattttcctatcttagtttttcccacattggtaattattgctttttttctctttggactagataaatttcttacttcagtaacattgtaggaaggaatgaaaatagtgaagacaacaagacatttaacttttgcattacaataaataggaaggaattatggaactttaatttgtctcctcatttcatgggtaagaggtcagaaagttatattaaaaaacatattaaggctgggcatggtgtctcatgcctgttagcccagcactttgggaggccaaggtgggtggatcacttgaggtcaggagtttgagaccagcctggtcaacatggtgaaaccccgtccctactaaaagtacaaaaaaaaaaaaaatttagccaggcctggtggcaggcacctgtaatcccagttactcaggaggctgaggcaggagaatcgcttgaacccaggaggcagaggttgcaatgagccgagattgcgccactgcactccagcctgggcgacaagaacaagactccgtctcaaaaaagcaagcaaacaaaaagccatattaaatcctgggagatagcctcatatagtctattttccccaaccattttgttagtctacacaggttctaggatagttgatcctgcacttttagcattctttttaatttgacatgtttttcagtttaagtcctttgtcagtatagcacagaatgagtactccgtttgtatcagttgaattaatttgagctagtatctaatgtactgagttcattaccatttaaatatgcactgaaatccttcatttctggaagagtaatggggatatcaaattagatccgcagggatgaagtgaggccagggtcactgaaatccctctggggatgcaggtgggaattacattttctcactaataaataacatttgacatttgataagtattcttaagttcaggggagctgaacttgttcatacaaactgtgttaattatcttccgtaaaaaacaggttagcctctataattttgagctgcaagtaatagatacaagtcgcccaaaattattttgtaaatgatgtatttgtaagaagttaaatacaaacagcttctttacagcagtaagatttgcttaaactcaggacagggggttgaaaagaatggtggggaagtgtgtgtgtgtgtgtgtgtgtgtgtgtgtgagaaaagagtcagaatcgggtagggcaacaggataagtagaaagggttgtgctaaaggtgtgccgggagccatctgacttgtactggagatccagtagctgaatgtcactatcaacagtagtgagggctcagaacgctgaagcaggtttacatgatatatttttattttatttttttgagatacctggaaatccacatctgagcttttgggatatgctgttgctttttgctttcagtagcttaagcaattcaacttggcttatatgtttctcatttgtaatctaaaagtcatgcaggactgtgtccaataaagtttctctcataaattcatttctctatctcttgattattttctttgccttttcctctgactgtgactttggttggattgattatctagctgcctaaaattcaaagaattaaatttgggacagggcctagaacaaaaacctgttgggctactttatttactattgaaaggaagaatgacaaattatcactccattattgggccgggctaacagtgaataagggaaagaaatcagaggctactttaccttgcactcatgtcctactcactcttctctcttccccattatatattacgtttttttttcccctgggatgatatgagtccacaagcttcatctggaaaacccgcatttagtcccacttggtccacttattcatatggaataattctgatggcttaaacttttagtcttcaaaattgaaaaccttgttgggatagttttgattggcttagttcttttgagtaaaatacttagtatctcagaattcttcttcctctcctccaagatgtcatctgaaggtacaagagaaaagtgtgcccttcatgatctgcatggtatccagtggctcatcctgttctcatgactttgtcctttcctttccggttattgttcaccttgcatttatgatgaagaacaacagctagtgtaactcatgatttgatttatctaggattgttcaggtgtggtggcattctctggctgattttgctctctgagtctctgttgtttcctagagttgagacacaccttcttgccatgcggggcccaaccagactgtgggctttcaacttggtttcctctgatattgtcttgtcatttctagggtcattcaagagcttaggttgatcttcaagatgtcgttttctaggaaactcagctcatatctagctgccagatggaggataagaggatggagaagacattcttatttgctcagtaatcttggacaatttatagaaattttgcagtgcactgaatatggtaatatctcacagccttgttagaatgattatacaatttcaaatattttttgagcctttaacctgtcctgtctaccttctgaagctcccctcccctcaccttttctgagcttccactttcttcctgcctcatagacacacaggataattttcattaaggtattgcgttttccaatgctgtgcttagcatagtttctgatatatagatactcagtaaatatttgttgaataaatgttggataaacaagacctatgaagtaaataattatacttagtttaaaatactatatagaaataagtattactagtattttgtcatatcctttccctcaatacccctctcttttaaattattttatgacagtgacatgtaattaatttttcttatttttaaacatcttactgtgtcaataagcatatattttcataatgtgtaatgtatagtataaacccaattttaatgtctgcttattgttccattgagtgtgtctaacataatttatttcatagttttcttgaatttggggtgttttctattttcctcttttataaacagagcttcaaagaatgtccatgtacatacatacattaaaaattatgctcatttgcacaatatatttaagaaaaatgcctagaattagaatttttgagtcaaagaatgtgcacatttttcacttggtatatatttccaggttgtcctatgaactttgatcttcaatttggagaaatataaatttttgaaaagaagctataatctttgacccactaattgagagaatctatctcatagaaatataagtagttttgactgggtgcggtggctcacgtctgtaatcccagcactttgggacaccgaggcaggtggaacacctgaggtcaggagttcgagaccagcctggccaacattgtgaaatcctgtctctactaaaaatacaaaaaattagctggacatagtggtgggcacctgtcatcctagctacttgggaggctgaggcaggagaatcacttgaacccgggaggtggaggttgcagtgagcagagatcgtgtcactgcactccagcccgggcgacatagtgcgactcggtctcaaaaaaaaaaaaaaaagtgtttttgtataaacatatatgtaatattttgagggcttgtagcagctaatagctgaaatcagtgtgaatgaccacatataagaaaaagtttgaataaaatgtggatcattcatgttacataatattatgtagcccttggtttagatctgttaactcatggtaatgcccatgatactaagtgagaaataccagttgcaaagtaatatggatagtatggttctttttttgtaaaaacaaaacacacacacacacacacacacacacacacacacacacagacagaataatactttatatatgtttatgatttgtttgaatgtacaggaagctgtgaaaggatacactcaagttcttaaaactgtatcttagtgtgtgcatgtatatcttaggattgtttcacgttttacaatgaaaaaaagttttgcttttgtaagaaaaagtaaataaggaagacaaagaaaaaatcagggccttaacaaaccactctgacttttctgcagccttaacaaaccactctgacttttctgcaaactgtgctttcaaactagacagcttcctgtagttctcggaggaatttcagggctttaaagagtgtgtcctgaagtcaggatcacttttatagttagcttaattggtatattattttacacaagataacagctaaactgttgcgatttctcaagtcattgatgttctcagaggtaatcatcctcagaaaggctgctgaaaatatggtcagcttacatcctggtctggttcatgtcaaacaaccaatttttttagaagaggaaatagaggatgaaatagcaaaaatgtttcaatttaagaaattgttttcagaaataatctatacttttctattgataagaggaaggaacaatttttgttacagctaaaaatatagaataaaataaggtgacaacaataggttgtagctaaatgcatgcttttattaactcactagatgtatgctgtgattttgattaaaattttgtctttctgaaggagagaagtaaatattaaaaaggaaaaaccttggtatgtcttagaaaattttaagcctagtagcactatgtaaaatcattttaaaatgagaaagtttagaaacttggagaacaaaagtgaaataaaaactttatttggaaaagtaaaattggttattgctcatggaaaaaatcttgatcattcaatgtctgtgaacagagatgttgacacagtgaattaaatatggcaggtgaccattcataaatgtgtaccaatgatatattgaaaatatctagtgaaagaagttcctggaatactgtatttatacttgattagccagtaatacttgcgttaaatgataaatgctagtcataaatgctgatgaatgaataagtttgtcaagcatgatcagatcagggatctgaaaaccctgtatgttaatattatttttaatataggtagataatggatacacatatgaacagttttatcaaaggatatactgaaattgttctattcctgtgcgagcctcagaattcaaaatcaaactataattttgacatagatcataaataagtgataataagttaatgaataaggcagattttattttatgtttgctaaaactttatcatcaaaacagtttaaagcattgtattcaatgtcaatgaaattaaatactaaaatagaaacaaaagtttccatgggggtcattggtgactactgtatatttcagtgtataattgcatatgcaactccattgctccctgttggtgaggtcagtgtgagtgccatatcactctgaagcaaacttatatgtcttctcagtgcaggcctcaaagtagtatgcaaatatattttgctattggatgagattaagtgtatcaatgcgtatagctaaccagtagaggtacaagttgtgcctcctcctaattctgggtctaatgagggctatgtcatctccatagtttgattctaaaccatcctactgtgcctgcttgctgtatttttggagagccccaactcctttctacgtatttcatcaatgtacattgtatcagcatgcatagtttgaaacactaatttattcaagtttatctaattcaactaactgttaatttgtttctgctgcctttggagtaatctatctccaggccttcctgtgttatcttgaataattgagagtgtactcgtagaaagagccacattgctgcagaaggtgctgctaagcctccaagaggttcccttcacttgagcaagattgaaagtgattccagctggctagaaaaaaattacatgaaggctgtaatagacctttaggaaggaaatctgtttctaccaagacagaagaataattcatttgtaaggaatataaattaaagctttcttcaagtcattggagtgtctctaatatttttcaggtagcatttttcatacttccctatttcatcaacttttagtacaaaattttccaagctttagttttctcatttataaaataaagtaataatgcctgtcctcaattctacgaatttatgaagatcaaataggaggatgtaaaggctcctataaattataaatttacccactatcgtaaggcattgttttctttatcagggtggcttttgcttttttattacttttcataactacttgcactatatactgttatttgaatacaataacataaaaccaaccatgttacatggttacataacttttttaaaaaaatttctttctaacttcaatttttattccttttttttttcctgtgcagaaagaaaaatcagcctgtcagctactcatgtctaatttcaaaattatcttgcagaattaagcagttaagactttgtagaaatttggggagtataaggaattgcagatgaatgccagctcctcctgggcatactgttgttcttaatgtaaaagtccggttttgcccagcatcaattaatggtgccttggaactgggtgcaggggtccctaaagatctcctgcaggctgagacagtctcccttgagccattttccacagagccagagtggtgtgacctcttgctgctgcagtatttcaaagtgattgtatttcactgctctcataaacacatcttgtaaaagaaacaaggttgtcttttaaactgtgctcttgcttgacaggaaaaataaaacccagtctactttcaggaccttatggcctaataagaagtcaacccttttcatttttgttaagaatagttttgtatcaacttgccattcttcatgtaaaagtataatttattatgaaagaagagaatctggatgataaataggacttttatgttcttgttacctgtgattcagaaaattctaactcacagagctggttgaatagagaattctaaaaccgacaacaaggagatgcttgttaaatctactttttaatgcttgtttattttattatacacatgacatgtactattcactgttcatcttatgtatatgggaacttgcaatttttggtctattatacatgcctatatattttatgtttggtgctatcaggaacatagatattattaaacaaggctaggatttattttactttactttatatttgtaggttattatgcagtccaaagattacagagatgaagggaaattagaccaattattttcatatgatatttagagaaaagcatttgtgcattcctttgtgtcagtaagcataagaactctctgtcacccaggctggagtgcagtgaatacaaagaaaatgtaagatattttactaatactttttatattgattatgtgttgacatgataatattttagatatatttgattaggtaaaataggaaattaaaatcaatttcactcttgaaagactttaagtccgggcgtggaagctcatgcctgtaatcccaacactttgggaggccaaggccagcggatcacctaaggttgggagtttgagaccagcctgaccaaaatggagaaaccccatctctactaaatctacaaaattatccaggtgtggtggtgcatgcctgtaatcccagctactcaggaggctgaggcaggagaatcgcttgaacccaggaggtggaggttgcggtgagctgagatggccccattgcactccagtctgggcaacaagagtgaaactcttgtctcaaaaaaaaaaaaaaaaaaaaaaggccaggcacagtggctcatgcctgtaatcccagcactttgggagggcgaggtgggcagaccatcctggctaacacagtgaaaccccatctctactaaaaatacaaaaaattagctgggcgtggtggcaagcgcctgtagtcccagctactcaggaggctgaggcaggagaatggcgtgaacccaggaggcggagcttgcagtgagcccagatcgagccactgcactccagcctgggagacagagcaagactccgtctcaaaaaaaacaaacaaactaaaaaacaacaacaacaacaaagactttaaaaatgtacttactaaaaaatttaaaattatgtgtgaagcttgcattatattcctcttgcacagtacttctctaagcagtcttggcatagaaatattatggaaggccaaggcgggcggatcacctgaggtcaggagttcaagatcatcctggccgacatggtgaaaccacgtctctactaaaaatacaaacattagccaggcttggtggcaggcacctgtaatcccagctactcaggaggctgaggcaggaaaatcgcttgaacccgggaggtggaagttgcagtgagccaagatcacaccattgcactccagctttggggacaagagtgaaacttcatctcaaaaaaaaaaaaaaaaagaaatattatgtttatatcctttatccttctttaccaaattacctcactttaccccatattttgaggacagtttaaagaggtctgcacgttctgcaagcactactttctgttgtctcacatcaaaaatttcattagaagtacctgaagagtttgctcttctctaagaggtttcatctataaaaagttgattttaaattcactttaggtcaatgagcataaatgttgtggagtttagctgtgcatgtatggaaaggaggctttcttccttgggcaagggcaccttctggtggtatatactgaacatagcagcttattcgatgatcagatgtagactttaagattctggaattggcaaaaaaattcatttcaggtgtttggaggaaaaaaactaagattaacgataaagatgttcatttctctgcagcatcttttataattgaagctcatctcagttctgggacttatttttcttagttacacaaggctaaggttgagacaatataataagagcattctgatttggagtgctttttaaaattgcaaagttcttatttgagtttttgggttatttttcccaaaagtttccaatggtggtttttgtatccattataaaaaggagaagagttctatatttttgttctttataatgtaaaacttgaggatgtttaggttatttagtatatacaagtaagcttcattagataaatgaggaagaagaggtataataaataagccctattacattttctcaagaagtgattttagttattttggagacatgcatttaaaaagagaaacattgttgaaaggctcaggatcatgtatttcttgtctttttctgtttcttcttgatgtattatagtacatatgattattcaagtcatatctcttcatcaccgcatttcatatacaaagcctgccaaaaataactatgaaatagctgagatcttaaatactgagaacaaaatagatttctcataatttggaattacattaaccagaaacagtaagacagttaaaatatgagccaacatccagctatcagctaaataaagatttccaaaaccacttattgcctttcaggctgatgtaagaatagttatgagtggttataagggaatgaatcagttggatttccttttaatgtagagaccctggcagcccatttctaaaattgtgctttagttatgcatattaccttctttggaacctagtaaaaatgtgaaaaacgttcagatgatgaaaacataacacaaataccattctttctttgtatgaaagacaaaaaaaaaaacaaaaaacaaaaaaaaaccccaaacaaggatctagccaagcaactctattctaagggaggaaatatagtaagagtggcctgtagccaggcatagtggctcatgcctataatctcaacactttgggaggctgaggtcagaggattgcttgagcccaagagtatgagaccagccttggcaacatggcaaaaccctgactctacaagaaatacaaaaattagctgggcgtgatggctcacgcctgtagtccagctactcaggaagctgaggtgagaggctctcttgggcacagaaggtcaaggctgcagtgagccatgatcacaccactgcactccagcctgggcaacagagtgataccatctcaaaaaaaaaaaaaaaagaaagaaagaaagattgtattactctattagtgaaaggagccaaaatttacccatattgacagcagagagctgaaatgactattttacttgtatgaaaatattgtctttgcttattaattaaaatgctttcatgagttgatatgtggtaatatacttttagatcagtatatgaaatagtatatattattatattgtattatttattaggtaaatctcaatggaataaaaaaattcattcaaactcattttcccaaaaaggctatttttagatttatagtatttgttttagtgataacttctgttcagttctctctagcatttccagaaatctatgcttgtttcatggcctccagtaaaggcttctgttgatgagggggttttgatcccatgtctgtccaaaaaagacaattggcttttcttggtagggaaggattcatttaagtggaatcttccaagcaactgtctctaccatcttccatattcttgctccactcttactgttttgtttgcctgtcgtggagtcctaattagggaaaaagtctcaggctggtgggaacaggggaaagccaaaagaaaaagcagataagctaagtctgcctttcttcctggtccaggacatgtagccctcctgcacaaataactcacaatcttcctgcattcaacttaccaccagaccctacaagttagcacactgcattcttggcattatcagtactgcacaaagctctcttcagcacacagcacaagcaccatcctataaaatccccagcaagcctttgtctccttgcagtcagctccactcttgctgacttgcccatggcacgctcgcaacgtattttcatactttctgctttctctaataaatctgcttttctttacttactaatgtcttggtaaattattctaactgcctgcgcaatacaggccccagatagtcgctacccgagacacctatcccatcccatttatgaaagtgaggcagcaagccaataaacacttcatggattcgtagcaatcacagtctcttgagagcaggatgtccacctgacctcttttggtgtgaacaattcagctttgtgtgtattggtcctagtcagggcgggctgtgtaaggacactgttttgagatcagcatgccctgtgcctgtgtaggcttgttgtcaacatgtgagtgcttcaaagagaatagagtacagcttccctcctgacttgttctcttgctttcatagagatttaagggcctcccctattttctttttcttttcttttctttttttttttgatatccagatacagtttattttcatgagaaagaactttttttaaaaaaacaaatgtgaattcattgtaaaacattagggaaacgcagccaagagggaaaaaaagaacagtatctataatttaccattttgagatgactactgttaatacttttgggagttttctttttaggcataaatatatactttattttttttttaataaagaagatttattactttttggctttttggctaagaccaagtgtaaataaaaaagctttaaccttagcgtgtgagacaaatatgtatacaataaatttcaccataatatggtagaagcagtaatacagatatgcacaggaagctctcagaatacagaagacagacatttagttcaaccagaggtaaccagtgaaggcttcctggagatggttacacaagagattaatttgaaagaataggtagaagttagctaagtacggacaagagaataagcattccaggtatgagacattttactatgaaacagtatgttgagcacagataattacaactaatgaggtatttctagaatattgagcataagttgggatagagataaaggcagtcagcatgacatgggggaaccttgtgtatcatattatatatcccatatgctatagagaggcattaaaagatcttaagcagtagagtaataatttagatagatggtatagatcactttggcagcagaaagaaggattaatggtggaaaatcctggagacaagattacaagaaaacatctaaggaggtaaagagagaggagaacagggactaaggaatataagggacatatagagggcggtgtacctgcaaagaagaggaagaagaattgctagagatggaggaaatatctaagagagtatggtgtcataggcatcaagacaagagagtatttcaacaacaacaacaacaaaatggtcaagtagggaaggactgggatgtttcacttagatttgtatgtagatcacttaagattttataaaagatatttcagtggagtggggatagaagtcagattgcagttggttcaggagtaaatagtacttaggcaaattcaaacagcttgcatagcttaaaaaattgggctttgaaggtgaggaaagagacagcaataatttgagggggacataggtttgagaaatgttttttttctggcgaggtagccatttcttttttttaacttttaagttcaggggtacatgtgcaggatgtgcaggtttgctacataggtaaatgtgtgtcaagggggtttattgtacacgttatttcattagtcaggtattaagcctagtacccattaattatttttcgtgatcctttctgtcctcccaccctccatccccagaaaggccccagtgtgaattgttccgctctatgtgtccgtgggcctcacctattttctctttttttggagacagagtctctctctcttgtctagactggtgtgctgtggcgtgatctcggttcactgcaacttctgcctcctgggttcaagcaattctcatgcctcagcctctggagtagctgggactacaggcacatgccacgacaaccagctaatttttatatgtttctgtagagatggggttttaccatgttggtgaggctggtctcgagctcctgacctcaagtgacccgccctcctaggcctcccaaactgctgggattacaggtgtgtgccaccgtgcctggcctgggcctcacttattttcagtgaggggttgggtggctgcacctgctgtcatttttacctaaagcaagaagcagaagtactgcctgggacaaagctagaatccagtgctcaggaagtttcctaggataaaatgttattgagaatcttataaatagctattccctggggagagtaatgattaatgccagttaaaagtgaagaaggtacttctcttcctgctgttttgtgcaatgtacacaaaactgagtaaaacaaattattgtaggttgttgaaatagcatcatgaaaaattaaacagttggaagacaactattgtggcatatataggggcttttacaagaaactaaactaaggatgttctttaaaatgtggaactggagtctacttagggtttagtctggtttgtgaccatgcccttcagccagtgcagacatttgatctcaggacaggtgcccctgctgcagaagaccgccagcaccctgactccaacagctctgatgcatctcactgccaaggcctggatggaaaaaaattcagcagaagttacacttatgacggcagaaagttcagcagaagttgtacttatttaggatcagatagagggctggggtagcttcaatagccagacaaggaccaatctactcaagaacaacagtgatgagaagacagattttatggactgggtgtggaaggaaaggggctgtggctgtaagagtaaattatgtggctgcaggtgagaccatttgtttgtttcatagtgaggatcaaaatagcagttacagatcccttctttctgtgctatgctgtggaagctaagatggctctatgtgtttttgtatagctggtgtgccaaagttagcctctatttggggcaaatctgtagaagagaagtaaagcaaaagagattctatagtataatacaaaagtctaggtgcagaaaaactaagttcagatgttggttgtgccacttactagatgtgtaaccttaaataatttactttctccgaacatcaccagtttcatatctgagagataggcataatacctacctcacagtattgtttcaaggattaaagaaaatacaaaatgccaaaccctccacattgtacttcatatattctaaaggctcagtaaagactaatttactattctgtatgtgattctatgtagtatgaataatcctttcccatatcttattgatcagatatgccatccattagccatacaactattttataattatgtgctctttgttagtaggggtttgcatcatcagtgcgaatgaattgcttatggaaaagcaattgtgaactcatgccccatggataatgaatggagagaagttaggggatatttattgagcccttattgtgtacttttgtgcacattagttttcttttttttttttttttttttttgagatggagtcttgctctatcacccaggctggagtgcagtggcatgatctcggctcactgcaagctccgcctctcgggttcacgccattctcctgcctcagcctcccgagtagctgggactacaggtgcctgccaccacacctggctaatttttttgtatttttagtagagacggggtttcaccacgttagccaggatggtctcgatctcctgacctcgtgatccgcccacctcggcctcccaaagtgctgggattacaggtgtgagccaccatgccttgccacattagttaattattacaacaacttaatgagatagatactattacaatttttttaaatcatgaagaaactgaggatcagagattaagttgcccaaggtaatgttgatcagcggtccccaacctttttggcaccggggtgggttttgtggaagacagttttttcagtgaccagggttaggggagcaggagatggttgcaggatgaaacttgcactttagatcctcaggcgttggattcttttttttttttttgagatggagttttgctcttgtcacccaagctggagtgcaatggcatgatcttggctcactgcaacctccgcctcccgggtacaagcaattctcctgcctcagcctcatgagtagctgggattacaggcgtctgccaccatgcctggctaatttttgtatttttagtaaagacggggtttcaccatgttggccaggcaggtcttgaactcctgacctcaagttatccacctgctttggcctcccaaagtgctgggattataggtgtgagccaccgagcctggcctggattcttaaaaggagcacacaacctagatccctcgcatgtgcagttcacaatagggttcacactcttatgagaatctaatgctgccactgatctgacaggaggtggagcccaggcagtaatgcttgctctccagccactcatctgctgcgcagtccagttcctaacaggccatggacctgtaccagtctgcgacccagaggttggggaccccaatgtagataataaatggtgtggttgaaatagttttgtttgaaagtaggatttatctttttttttactttctaatgtcgcatttacttataaataagagaactgttgagggacagactataaccactttgctgaaactatgaaaaaagcaagacatagattttgtttatatttaattcttaaaacaatgggtgattcttgcatctttcttgcaggttcattgggtagcagtctctgagaaggaggtgcaggaagttcaatggggagtggtcttgggaagggaagaaggcagagcaggataagacagaggcaccagttcggttgcaatatagtcacaacagggtccctatgagcaccacacagggagctctgaaactagaatagtccttcagagtaggcctgagtgggatgagagcttgggcttttatacagttgagagttgagatcagtcagctgacaatcttcccagcagcttggaaaatcagtcatttggtcttaaaaggggtatttgggaagtgccacccagtattcatgacatgttctataatatgtaactcataaaaaggagagaagtgacatttaatgtaggaatatagatttatttttagtgttctctttttgaagcagttataaaataaatagaaatttaatttttggtattttcctttcaaatgttaacaattctttttgcaacttctgggttaggttgacatcgtactttggtctggactgtaagaccgttagtgaaaatctgtcaataaatctcaccccatgcagtgtaaaagtaccttttctctcttcattcaaatgagaatcgtttagatgtcctgtcattctagatgggttttgaagacaaaagtagcatctttctttttcatcagattttagggctagagaaagaatttatccaagggatattttctcttcttttttgtttttttttgtttttgtttttgagacggagttttgctcgtcacccaggctggagtgtagtggtgcaatctcggctcactgcaacctccgcctcctgggttcaagggattctcctgtctcagcctcccgagtaactgggattacaggcatccgccaccacacccggctagtttttgtattttcagtagagacggggtttcaccatcttggccaggctggtcttgaactcctgacctcgtgatccaccagcctcagcctcccaaagtgctgggattacaggtgtgagccactgcgcccagccccaagggatattttcttatgaatacttttaaagaagacattgatttgtctcagttcacttagatgtcatgttatatatattctaaaagtattttaaaaattcatctgacttttttttttctaaagaggaaatctcggcagaaaaacagtacttatttttgttactttcttattgattcctaatgatttccccagaggtggtcatgcatgtggagggccatcctcctccacacccactagcttcttactttactgacagatatgatacaatcatctttgatgtgtctcaattctattcctccacatttcaggatttatctacttttaaaataatggcccttccttttcccttaccatttgacgagtatttgttgagtgcataccatgtgttaggtattcttcaaggtgcatggaatatgccagtgaacaaaacacacagaagtacctgtcctcattgagcttacagtcttaacttttccagattctgtttctgttcttaaggcatcttctaacatttcttttgggaaatacctcttgaatttttttttttttttttttttttgagatggagtctcaccctgtcacccaggctggagtgcagtggcgtgatctcagctcactgcaagctccgcctcccaggttcatgccattctcctgcctcagcctccccagtagctgggactacaggcacccaccaccatgcccggctaattttttttagtagagacagggtttcaccatgtcagtcaggatggtctcgatcccctgacctcatgatccacccgccttggcctcccaaagtgctgggattacaggcatgagccactgcgcccagccagaaatacctcttgaatttttaagctttctaactgctttctagaaaacactcatatcctcttattttatataattttctccttatcaggctaccctaaaactaccatactcatatttttttcctctattgttttaaagtagtctgcacttactctcagcttccttagttctctattattccttaacctcttgtgatccaatgtctttcattagaagtttgcaaaactgtcccgtggaaaatatactttaaaaaaatccattttttttgcctccactgctacactgtcaatatctctctcttggaccattgcaatagcctttttccaaactggcctctttgtcaataattagtcatcaaatctaccttataagctgctgtcaaaatactcctggtatcaggaggtcaagactacccctagttttaatgactcatgaggagaattcacaggcctcagcatatattaggactcatggctgggatttattatggagaaagaatctaaaagaaagtcaactaagggaaaaggtgcgtggggcaaaatcctggggaaattaggcacaaacttccagaattgtttcccagtgaaggcacacaagacacacttaattccctcagcaagggattgtgacaacacataggaaatgttgccaaccaggaaaacttgttagagactcattggccagggttcttattgggtgctggtcttgtgggcaccctctgcttggcatgttaccaaattccaggctcccagaaggaaagcaggtgttcagggtaagccatatcgtttatataaacattttaggcataatgaaccaggcttttaaattatggaatgataggaaccttccccaaatccaagttcccagatgccagccaagggccaactttgcaagcaggcttttctaaggacagcaatttaggcctgctatgttaactattttctgtacactcttcctaaagtgtagctctaatctaacttccttctttccttctggaaattccagagatatttattggaaatctgcaatgtatcagccactattttagatactggggctacagtgataaacaaaatagataaaatcctgtcatgttttgatctataagagaagatagactataaagagataaatgaaaaatgaatagtaaatgtcagatggtagtcaagattatgaaataaagcagtttaaggggaaaagaacaagggatggggtaggcactattttagataaggtcatcagggaggcttgtctgaaaaggtgagattttatcatagacttaagggaatgtctaggcagaaggaatagcaagtgaaaagcccagaggtgaaatgagctggatatgatgttccagaaacagcaagaaggacagcgtagctggagtgcagtgtggaaggtagagcatggaaggagatgaatttggtaaaataggcaacaaacagattatgttggctcttttaggaagccacgataaggagtttggattttattctaagtataatgtaaaattctcaaagcattttgaacaggaagggacatgacctaatttatatttttaattgattatattagttgctgtgtcaaaaacgaactgtaagagaacaagaatggaagcacagagacaaatcaaatgcttttctagaagtcttaagacatcatggaggcttggactagggtgagagcagtgaagaggcgaggatattatgacactttagtgcttaaaaacttaaatcactcagttggctacagtatgtagttcagataccttcaaggcattttttgaaaccaagtttcagtcttgcacttattcccactaaaaatttctcaaaattctgcctttttcagtgcatatttaaatcaacctaaatctctgtccattacttagatattctagactttcttacctccatgattcattatatactcaattctctttgtgaaaaatcacaatctcctttagccattttttccatccaaatgttacctgttcttcaaaaccaccttttcatgaacctttccctattctctactttgaaattaatttttcttctgttatcccatatatttcacttatctattactgcctaaaaccctaacccagacttactggtttagaatatcaattttaccttgcttgtgattttgtgggttagaaatacatgaaggactcgggtgcgtgactcatcagctgaagtagctgggactagaggatcaattttcaagaaggcttattcactcacaagtttggcacctcagtgcttcttggcctttctccacctctgcatggtacctcatccttctgagctttggcttttctcagcatgacaacttcttaaagccatcaggagaccaagatggaagctgccattcctcttaaaggccaggtctggaactgacataccaatacttccatggtactgtattggtcactgaaatcacaggccagctcagattcaagagtggaaagaaagtctctgctcattgccaagagcatggcatggacatacagggagagaagaaattaatggcagccaccttggggacagctaccaaagcatactcccttactcacatttccattttcaaggtgttggttggtattaaatgtattttcacagatgtctcatcttccttattaaattgtaaattctttgagggagagaatggtggctggttcatttttgcatccctagtgtcacattacagattttctttttctttcttttttttaaaatttaacttttaagtttgggggtacatatgcaggatgtgcatgtttgttacataggtaaacatgtgtcatgggggttggttgtacagattatttcatcacccaggtattaagcctggaacgtactagttatagttcctccttctctccctcccaccctccaccctccaataggccccagtgtatactgctaccctctgtgtaagtctgtgtgttctcatcatttagctcccacctagaattcgtggtatttggttttctgttcctgcattagtttgctaaggataatggcccccagctctattcatgtccctgcaaaggacttgatctcattctttttgtggctgcatagtattccatggtgtgtatgtacattttctttatcccgtctgtcattgatggacattctggttgattccacatctttgctgttgacatcacagattttcaatgccctttttttttaaatagaatttatgtggcaatattcttagaaaatatatacagaaataaaaactaactcagttgaacacataattattgcatatgtactaagttcaatgggtttattaattgtgaggattgaacattttgctttttttaacttttattttaagttcagggctataagtggagatttgttacataagtaaacttgtgtcatgggggtttgttgtgcagattatttcatcacccattattaagcctagtatccattagttatttttcctgattctcttcctcctcccactctccactctccaaaagaccttagtgtggtgggctgttcctttttatgtgtcgatgtgttctcatcctttagctcctgcttgtcaataacaacatgaggtgtttggttttgtgttcctgtgtaagtttgctaaggataatggccttcatctctatccatgtctttgcaaaggacatgatcttgttcttttttatggctgcatagtgttctgtggtgtatatgtgccacattttctttatccagtctatcactgacgcgcatttaggttgattctgtggctttgctattgtgaatagtgcagcaatgaacatatgcgtgcatgtgtcttgttatatttgaatagttttacagtttataaatgaattaaagccattatacatttactgggcaaagttctgtgatgggtgctgtggggaatacaaaggtgaatgacaccatcttcaatacaacattatttaattcacatatcaaaacaactgtctgaagtggtggagaaaatttgccagtctcatgttatacatgagaaatggtcaaggaaacttttatcagatctggtgctacaatttagtctctttgtttccagggcagtgatattccgtacaccatgctaaaggtccatgctaatgctaatgctaatgcttagtttatgttaaggcccttcataatatgtccttaaacttacccttccttttatgtctcaatagtcttcaagtactgaatattgttattttctaaacaggctcaaaacattctcataattttgctgatgaaggctgtaagactcagcaaatctgcaatttcattttctcctgcctgctttattctagccacactggcagctggttagatgggatggtgcccattcagattgagggtgggtctgcctttcccagtcctctgactcaaatgtcagtctcctttggcagcacccttaaagacacacccaagaacaatactttgcatccttcaatccaaccaagttgacacatagtattgaccatcacaatatttaataataaaatactaacattaattgagctcctaccttgcagcaatagtgtatgaggcactggagatataaaggttcgtgggaaatattccttaccctcaggaggttctcagactatcagtggagacagtgtcttctagattgtgccttctccttcccaatctccctgtttccatctcttattaaaatcttagtcatttttcagagctcagcaaaaatatcacctcttctataaagtcatttgtgtttcctctagtcatctgatcacttttatatggcagttacattgttcatagtttgttgttatgtggttgtcctcaacttgctttgtctcctactctgctgacatttgggaagacgcaacatttgagttcagtctatagcaccttgtacagggtaggcaaccccatgtttttgaacattggattcattgtaacagtcacttctaggttgcctgaaataaacacatttttttttttgtggtccacacttcctatacatgcttttgacattttttctcaggccatggcctttgctggaggctttgttggccatggttatagcatgtgactcctccctcactacagttgactggataggaatgtgcacataatccaaggctggtgaactcaattgctgacccacagcttatcattttatcatattttctaatcagtttgcattaatatgaggaggtttcagtttatggtgggtgtttgccctataatttaatatatttttgtgtcaggcaaccgtattggtctgtgtgcaagaagaggaagctgctcaagagaacaaatagagaagatgagattcatcatataaacttcgagagaatgactagacctagttgcctgagtcaagtgcctataagacaactttttctttctctgtgagattgcctctctgattattaagtaaattctccctcacttgaactatattgagtgttcttttgcaaccccaaatgctttgaataaaacattgccacattcagtcttctcagtctacattttcctcagtctctcaccatattcttaaacttctgccgagagctgctttcttgaaatgtttccttggacttttgtggtactgaattatttcaattcttttcttacctatcagttccatctatactttccttttgtaaccattctttttttttttttttttgagacagagtctcacattgtcacctgggctggggtacaatggcatgatcttggctcactgcaacttccgcctcctgggttcaagtgattctcctgcctcagtctcctgagtagctgggactacaggcatgcaccaccatggcccagctaatttttgtatttttagtagagatggggtttcaccatgttggccaggatggtgtctccatctcttgaactcgtgatccgcccgcctcagcctcccaaagtgttggaattataggcgtgagccaccgcgcctggacttttctttttttagagacagagtcttgctctgtttcccaggctggagtgcagtggcatgttattggctcactgttgcctctgcctcctgggttcaagccattctcctgcctcagcctcctgggtagctggaccacaggcgcgtgccaccatgcccagctaatttttgtattttttttttgcagaggtgaggtgtcaccatgttggccaggctggtctcaaactcctgacctcaagtgatccactccagctttggccttccaaaatgctgggattacaggcatgagccattgtgcctggcctttgccttcattttctttgtccatgctttttctctcatgacccttgtctaattcccatggcgtcggctgtcaaggctatgaatgtgactaatatactgcacacacatgcacatgcgcacacacacacacacgcacgcacacacacacacacacacacaccgatttccttcagttttagcttctctcctaatttctgctctttacttattggcatctgaaacttaacagctcaaaacagaattcctcatctttccctccagatgagtttgtagatttgggatgatgtttgaagtacttcttcactcttaatcctatgaatctgagttcttgtgactttatttcctgttaatggtgtaatttttctcttagtaatctagctagacatatgaatgcccttttaggtattttagtgtcaagctggactttcaggatatattgtgattaatatatattattaataatatatattaattaataatatattaataattaataatacacttcaggacatattgtgattaataatgattaatagaccctttctattaagaataggttaataatagaccctacttgaacctcacatttctagatctattctagatctggctgtgggatgggaggctgttttcatctcatctgtaatccactttagatatctaggatacaggaaaaaagtgccttcagtgttccaggagtgagttaatctcattgacctattatagtgtcccctgcacagttttccatggctgagagcagcatgtgatgtcggtgttaaataacttacttcacaatgtacaacacagtagttagttgtactgtaatagggtgcttctcttacatgatactttcttgaaattcaactcctgaactgattcattagcatttgcaacagaaccggagagtctaagaagatctaccgaaagtaggattggctctgagacaaaagtggccccataagttgttgaaaaagtaaccgatctgacagacttgagaacttccagattcttacttcagccaagaaagacagcggtcattttctagctgggatggagcagctgtccgtcagtggatttctgtcgaatatatgttataggcagataaccaagtgttaaggcaagatcagaaagatcttgagaatgcagcccctgcccttgcacaagaacctttcatactgctgagaattcaatacaagtcctaatctaaccacatgaaagtagctgttttctgtagattcatattgcttgaagtctgatcctaaatatgtttaattacaaaacccaaaatatttttcttagctgcaattgaaagcagcctattagcaatgaactttgtaaggtagtgaaagttggattatctagggctccttttactgaaaatctttactgatgagtactgtttataaaccacagtgacaatttatgttgataatttgtaaaagattctgaactttcttcatcgttaaaaatataaacttatttttagtatgtggttgggggttttattgtatgtacaatgtaaaacattggtagttcatatattcatttttaagtggcaataataaccagcctcctatcatgatcattctgaagaaacagtagtttgccatattgtgaattctgcatattggagtcctggggagttgtgctttgtttcctcagtaagccacttcaattaacagaagatctttgaaattcatttcaggtgtgtttccctaaatttttatttttttcaaatgagaatgtacacaagttactaacttttagcaattataaaaaagactactatttattgagcacctgcccaatacccaccacagtgcaaagtactttacatacattctctttaattgtcctcttttgaactggcaggatctttagtcctaagtagtgtattagaaagaagatgagctttggaagcagacagagctggatttgccactacctagatatgtgaccttgtgcttttcttctctctgaagaggtttataataaagatttatatatattcattttattctcatgtgtattactatgaagtgggacaaaattggtaagcattcagtgagtgttcacaccatccatgatcatttcctgctaatggtttataattgaaggtggtttataatcgaaggtaagttttaaagtttggagcccactcacaactcatttctcagcttattctcaaatctgatcctccaaactacagtaaaaatctactggtgggattagaccgctggagtttgctgcagcatattgtatttaaatagggtccttgcatatagggttttttggtttatttgcttgctaacttttgccttaacatctgctttagagatctgctgggacagtgttctgaggatgggggcagtcattacccagaggtagtttaggaagttacagcagcgaccactgctttttggaaaattacccattaatttattaaggaattaaaaagaaatcaattagatttttctttattatacttgaagaaactctcatgcccttaaattatcttacattctcggctgggcacggtggctcacacctgtaatcccagcattttgggaggccgaggcgggtggatcacaaggtcaggagttcgagatcagcctggccaatatggtgaaactctgtctctactaaaaatacaaaaattggccaggtgtggttgcacatgcctgtaatcccagctacttgggaggctgaggaaggagaatcgcttgaaccaaggagatggagtttgcagtgagctgagatcgcgccactgtactccagcctgggcgacagagtgagactttgtctcaaaaaaaaaaaaaattattttacattctcttcaattctttctttttgggggaggggttatttaaagagcaatgcatgttaagtatagaacatttggaaactacagaacagagagagagagaggaaggaagaaaagaaaagaagaggaagaacaatgaaaaaggaaaagaaaattaaaatcacctactattcgaagactcttgactaaccagagcacaatttattttctggatttccctgatttcattaagtattatagcccatcatatagatagttgtactgtgatttattgaatcaaccttcattgcttacttaggttgtttctatttttcttttgatataaatgaaacatttttgtatataaatctttgaataaatgtctaatttttttggaaagactcctagaaagagaattattgggtcaaaatgagtcgacttttaagaaagctctggaaacaaattgtgcaaaggctttctgaaaagaatgaaacaagttatgtttctgctagtagcatatgagagttatttttctccagatgctttctttttcaacaatagatcattcatttgccccgttttttgtttgtttgtttttggttttttttgtttttgagacggagtcttgctctgttgcccaggctggagtgcagtagcgtaatctcggctcactgcaacctccgcctcctgggttcaagccattcttctgcctcagcctcctgagtagctgggattataggcatgtgccaccaagcccagctaatttttgtgtttttagtaagagacggggtttcactatgttgtccaggctggtcttgaactcctgacctcaagtgatccaccatctcagcctcccaaattgctgggattacaggcgtgagccatcacacctggctggtgctgtttaacttatttacatgtgtcattttcctcaacaagaaaattataaagtgaaactgctagtgtacacaatagagcagagcatcacagcgctactaaccaactttttaggattacgaagaatagatgaagcacctgaaggcatttttaaggtctctatttcaaaaagaaaggaagtaaaatatatgtattccatgaaattatgaatctgtttgcctaatgtttttttcaagagcctgggagagaatgggatttagtattcagtaaatattgtaccatttcttataacaatatacaaaatttacattttgtggtctattctgtggtgataatggtggcatattacatagagaaaatgataatgttaacattttatggatttgggaagacatttgcttactcaacctacataaattttataggtttataaatctgtgaaaatacgctgtttgatcaattgtgcattctgttagtgaatttacaactggttgtcttatattgcaaagcagagtcacacctgacggtgttaactggaacagaagtgatctagggaacctggaagttggaactagacatgtccttgagtgagggaggctggagatgggttgggaccaaggcataactatagacactgggggaaagattatttcaggaagatactttatggtatccagagagctgacataatggttttatcagaacaaaggcccaggcacagaaggaaatgagcaagggacccagttaccacatctagaggatcagctgggacttgatttcaggaaaacaagacagaagcctgttgttagaactttgccaaagagtcagttttcagaattgaactaatagcaaggttgacttgatatctagtgctctacattgagctaaagttcccttctcgtgaggatgctgttggtccaaagcctgagataagattgaacatccaggaaagcttaagtggcttccactgtggggagacaagggataggggtaggagggtattggaaccagacagaccatggtagtatcacccaaaggtgactattaatgttttagaagtaagagggatacatgatgacccagaggagccagtcctagattcagtgctatttaacacttccatttaatggatagattagagaacaagccattagttactcaaatggcatcaagtaaaaatagttacttgcatattagtaaataagatttcagcataatcttaaaaaactggataactgattaaaacccaagagtagcttaacaaggacaaaagcacaacagtacctaaatagaaaaaaaaaatgctgcaagtaaattatttttcctaaaattatagatcaaaaaatggaagacctttattttctggttgaccttttctggaaaactcatgaggtattgatggaatttttaaactgtgacattagtaactttactcttcccagttttaaagttttctgaaatttacttgattttctagagtccagttatgcttagaaaaagaataaaatattatcagacctctcttggtgctacttgatatatacttttcagaagaagtattgtatatattttttgggtacaagtcaagaaaagtggatgccatgaaattatgaaaagtataatctgatttttctagtgtgctggatgggaaaaggtcactaagcactactattcactgcttctgctggtgttttaataaaaacttttctaagaaatcgagtgttgaggatataaaatcaattgagtccaagagggacttattgaatatagaataaagaaaaatacagattaagggacattagaatgagtcatctcacataaaaaatgggatatcagtacagcagaacattttgttagaatgatttttatgtgttgcattaataatttacattcaatttcatttaaaactggttagaatatttgaaaaatatctactgaagttggcagctttctttttagataaagataaaatgaagaggcaggtgataaaggagcatttatagcctaagatgtgggtttaggggaactctgacattaaagaaaatgttaaaatgtttgatatgtctgcactttacaagagagtttctgctagtgagctctttctcttggagattattcaacccaaggaacacttgatcttgcagtgcagctcagcctgggccatttatatgcctacccatggttatctggttatctgacctcttggaacaagaatcctctcctttctaattttcctaccaccaagaatggctgagcaagtgtttaaccctgcctcaatgactcctttatgtactcaaatgccatcattctgatggcttaactttttcttccacaaaaagaaacaaagcccaattctttaactttcatcactatcatatttaatgatcatgcattcacagagtattgtgttataagtgaatgcctggtcattttgccagatggtatcatttaagaaaagaagtattttgatttttctaagatcagtttgcatgaacaacttgacatgttcacaaattaaaaagaatgatttcttaatttcctcaaaatcgttcaataaaacagattcattaaatagttcataagaagaaagtttatttccttaaaaacaaccttttaggccagacacggtggctcatgcctgtaatcccagaactttgtaggctgatgggggaggatagcttgagcccaggagttcaaggctacagtgagctatgatggtaccactgcactccagcctaggggacagagcaagatcctgtcttttaaaacaaacagacaaaatgattcctaatgatattagtgttttaaattctatttaacttttaatatctatttaaattttaatgtccccaatcctagacctttcatcaggccctttcacaaagcagtctttctcctgaggccccagccagctcttttggaacaagaattctgtcctttctaatttttctaccaccaagagtgcttgagcaagtgcttaaccctgcctcagtgactcctttgtgtactcaatagcactacattgatctgttgatcatttatcactcccgggttggtgcctggcttccatttccctggtcctaaacatttacatctgaagaagaaaaatcagttatagaactaatattctctgtacgcaagaaaacttttttacattgttataccaagcagtttagtcccttgttgttccagtttcttcactccaaaataacatttgcatcaacatttgcttatcaaacgatctgtttttggctgggcgtggtggctcacgcctgtaatcccagcactttgggaggacaaggcaggcagatcacctgaggtcgggagttcgagaccagcctaaccaacaaggagaaaccctgtctctactaaaaatacaaaattagctgggcgtggtggtgcatgcttgtaattccagctacttgggaggctgaggcaggaggattgcttgaacccaggaggcggaggttgcggtgagccaagatggtgccattgcactccaccctgggcaacaagagcaaaactcggtctcaaaaaaaaaaaaaaatgtttttgagcatgtctgtgcctgtgtatgtctcccctatcctgaagatttctagttccccttaagttatgcagagaaagcttagaaagggcagctgcagttgcaaggcatcagatgagtttcttagtacttaatctagaatacttgagtattctttctattcattctcttattcccagtatgcactcatctgcattttctaggcactcagtgggaggggtgatggacaatcttgatggggagtggggaccagaagatgatcacccttcttctcctggcagacaccgtggctgaagacattctcccattagattatattaactgttagtcaattaacttagactttatttatttttaaatatttatttatttatttgcattttcacatagactcttaaaaccataatgggtaatagcagaaagttgtctttctgggctctttgatctgcagcttgagagtgttagaaataacctaaagtgttcagattagagaaggatggagacttatttgctcatttaacttaggaaaatgatttaggcttggagcaagaacttccttttctatgaatttctggatgtggcatatctttatatttttagagaagggagcaaactcagtcctgagtctgatgacatccttattttctgtttcctccgtgttgtgatcctgtgctcccaaatcccccaaatctttctgtagcttttgcttagatcacatgaataaatatagtttaaaagtgtactgtatattctctaagaattgtcaagcacttagtatcattactgtttatttgtatgttttggttataataattctgttcattttaaccaaatatttataccagcatgctaaacatacattgtattttgctgtcaataattttctacccaactattattttctctataaaatactttttaaactcctactttattttttctattttatttctattaacacattcatacttgtgcaatacattttagatgagttcaattgttaaacaaagatggcagaatgatacctagtgctatggctcatgcctgaaattccagcactttgggaggctgaggaaggtggatctctcgaggtctggagttcgagaccagcctggccaacatggtgaaacctcatctctactaaaaatacaaaaattagctgggcatggtggtgcatgcctgtaatcccagctactcgggaggctgaggcaggaggatcacttgaacctggatgacagaggttgcagtgagctgagattgcactactgctcttcagcctgggtgagggagtgagacgctgtctcaaaaaaaaaaaaagaaagcgggggaggagccaagatggccgaataggaacagctccggtctacagctcccagcgtgagcgatgtagaagaccagtgatttctgcatttccatctgaggtaccgggttcatctcactagggagtgccagacagtgggcgcaggtcagtgggtgcacgcaccatgcacgagccaaagcagggcaagccattgcctcactcaggaagtgcaaggggtcagggagttccctttcctagtcaaagaaagtggtgacagacagcacctggaaaatcgggtcactcccactggaatactgcacttttccgacaggcttaaaaaacggcgcaccaggagattatatcctgcacctggctcggagggtcctacccccacggagtctcgctgattgctagcacagcagtctgagatcaaactgcaaggcggcagcgaggctgggggaggggcgcctgccattgcccaggcttgcttaggtaaacaaagcagctgggaagcttgaactgggtggaggccaccacagctcaaggaggcctgcctgcctctgtaggctccacctgtgggggcagggcacagacaaacaaaaagacagcagtaacctctgcagacttaaatgtccctgtctgacagctttgaagagagcagtggttctcccagcacgcagctggagatctgagaacgggcagactgccccctcaagtgggtccctgacccctgacccctgagcagcctaactgggaggcaccccccggcaggagcagactgacacctcacacggccgggtactccaacagacctgcagccgagggtcctgtctgttagaaggaaaactaacaaacagaaaggacatccacaccaaaaacccatctgtacatcaccatcattaaagaccaaaagtagataaaaccacaaagatggggaaaaaacagagcagaaaaactggaaactctaaaaagcggagcgcctctcctcctccaaaggaacgcagttcctcaccagcaacagaacaaagctggacggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacatgaagaatgcagaagcctctggagctgatgcgatcaactggaagaaagagtatcagtgatggaagatgaaatgaatgaaatgaagcaagaagggaagtttagagaaaaaagaataaaaagaaatgagcaaagcctccaagaaatatgggactatgtgaaaagaccaaatctacgtctgattggtgtacccaaaagtgacggggagaatggaaccaagttggaaaacactcctcaggatattatccaggagaacttccccaatctagcaaggcaggccaacattcagattcaggaaatacagagaacgccacaaagatacttcttcaaaagagcaacaccaagacacataattgtcagattcaccaaagttgaaatgaaggaaaaaatgtgaagggcagccagagagaaaggtcgggttaccctcaaagggaagcccatcagactaacagcggatctctcggcagaaactctacaagccagaagagagtgggggccaatattcaacattcttaaagaaaagaattttcaacccagaatttcatatccagccaaactaagcttcataagtgaaggagaaataaaatcctttacagacaagcaaatgctgagagattttgtcaccatcaggcctgccctaaaagagctcctgaaggaagcactaaacatggaaaggaacaaccaataccagccactgcaaaatcatgccaaaatgtaaagaccatcgagactaggaagaaactgcatcaactaatgagcaaaatcaccagctaacatcataatgacaggatcagattcacacataacaatattaactttaaaatgtaaatggctaaatgctccaattaaaagacacagactggcaaattggataaagagtcaagacccatcagtgtgctgtattcaggaaacccatctcacgggcagagacacacataggctcaaaataaaaggagggaggaagatctaccaagcaaatggaaaacaaaaaaaggcaggggttgcaatcctagtctctgataaaacaggctttaagccaaaaaagatcaaaacagacaaagaaggccattacttaatggtaaagggatcaattcaacaagaagagctaactatcctaaatatatatgcacccaatacaggagcacccagattcataaagcaagtcctgagtgacctacaaagagacttagactcccacacattaataatgggggactttaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatagttggaagtaaagctctcctcagcaaatgtaaaagaacagaaattacaacaaactatctctcagaccatagtgcaatcaaactagaactcaggattaagaatctcactcaaagccgctcaactacatggaaactgaacaacctgctccggaatgactactgggtacataacgaaatgaaggcagaaataaagatgttctttgaaaccaacaagagcaaagacacaacataccagaatctctgggacgcattcaaagcagtgtgtagagggaaatttatagcactaaatgcccacaagagaaagcaggaaagatccaaaattgacaccctaacatcacaattaaaagaactagaaaagcaggggcaaacacattcaaaagctagcagaaggcaagaaatagctaaaatcagagcagaactgaaggaaatagagacacaaaaaacccttcaaaaaattaatgaatccaggagctggttttttgaaaggatcaacaaaattgatagaccgctagcaagactaataaagaaaaaaagaagaatcaaatagatgcaataaaaaatgataaaggagatatcaccactgctcccacagaaatgcaaactaccatcggagaatactacaaacacctctacgcaaataaactagaaaatctagaagaaatggataaattcctcgacacatacactctcccaagactaaaccaggaagaagttgaatctctgaatagaccaataacaggagctgaaattgtgtcaataatcaatagcttaccaacgaaaaagagtccaggaccagatggattcacagccaaattctatcagaggtacaaggaggaactggtaccattccttctgaaactattccaatcaatagaaaaagagggaatcctccctaactcattttatgaggccagcatcatcctgataccaaagccaggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatatgcaaatcaataaatgtaatccagcatataagcagaaccaaagccaaaaaccacatgattatctcaacagatgcagaaaaggcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtgtatctagaaaaccccgttgtctcagcccaaaatctccttcagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgtgaaggacctcttcaaggagaactacaaaccactgctcaaggaaataaaagaggatacaaacaaatggaagaacattccatgctcatgggtaggaagaatcaatattgtgaaaatggccatactgcccaaggtaatttacagattcaatgccatccccatcaagctatcaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagtatggtactggtaccaaaacagagatatagatcaatggaacagaacagagccctcagaaataacgccgcatatctacaactatctgatctttgacaaacctgacaaaaacaagcaatggggaaaggattccctatttaataaatggtgctgggaaaactggctagccatatgtagaaagctgaaactggatccctttcttacaccttatacaaaaatcaattcaagatggattaaagacttaaacattagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacagaatgggagaaaatttttgcaagctactcatctgacaaagggctaatatccagaatctacaatgaactcaaacaaatttacaagaaaaaaacaaacaaccccatcaaaaagtgggcaaaggacatgaacagacacttctcaaaagaagacatttatgcagccaaaaaacacatgaaaaaatgctcaccatcactggccatcagagaaattcaaatcaaaaccacagtgagataccatttcacaccagttagaatggcaatcattaaaaagtcaggaaagaacaggtgctggagaggctgtggagaaataggaacacttttacactgttggtgggactgtaaactagttcaaccattgtggaagtcagtgtggcgattcctcagggatctagaactagaaataccatttgacccagccatcccattactgggtacatacccaaaggactataaatcatgctgctataaagacacatgcacacgtatgtttattgtggcactattcacaatagcaaagacttggaaccaacccaaatatccaacaacgatagactggattaagaaaatgtggcacatatacaccatggaatactatgcagccataaaaaaggatgagttcatgtcctttgtagggacatggatgaaattggaaatcatcagtctcactaaactatcgcaaaaacaaaaaaccaaacactgcatattctcactcataggtgggaattgaacaatgagaacacatggacacaggaaggggaacatcacgctctggggactgttgtggggtgggggaaggggacagggatagcattgggagatatacctaatgctagatgacgagttagtgggtgcagtgcaccagcatggcacatgtatacgtatgtaactaacctgcgcgttgtgcacatgtaccctaaaacttaaagtataataataataatttatatatatatatatatatatatatatatggcagaatgaaagctccatgtgggcagggatttttatctgttttgttaactcctatatccttggcacttttaagagtgcctggtacatattacacactcagtaaatatgtgtttaatgaatgaaaataatggaaatatgtcttttttttcaccttggttaatattatccttaaagtactgatgtttttattggtgcttttccatgtgattttcaattaatatatgtgtagcctttaatgcatgtaccccaagaaaattagtctaatttatagttatattcattttatccaaaaataaactacacagtttaggcatcttcctgttgtatctgtctgccatgtttttgcatgactttaaaaattggagtcctccaagaaaggcttgtcattattgagattattcataaaagctatcctaggctttgaaacattccaaaggaaaagttcaaaaaaatattttgagcatctggaactgttttgagaagtggaatactttataagcctcaaggcagtcattcttaacttcattagggctaccaatccttttgagaatttgatatctgttgaacatatggccctgtcaaatgcacataccaacatttaaacacgctacatttatttaagggatttgtaggcttctggaagctcattcatgaactgtctatgggtccttggactccaggtaggaagcctggctttaaaggcatacctatcaagctctaaatccttgaatatagctgctgcatctgcttcattcttcaccacaggaaagtgcctcatatttaataaacattgcttgaaacaatgtctagtaacaaaaaagtcatattgttttataatcatattttgaacttcttactgtatatatattcatatagattaataaagtttgtattaagtatctgtcccatcatgttatgggataaaagatcccatttacctgaaggaaagggaactaacagagagggactatttttgcctgatagagggctggggctatctgagtgacatcccagagaaactggggacagagagaggagaagcagaccatgtccaactggcattctatttaaatctaacatccaggtgttctctgagtttatgagtcgttcctgtttttgccactgtgtgacagttgcttttacagtatgcattatattgtctctagaaaatcaatacaaactggatttatgcaaggcacagaatcacacaacatgctttaataaaagaataaaggagaattttggcatattttaattattcattttgttcactttcatcatggcagaatataagatatgttttatttttaaatttatgtttacagagaatagaagtattacacgtgaccaaatattaactatatcatgtcaagtaggacaaaagttctcatgggcttttccgtttatattgatgtattttaattgacttagttctgttaatgtttttgggataccaggtataaatgcccagatgtgaaagatagaaatgctttatcctttccatatttcctctggtgcatctgagggcagacaaagtatcacaggagaagtctttggctaaattcaatcaattaaatggaaaccgtgatgctataaccccatgtataccaatgcatgggagagtcgggggacatgcagcagcttcgggaggggatgtgcttgaaggcttggtactaggaatattcatctatggggaaaaccttgagttactaaactttctctgatactgctttggttttgcttctcttccctctattactgctttcttcctttctcagacctgcaggtctgctaagaaacttagctctaatgaacccgctcctcagtcttcccctagattgtgatcacattttgttcttctttatccctgcactaagtctgatctggcaattgaatgaactaattcatttcacaaatattcgtggtgccccttctatgtgccaaacactgtgccgggaattcagtggagaacaagacagacacaggccctgccaatggagctttcagcctccagttaaatgcatgatagagaggatgggagagaaagacagtggggaacaatgggttacttttactgtccctgactgatacgtctgcatataaaagaacagtcagattggtgagatttcatggtagccgtgcctgctctttattctcctgtctttctttcattcatgaaataaatcaaattttggattgaggagctgaccaaaaagcatttgggtatgtggaaactttgagatcaaagggagaggaagctgaaaccttcagagggtagagattgatggtatttgattttgttcatagtgtagtatttattaatagttctgtaatatttggtggtataagttctggtaccccctccttcagcaaatttatattaaaactcactgtacatctgcatatcagaaagcctagtatcttcttgggattttcttctcatcttgatttacccaagaacccctgaagcttatactgtgagaggaaaatctggctgctttctttcctcatgggaaagcactgatgtttaaacagtgttactgcgatttcttctttgcttccacatggtttcagtattgagtgttagttctttccaggcatacagacatccaggttctcaaagtctaggtcttacctataccccttggagggaggcttggccacccctcagtgacatttaccaaaggcgctccacactttagacttctccttcagttaatattcccatcatgagtcattacctcttaggatccaagcattgtgccaggtggctggaaacagaggggcagaccgaagttaaccctcctctgtggatcttgggcttcctgtcttgagtctggttcatcagtcatagttcttcttgcctcaaggttattttgtttctagagcttcattaccctttcttaccacctgaccttgtccagtccacacccataactttccttaatttcaaatatcagtgcttcttatacaaactgatcttcatccccttcagtgaccaactttgcatagctaagtactcttgcttggtcacagaagggtttattgcacttagtcccaggccagtgactatctgctggctctagaattgtctaatttaaaggcctgctcaggcgagacctaggagaatagagaaggcttgtttctattattaaaaagaaagaggaagaaaaagaaaggaggggaagaaggaaagaaggagtgaagaaagaaaaagaaagaaagaaagaggaaaaaaaaatccagtggtgtttactgagtgtagtgttttcaaactagaggaggcaagggtaagggaacactttttttatttttatttttaatatgggaggctatgaccacatttcactgccactgttgcaggtattacagcttcagcacccccctcaacctcacctcccatccccactctaacaactctcttgtctgatctagcaaaaggactgctgtggccattatggtaaatagtggcagggagagggtgatggttgggcaagaaaaaagtgggggataaattcatagtcactactaacttattcttctttttccagccacattttgagccaccttcaaatccaccagaagaggggaggcatggagggagaatgttagaaggggaaatggaatggagagaggggagggattccctgttccacctctttgttcttcattgcctaatatttttcagtgacttaatgccagccatggtaacctctttattttcttcaaaatgttgtttaaattattaaactaaaacaagaacgttgtgtagaatttagaaaatgtagcaaagttcaaagaagaaaaaattctctagtaatctgtcatctagagaacaccaccattaacattttggcagttttcttatggatatatgtttataaaacatgaatttattctgtgtattcaatatttataatgattctaccccatctagattattaaatatcatgtataagcacatcttaatggttgcatgattttattactttattgtaccaccatatttagttgaacatttaggatgttcacaggatgctgcctttattttactacttatatcactctgatgtgaacgtcttagtccatagatctttgaacattgtcagaaggagaaacacaatgaagagttgttacattactgttgctggagtatgaaactgatgagtcctgatggtgttctctcttcagttactgggactaaaaaattaaatggcatctcaaagttttcctacttcatcctaggaattgaaagggctaaacataagccaggtagatatatctgatttcttgttggcgtgaagtagatctaggcttcttttctgatgttaacaatctcactgttagagcctagactcccctctctactcctcccagtggtccatccttctcccctgctacagtcagatccatgttaaggttgcagcctcctagagcataatcagattacctgaagccattagttaccttaaccatttatttacggcctccctatgcccagttttagatgtgatgagttacatgcagagatcaaatctgatttattgatatagtgatacaataatagtactatggctgggcagagtggctcatgcctataattccaacacttttggaggccatggtgggaagattgcttgaggccaggagtttaagaccagcctgggcaagatagtgagagcctcatctctacaaaaaaaaaaaaaaaaaaaaaaaggcgtgctgtggtggcacgagcctgtagtcctagctattcaagaggccaaagcaggaggatcgcttgagctcagtagtttgaggctgcaagatcttgtctctaaaaacaaagaaagaatgctaactcaccttgagtgcatgccctgtgtcagggcactttagtaagtggtttatgtaattcacaatgtaatcttcacagcaatcttatgaagtggttactattattaccctcattttacatataaccagaagcagggagaagttatgtaactgtcaccccagtgggcagtggcaaaaccaggaattaagcctcagccatctgtctcccaagccctcacctttacccattatgcatatcataaacataaacatttttagcttttagtaacatttatttttaaaagatcttgggctgcaatattggggttcataattcttacctgaattttcaaaccaattcttttatatgtgtctaattttaggattcttttaaagatttttatcaagcaaaaggcaaacatttttatgaggatttataaactcatagaaggtgggagctggagtgagtgaccttacaatccccttgtcctgtcaccctcttgcacagacttgggttatacttttttagacattggccagttgaggttgatttaggtttctatagaaggacttgatctctattccagtcacttggtctatggcattgagtcatctttactagtttgttagactgatttcctagggctattatctggtagatagggaaatccttcagtttctatttctgctccacgagaacactcttatcatcaaggacatagcctgagatggaacataactgtcagacacacacattatttgacaaaaatatagcctacagggtgctgcagactgcctgcagagtgctgtgattataactgttacaagggggacgtcattctgtcattgcctggaacagttctttttttcttttcttaatataattactgacagtacactttttgtatatgcaggctccatctggtctagtctgattaaagttgatggctatttttatgtcatcagcaatcataattttttgtttcatttttagaacatctcttgcaggggttttgaatactttttttgacttgtcttttttaacttgtcacccagttcttgccaaggttaacagcaaagtttacaaaggttaacaaccagtctcacctgagaatcaccgcctaagcaaaaggttatttcaccatgctaattcttttggatagctttgtctagctgcttagttaattaaccaattagaagctacttctgatattatttttcaagatacatgcttgcttgtctgtaggccttttctttgaatttattttccttttttaaaaaacattaatttgatgcttccttcgtacagacgcttccagtgggtcttgttagcccttagctctatgcctgcctcttgaacactgggaattatcctgcatgctactgagttccacagctgtctgccttaccaacactcaaaagcattttaatattctcaccatgcctctgaaaatactttcttcagtctcaattgaccatcacataccaaatccacttttctgtcttaattctctaatctctgtacaatttgatactgtaactgcacttgaagttttctcatttgatttccataatgaaaattatctactatatactctgcttttttggtctcctttatcggctcttctttaatttccagtttcctgcaagtattaagtgagccacataagagagctgcttccctagttcaaaaacttcggtgttgtatctccagccctgcattctttcttctccttttctcctcattgcatgcatccactctctttttaaaaattttattttattatggtaataacactggacatgaagtataccctctttaacaaatttgtaagtgtacaatacgttattgttgactctaggtatagcgttgtacagcagatgtctagggctgattcatagttgtttaactggaactttatgcccgttgattagtatttctctatttccccgtccagaaccagacaaccacccttgtactctctgttctgtgcatttgactgttgtagatacttcatataagtggaatcatgctgtctttgtcctgtgactggcttgtttcacctggcataatgtcctgaaggttcatccatgctgtctcatatggcaggacttccttctttattaaggctgaatactatatcattgtgtgtatatattccacattttctttatcaatttatcgtatcaatttctctgtctatggacatttagcttgtttatatagcttggctgttgaaactgcagtgaacatggggatgcagatatcactttgagatcctgatttcagttcttttggataaatatccagaaattcaatagctaggtcatatggtatctatttttaattttttgagaaacctccacactgacacagtggcagcaccattttttattctcatcagtagtgtgtaaggattccagtttctccacatcctttccaacactttttgttgttgttgttaattgccattctgacaagtgtgaggtgatatctcattgtggttttgattttcatgttctttcttttggtgactttattctcaagaattgactgatcagctctaaattgatgcaattcgtatttatatctctaggtccagcatcactcatgatattttcatctctctttaggacctcttcattctgttactttaatggaaatccagattcaatcttctccctgtggcacaacccatgtcaatagttaatctctgcaacctctccttttttactggctttaccatttccccagtttcctgagtttgaaacactgaagttgctctctgacctctctctccttacactcaacaggataacagctaccaaattttatagattttatctctaaaacgtctttgcactcctctctttaaaaattactttttgttggtcaggcatggtggctcacgcctataatcccagcactttgggatgccgaggcgggcggatcacgaggtcagaagatcaagaccacggtgaaaccctgtctctactaaaaatacaaaaaattagccgggcgtggtggcaggcacctgtagtccaagctactctggaggctgaggcaggagaatcacttgaacccgggaggcggaggttgcagtgagccgagatcacaccactacactccagcctgggtgacagactgagactcaaaaaaatgactttttgtcataccagttcaaacctagagggcctttttttttttttttttttttgacaggatctcactattttgcccaggctggagtggagtggcatgatcacaactcactgcagcctcaaactcctggggctcaaggagtgatccctctgcctcagcctcctgagtagctggcaccataggtgcaccaccacacctggctctaaattgctttttactgtactatttcagtagcattttaaaatccatcctttaaaatgtggattacttcctgtaaaggataattcagagagtatctcttctctgcttgacaatctagttatttgttatgctcaaaattaagtataatatcttagccagatatttgaagtctgtcaccctcctgtggttccctccctgtatcttacacttcagtcacactcctgctttttgttagtccttgatctgcattgtgctttccacttctacgcttttacttatcatttatatctggagtagcttgttcccgttcttataaacttgtctacccttctgtgtttcctaatgtggccctattgatgctcttaaaataatgtgatcttttcttatctgagcccatggcattttctcatttttctttggtacttttcttactaagctttgcattatttgttggtttgtctctatctgtcttatctatctacccacccgtctctagcctagaagcttcaaaaatgtagaaaaatatttttctttctgattatttttccccagaacatgcatatactcaaacagagagtcaattaatatttggtggatgaaggaaagtgttttgcttgttttccagtgttcagtttcctttacatttttttagttagtatctggtagagagagaataagatttggagtctgatagatctagatttaaatcctagatatcccacttgctagctgtatgaccttagagaaatcaagtaatctctctgagcttctactctctcatctacaaaatgggagcaattatacttagttgcttattttgagatttgaagtattatgtgaaagacctttgcaaagaagagctcagtaagttttattggttctaccttctctttcttccttctgattttctctattctcatatattaaatttgttatacaactccactgttaatcacattttgttttaatgctatttaccttttcgtttctatgtatctcatcttctcaactaaatatcaagtttcctgagggaaggaaaagtttttatgttcacagctgcagttaaggttaggttctgcatagagagtcactcaatgaatattcattgaataaatgcattcccccatttgctcagctgacattctttccattccactgactccatgttggtgacttctccattgctacttctgtttggcagctttctaattattaccaggtgtcccaaatgtccactgtcaacctctaaaagtggactttcttcctgaactctaccataaaagtcctaaagcttctttctccaaattaaacctccatgtaaattgcccaccttagggtgccttcttgtcagtagaaccagcaaaaaagcacaataaggactccttggatttaactagtgagtcagatatgtcttacaaactgtggtttctcttaacacttgtgtggtctctctttctgtctctgcttctctctgtctctgtctctctctctctttcttggtattagaaggcaatacgcgtgcagtgggttctctaaatagaaagggatataacattagaaattggagcagtaattgaattgtaattatttctaggtttttaaaaattgaatttaaggatacattaagaaataaaccatccctggtgacttagtgaaagaaaggagaatgttatatgaaattaacatataggtaaatgtagcccttatttgtgcttttggtttaattatatggaataatgtaaatatttatgtgcttttgtaaggcaaaagcattacaatagagtgacacatttggtaaatttggattttatgttagcatgacttagcctcattagggcgttccgtttggcttctcaggtctgttgatggctaaaatcacctttgctttgaggtttggttaaacatgttatagtttgctaactttacacttgattaagttatttgaatctcttcattgtaacttcacacaacataggtagtttgcaagagaatgaaagttggaactcatgaaaatgctggttagtgtctggggtggttgtctttgatcattttgtagactatttgtttcttctcaccactgatgtttttaagtcccttaggaggcccaagaagaagtaccccttttctcagcctatgttttaaatatagaaagaaataagacagaaataaagcctgtggttaccaaaatatcacctttattcctaaaagactgtatactggagaatctgcaggcatgggacttcccaatactaaactccaaaattaaatagatttccctagtccctgacaatactaggttggacacacctctgctggaggagcagagcagaatttggagtgctgccaggagagatttggtctctagagaaaagatgttgacttatatatgccaaatttattctttcaaaatggtctatcagatatgttgcttctcccctggaagtggagagtgggccgttctttatctggaaggaaacacctaggactagggaatagacattccacataatagggccaatcctcttgtgtaatctagttggtagaaaaaatgaggtggcccattatagtggatttatcccaacatatttgttaaaaggaacagtcaagatttcaagtaatgctttgcatttaatagctacctaaaaatgatttttcatttgttagatgtacagaccagggtggcatctggtcacacatttttcagtttcacaaatgtgacaatactcctataacaggtatccctgttttatcttatgtgttaatgatgaaccacagtagaatatagtgtgttacaatgagtcagtatttttcatcacaaactcatcacgttattacttcttccaggcactaatggataactatttctaagactgtacaagaggctaattcaaatgatattatatttggaaagactttcctactaatctctctgaagttggaggtttgcatatttggttaagtaaaaatatataagataattttctgtcataatttcaagttagtgtacaataaaaattatcaatttctttttacagagtcatgtaaaaccattgagtacagacgatgctggaaatggaaagtattgagtaatatactaatattctaaccacagatttttcatgtccttatatgtagaaaaataaatgtcagtaatagtcagcagtgtttaattcatagatttatttgtgaagttcaggaaggaaacacaatttatactatatagatattaaatattgttatgaccatcaagtgttagaatagtggctaagtaaattactctttaataaaacacagagcctagaacacagcactatataaatgcctgttaaataggaaccaaataaaataatgaattctgtaggagtgggatttcaaacaaaaaatggcactgtgaatcttaatgggttttatatactaatctcttttctgtaaatacagtttcttggctctccagagtgtggtgtggctccttgtctattctttctataactgagacaagttacaaatctcagtagattaaaacttgggaggaatattgcctgaattcttaaagatgaaagaaccctaagcatttaaattatagtgctttattattcattgtttgcgtagacactggtcatataaaataactcctttgtctattattttattgtcaatatagacatcaacattctgactgaaaggatataaaatatggtaagaaaatatgatacattatgtgaattacagtagagataaaaaatgccattactgacatttactacataaaagttgccctttgaaattatttaattatttcaagtatttcgtgctgtgaaggttattttcacaaatgttcttttgctctgtcttaataaaatgtcaaacattttaataatgtaaaatacatatttaccctatgaatattgtactttatttctagtttgtgatctcacatctctcctcataaaaattgcattatcatattacatttttagcatgttatttccatgcttcaagttctcaagtggctcttattcattttcagaataattatagagcacaaagttatttattgctgtgtaacaaacacatccaaaactcagtggcttaaaacaagaataaacatttgttttctcatagtttctgtgcgtgaggagtttgggagcaggttggctggttctggcttgggatctctcatgaggttgttgtgactatatcagccagagctatagtcatccgaaggcttgactggaaagttaccttctaagatggatggaagatgttctctcaaatggatggcaggttggtgctagctgtttgctggatccctcagttcctcaagtggaatttttcatagggcaacttgattgtcctcgtgccgtaatagttgatttcctccagagacagcaactcgagagagggaccacggtggaaactacgataactttcacaacctacccttggaagttcctcatgtcatttcaaccatattctgttggtcacacagggaaggcataattcagtgtgtgtgggggtgtctagccagaggtgagactcattgagggccatcttgtaggctggctaccacacttgccaaaaaaaatttttttttttttgttaaaagtattgaattgggttaaatggtcacatttattatatgtgcaacccaatttcactgactctttgtaacctccaatttctaattttatttaaaatctcaaacatttatttcttatctctgagtgtatcatatgggcttataaagtcgtctgtcatattctgttctgtgccctctattgatgttgacttgccggaggctggtggaggctagtgctccgccacagctgcgggctttaggactccacctcgtcagtcatccatgccaatggtatggtttcccagggtttccacatttataagcccccaggctgctaaaatgaaggtgaattacgtgaaatccttcctatttaaaaacctgtgcttatttccacccagaagtggaaaaaatgttaccttttctacctatgaattatatatatttatcccctagtacaagatagtgtgcttctatatctggtggggcttagaccaggatccatgggctgagcttgaccctcgtgtaccatcatgtgcttcagatgcaatgttgtgttgcctatttcatttgacatttagtcggaaagtagactattgaaatgattggaattctttgctttcagtttagcaagccagtctgggtcccagctttaagctcaaactagccacttgccatgtatgtgcaacacagaacatattaaacatacatatccccagtgccattagtagctgcataaataatgtttgaggttaatctgtatgctaattaaatatatgtttagaaaaattcagtatatatctaaattttggtcttatatatcttgaagttattcgttgcatacatctgtcaaggaacttttgtactttaatagaataattcaattcaaaattggcagtgaaattcttacctgaaatcagtagaagcaccagggtgctttagtcctaaaacattggctggcatatcctttccattaatggataattgatttgttctcccttatataaagtgaagtgctatgcaactgtagattcaacactcttctcctctcttccaatcagcttactgctcctctttgtaaaatccagtagttacattgcttaaagtcttctgataaacattttcataagctagggaatatagtctgagaaaaaaataaatgtttacatcggaatttcagatttaaattcacattagtcattcttataaatatctacccttttaaatttgattttttaagtgaattataaaatcttagggaagaagagtttatgaaatattggaattaattgttacttgaatgtttgtgaaagaactcctctctcaaaccatttagacatggtgttctctttaccgaaaggtgcttgcactactgaacagaatattttttagtaatagaataactcaggtttcatacttctttaatcattttggcaaataatatctttatcaaggtatttatccattttttatctctgctatctatgtttgtagtttttcatttctaatacttttattaccttatctcttttttcttcatcagtctagtaagagatttgttggttttataaaactttaatgtttttggcttcattgatcctctatattttatttttgcctttgacttaattattttttcgtatcttttaatatcaactttcttttgctttctatgagtttattaccttgtgttatttttcttcttaagttggatatatagcttatagatattcagccttttataatctaaacaattgaagactaagtttcctattttcaactatttttgttgcattccaaaagtttgaaatgtagtctcttgataatgtttcttaatctccattgggatttttgttttattcatgaattattttgaaatgtgtttttaaattctgaagtatgaggtataaaaattatttaacattttgttactaatttctaattgattacatttgtttggaaatgtggtctgtgtgatatctaatctttgagcttcactgaggtttgttttgtcaattttaaagcttccaatgcatgttggaagagaatatgtgttctctaattgttgcatgcagggttcaatatgaagtccattaaatcaagttttaattgtagtatttaaatatactatatctttgttaattttttttgtttttggttttttttttggtttgcatgacttattaaatgagagaggaatgctaacatctcacactgattatagatttttaaattccttcctgtagtttatctgattttgttttacatacagtattttgaatctatcttatttatataatctatctcattgatcaattttaaaatcattctatttacctggagaatttattatttgttattatgtaatgattctctttattcctaacattgttttttaacttaaaatccatgttgtctgaaactaatacatattctagctttctttttgttagttttatctggtatataattttacagcctattacttccaacacttctgcattcttagtcatatctcttgcaaacacacatctttggatttgttttgctctcagttttctatcttctatctaacaattattgtcttttaactggcaagatcaatatattgaatttatattaggacttgattctgccaagtttttttgtgttttctgttagcacagcttttccttctttcttttttccctttttttttgcacagagtgaattttgtttattctttttctctttctatccctccttcactcctctactaggtttagaaattatgtattaaatatctactattttagtggctacccttgatactttactatgtatatttaaaaagctagctattctaaagctgatcaatatcttaatcacctgctaaataataaaagttctctagaacgttttaactgtaatcaacctcttcttacttccatgcgattgctgttcagggttctagttctttttttggttcaactccacaaagtagatgttaatatttttattattttatataaataatgtttgtctagatttgatacattacttactagtttatcaccatttctttttgcctcagatatgtcttctgagatcacctctggaattaggttcattctccttgaagtacttttaaatgaaggtatataggaggtatactctctcagtttttgctttttgtttttttcatttttaaaatcctgtgacaaatgtcttttagtggagtatttagtccatttgtacttacataactatcaaatatttgcatttaaatatatcactttaccatgctagttttatttatttatttattttttattattatactttaagttttagggtacatgtgcacaatgcgcaggttagttacatatgtatacatgtgccatgctggtgcgctgcacccactaactcgtcatctagcattaggtatatctcccaatgctatccctcccccctccccccaccccacaacagtccccagaatgtgatgttccccttcctgtgtccatgtgttctcattgttcaattcccacctatgagtgagaatatgcggtgtttggttttttgttcttgcgatagtttactgagaataatgatttccaatttcatccatgtccctataaaggacatgaactcatcattttttatggctgcatagtattccatggtgtatatgtgccacattttcttaatccagtctatcattgttggacatttgggttggttccaagtctttgctattgtgaatagtgccacaataaacatatgtgtgcatgtgtctttatagcagcatgatttatagtcctttgggtatatacccagtaatgggatggctgggtcaaatggtatttctagttctagatccctgaggaatggccacactgatttccacaatggttgaactagtttacagtcccaccaacagtgtaaaccatgctagttttttatttaccttctgtctttagttctttactcctttttgctttgctttggataaataaaatatttttaatattttattattactactatactaccttattaattacacatacttttattcatttagtgattaccctaaagagtaaaacacacataattgacattaaagcctacctttaattaatattgccaacaatttccaagaaccttatagcacttaactttattgaccccttctgccttgtagcttatttttgtcataaactgaaattccacatctttaacagcattattgaggtataattgacatataacaaacttcatatacttaagtatacagttttgtaagtttttgacatatgtatataactgtaaaaccaccatgacagtcaggataaccatgtctgtgtgagcttttgtaacctgcttctcttatccttccatacattcacacaatcactgtttatttgcattttctagaaatttatataaatggaataatatattatgtgcatatttaacagctattaaatctatccattggttatttctttggtaaaattcataatctttttatatatttctttgaacatgctaattgcagttttctgacttctacgttataatgccaatctttgcaccatcactgagtctgcttatgttatcaattttttcccctgcttttcagtaatttttttatgtcttgtttctttatgtgcctaatttaaaaaattgaatattagagataatatctaaagaattgtagaggttcatgatgatacaatcttccctagagaaaattttattttcttctggtctgtagatactgggttcaggctttctttggtttgatctgtttctgatttgtccttactcctatgatattgcctttcatatatcacatcctaaagcctgaactctgcccataattcttctactttgatgttccctgaattctaatttttgtttactcagcatcatgagactaaaatttatgcttagttttttttgcttatcagcagttctatgcttgatcttacctcacctacatagtttagtaggtgtcagcaaatgatctatgggaaattgtgttagaatttcgggtcatttcctgagtttccttattttttctggtattttgttccctcatgtcctgattgcatttgtggacatgaatttcaatttttatctctggcccagtgacactgcctcaagctctaagccacagttttccatatggtccctatgacactgaaaatcagcaaatctcccaaggggaaaaagatgcaataaatttggctcatctaagtgcattttctttccttagtgatcttggcctttcaagtcttgcctgccttgcttgctttttgatgccttcaaacagtggccttcattatgataaatacacttgctaggtacacagctatagattgatagttatttcctcttagcagtttgaggcactgtcttatgacatccgttgttgctgttgggaagaaatcagtataattattgttcctttcaaataatctgcctttattattgtctgattttaagatcttttttgtcttttaagataaataagccctgcagttactacagcttacttcctggagagttttttggcctcattgcaggaaggaggaaatcaggcagaggccagggtcttcctgaatggaagagatagagctgggtgtgtggggaggccaaaacagctatttcatatgtcagagtaccagagtgaaaaagagagcacagaggaataaccctagaaatctgaagatgcctcttgactcttcactgagtaatgatcaccacagggatgtgagaacccaccccaagctggggaaagtatcactcaaaaggaacacaggaaaaattcttagagctcacacaggactaagaatagtttgtgtccctacaaggcaaaaacacaaaaccttgtcatttatttgccatcaggtagagtagtcagaatggtggaagtggggcaaaattaacctgagggcttctgctgcctaataaagtttaatagaaatattcagtagcatcaaactatttccaagtaatttaaatgcatccaagaacaaaactcaagagtacttataggcatacaaaaatatcctgcacccaataaagtgaaaattcacaatgtctggcatccaatcaaaaattactagacacacaaagatgcagtaaaatatgacccataatccagaagaaaaataagtcaaaagaagagcccgggaatgatactgttgatatagttagtaacaatgatatcaaaaattataactatgttccatatgtttcagagggtagagaaatgcccgtgtgtaaattgagacacaacagatttcaaatattttacatttggtaatttcaatatttaaagttcttgtattgtctaaagttttatttgctatttctatcaactctcactcatggtagcacttctttttgagtttagtgaatttttactttgaactcatattttaataatataatctatctgaattctgaggatttaaataaagcttgtttttctctagagagtattcacatttgccaaatttggaatccaagagatacaatagtttaaggacaactttacattctttgaagggtcctgatttattctgggagacccaggcttggcatctccaccttgcagtgtccttgagcttacacttttattttctcagtgtttttatgggcgtttggtctgaaagtaagtctagattttaagtttgcttactggtactctttaaattttagctgactcttcttgcctctagcccttttgatgtgcatgaaaatctatgtttgttgtgtttcccgtatttaccatcatatttacagtacacagcactggccaggctcatagttagaattaagaatttgccatatgagttactatcattaatacaaaagcctatggtgtttaaaattatattgtttatttctagattttttaaatcttaggagtctagataaaatagagaaaatgactacctcatataataatttatataaaataacttatatttttaataaaaattctttggtagtcagatttactttgctttgatttcattaaataagtttttttttttttttttcagaactggatactttttgtttgaacacctttcaaataccctttttgatggtgatcaccaaagtgattcctgcatcctgttcttttgattctactttaacttgggcttggatagttattggagaattgtctgaaagatctttacgcttggcttaaaagaaataatgattgatagatttgtcctaactcaccttaaagtacatcaaaagagtcctggactctgccttcaaactgttgtgtgactattggtgggttatttgagctacttacacctcagctttctcatttattaatcaaaggagttgaaatacattattcttggatattactaagggattaaaaagcatagcaacttaaaattaacacctgtctatgatactcctaatctgtcatttaaacttgtatcttatgaattattaatatattttagtaaatctataaatggaatgggtagagacaatagcacatttgcaggtacaagacaccagtctgaaagacttagaggacttgtggaaagtcgtgaatgaaaatcaaattcaggataaaagggagagtcagagagatctgaatgcataggtacaaataatagcaatactgtaaatgtggatgacatggcagaatcttggccttggcatccaccccttgtgattgatcaagattgcttaagaccatggaaatcagccttcaggggactattcttgacaatttaacttttccttcttaattgcattaatataatgcctgaagttaaaggaaaacctatttaaaatcgttaagtattcttgttttttaatattggtatcagtataatgatgaagatgtaagaatttaataatggtagtaatattaactttttttttttttttcgagacggagtcttactgtcgcccaggttggagtgcagtggcacgatctcggctcactgcaggctccgccccccagggttcacgccattctcctgcctcagcctcccgagtagctgggactacaggcgccagccacctcgcccggctaatttttttgtatttttagtagagacagggtttcaccgtgtttgccaggatggtctcgatctcctgacctcgtgatctgcccgcctcggccttccaaagtgctgggattacaggcgtgagccactgtgccagcccagtaatactaatttttaacaattgggaactatactttctatctcattgcccatttcaaaatacagaatttcctttttttattgagatggagtctcactctgtcgccaggctgggattcagtgatgtgatctcggctcactgcaacctctgcctccgggttcaagctattcttctgcctcagcctcccgagtagctgggagtacaggcgcgtgccaccacacccagctaatttttgtatttttagtagagacggggtttcactgtgttggccaggatggtctcaaactcttgaccttgtgatccgccggcttcagcctcacaaagtgctgggattgcaggcgtgagccaccactcccggcccagaatttcaatagtgacaatctctaatggttcaggaaatattttgtttacttttacttgaattataaaaatggattcaaagaattttgattattaaatgttgaaataatgtttctaatataattattttaaacctattatagctagttatgtcatattaagttaagtgatatcaaattgctgatgtttggtgggttttgaccttaaaaatgctatttgatataatttcacttagtagtaaaatataggccaaattgattccgtcaaaattagagaacataatatatgtatgcataaattaagtgtgctgataaattttaccttgggctacaaggtaatatgtagtattaatatagcattctttttatttgatggctaacttttccttaaaaggaaaactaatagattctaataaatgaatacctttatttcctcttggagtcatgttttttcatgttgagcaataagcaatttgatttagttaaacttgaggatagtttaatggaaagagccaaatagtaatagtaaaatataatattcagactctctcaaatggaaggtttattactgtgttactgagactaatttatgtcaacatgtgtttatttagtaattttactaaacatttattttaatatgcacacttttgaaattgacattaactttagttaaattgacattaaactttagatctgaacacactattattcatgctgtttctaaccatgcttttattttccttttttttatagaacctcttttgaatttcacattgtaatctttgttagtattatatgagattgtatctcaatattcagtgtttgatattctgtcaaattcagtgaatagccgacatttcttgagtatgctcctattcctaataagagatgataaccatctgctcaatgtttttaaattctctttgtaccctgaaataagatttgatctgaatattaatgtaatggtactcttagagtacaaaagttttatcatcttacatttattatataaagccgtgtttgtctaactagaccatcctaaccgccataatgatactctggtgtagtttgttagataactttgttgatgtcccattcatggaataattctcatattttagttatttttattctgttaccgttttttattttttatttttttgtttgaggcaaggtctcactctgtcacccgggctggaatgcagtggcatgatcatggctcactgcagcctcaacctccttgggctcagtcgattctcccacctcaatctctggagtagctgggactacaggtgctccaccatgcctggctaattttttgtattagagacagagttttgccaggttgcccaggcttctgttaccagtttttagttagtgaatttaaacaaaaatagtcatatcatgtttttataaactataaatttacacaagcttgtgatgaattcttaatatacttattttagtctgaccggaagtgaatttcaattaattttcaactgctgtaatcaaatttcattttatcttttattctcttcttccagccataagaaatagggattacatttcttgtcaagtattctaatatttaaaatgttaaatattaagttggcctttaaagaatgttatcagtttgttacttcgggttcattttatatattagagaagcatacattgagagataaaatataaggaggaatattttttcttttagtgggtaaggataatatatatagcagattttgagctaatctctcactgacaaagcaaatcataaatctcggaattggtctggatcttaaaagtcatgtaatccagccctttaaactatgcttggcaatggccatttctccttgtctgcactgaaaggaacttactacctcctgagagagtccatcccataagctctttctataatcccagatataaaatattaacaaagaagacaacttcccagaggagatcatttctgacctgcattctaggctttataggaagtagagcagttagttgagttatggagaaggaaggaaggttatcccaggcagagggttcagcatgagcatagaaaatgcaactgcttagtgttcatggaaacagagtgaaaggatgggagtggtgagggaggagagggaagtatgggtcaaattaattcatgccttgtataccatgttagggagcttggattttatattacgggagaattgtgattattgaaagtttttttaagtgaaggggtgacttgatttgaccacataggattttagtcagatctattggctctgtggtggatggatttgagatggaaaaggttgaagtaagacaggccagttaagagggcatcgcaataggtcttatcaaaagacagtgagaacctaaattatgagagaagagtttggatgtaaggacataaaatgataggacaattgattgaaatggaaggtgtgtaggagtagatttagggatgggataggtcaagttgcaaatagtggcatattgtatgttggggcagagggtagggattttggctttgtttttgtctactgagtttgatttcctggtaggatatctaagactatagtgggcagctgacttccagtgtgaagctcaggaggaaaaatttctactggagatatgggatgttgaaaccatgggagaggatgagatcatatagtgatatgatgaagacaaggactgaggacagaccatggcacatcattatttatggggtaattggaagaagggatgcccaaaatggtgactgagaaaaatcaggaaaatagaaaaagaatggcatatttggtgttagggaacccaaggaagtagtatcaaaagagacggagaacaactgttaggtcagatgcagccaggatgtcttgccagttaaagaccaatatatttattccggatttgggagtggtggaggtcaatgcatttgccagaacaacttcagtggaatgtttgcatggcaagtaagatctcggtaagtgggtgtgataaagattactctttcttgaagtctagatgagaaaacaaggagaatgggtggaagttcaaggacattgtttttaggatcaacttaagaggcctcagaggtggagaaaaaagaatgaggagagagggagagatcagatatacaaaggagtgaaaggatggctggaccaagtcccccaagagaggagggggtgtggttttaaaaaggcacaggtagggtcttctttgggaggagtgctccatcctttgaggaataagggaaggaagttaggatagtcatgaaggtagataagtagatgaatgtgagcaggtaggaagttgagggaaaataatgtttgatgacaaggatgtcttcttgaggttgagaccaaagtcatattctaagagtgaaaagggcttagtgggagctttgagatgaaatttgaaatagatattaaggagaacaggaaagagaattgacaaggatagggaaaggcattgatgcattaatgtgcagtgctgtgatagcaactaaactctggatcatgattgtgtagtggcttctcaactgtgttgtgcaacttttttccacagtagtcaaaattggagaaaacgaactgtagctgtacatcagagttgggtgtttgctggggatgtgtaagacaaatatagggtatacagaaatgtatgtggtgttgatgaaaaggctgataaggaagcaggagcttctcgccaaataggagggaacagaatttaggaggtggcttatagatggggagaaagttggggaggagagcagcttaaagaactgaacggctcagagggcaactataataggacctagatgtagaaagataggattccatacagtggaatattatttgttcatttatttgtatagcctttttttttaaaatccactggacaaataacttaagacatactgtgtgccaggtactatgccatgaggacatagtggtaaagaagatcaatctggtctctactgtgctacagtttatagacaggtgtagcacacatatagtagacaaaaagtatacatatctttgggtctcagtgttatagaccacaggcttttaggctcccgtgtaatagaaatttacataaggccaagtagattagccagacaaggctttattttgcggcttgtgctcaagctcaagggagacagtggaggtaaaagaattctctgtctggctccctgaaaagagcccgtagggattttttattaggcaatgtgcaggaactgacatcagggggagggtgtgcaggctgggctgggtagagcatgtgagggctggggtatgcaggacagcatatctagttgtgatggtttgaggtaatgggccacctagtggtctggctgggggcaacaaggctatattatatattattatatattatatattatattatatatttattatatttaatatatatattagctaatcctaaggcttagttaaattgctcttcataactctggctagggtaattgcttcaggacccaaatgagcccgaatagaatgaatctcataattttctctagaagtgctagggcaaaagcgttatcttttcatccatggacaacaatgaagaagcagccctcaggttgttatggtcatcttgggacaacaaagggtgtgtgcatgtgtcttgggggagaaagtagtgggagcctgctaggataagacgccacactgaggaaatggagctgggaaatagagattaatcaagtcttgataatattatctgagtgctggatcaggctttgcttgaagtcattctatgcctttagttaaactagttctacaaaaattttgtttagagaacagacatgagaaaaaaagatggaaaatgtgagaagggccgggcatggtggctcatgcctgtaatcccagcactttggaaggccaaggtggatggatagctgaggtcaggagttccagaccagcctggccagcatggtgaaaccccatttctactaaaaaatacaaaaattagccaggcacggtggcgtgtgcctgtaatcccagctactcgggaggctgaggcgggagaatcacttgagcccaggcggtggaggttgcagtgagccgagattgctccattgcactccagtcagggtgacagagtgagactccgtctcaaaataaaaaaaaaaataaaaaataaaaaaagaaaagaaaatgtgagaaggaagccaataaagaatccttataatttaatctagtttaaatttagtttttgttttcgcttttgttatttgcaacaggaatattactggtatgtggaatgcctgctatgctgattttttgactattatatcttttgactccaacaaaccaaatatactcctttaagtagctgcagattctatttgtttcttgtatatatgggtgggccaaatcatatataggttggccaaatcatatataggttttagagcagaagacttaatggacagtagtgttaatttcagtttggagtcctcttgaggaatgaatcccttcatttgtccttttatatttcctagtcagggtcttatgtgtaatgccatactttttcctctaaattaaatcttactctgagtttttgcttaccaaggtaagcagagagtacaatattaataatatttcacatcaccttttctatcactaaggttttataggagttccagggctacagttactgaaaagactcctttagcttgtttttacttctgcatcccttctcctactgccacttcagtaatggtcttctaccactttggcacaatgactcagactaaggtgcctgggatctactcaggtcattgtgcacctaatagaggtgggtggctgccctaactggcaccattcccctgggactagcttagtttgataactcagacttccaaagccatgtgtattagtctgttctcattctgctaataaagatatacctaagactgggtaatttataaaggaaagagatttaatcgactcttaattccacatggctgggaaggcctcacaatcatggcagaaggcaaaggaggagcaaaatcacatcttgcatggcagcaggcaagagagagcttgtgtagaggaactcccattaataaaaccgtcagctctcatgagacttattcactaccacaagaacagcacaggaaagattcgcctccatgattcagttacctctcaccaggaccctcctacaacacttgggaattattacaattcaaggtgagatttgggtatcaacatgacccttgataccttggccttgaccaacattcatgtagtcatccccaaatgaggctctgccaccttggagacctaaatgcttgtattctttatgaacccagaagccctcggtctatctgatccctgctttaacaaccttccagaggtagggctccccacatctcctacctagaaacacaaacacttctccttctcctctgagactctttagtgtatttctttgcacaggctccatgtgaaaatcactcctaaagaaaagggacctagaactctcaatttaaaaagtctagcagtgaggtagaaaggaaattcttctttccattcttttggtgaagagaacacagcagcaaaaaggccaagaaaccaagtagtttctccataattctccctgtcacagttgtctacctctattttccacaacatatgtttgctcattttatatacactttttttttttgagatggagttttgctcttgttgtgcaagctggagtgcaatggtgtgatcttggctcactgcaacctccaactcccgggttcaagtgattctcctgcctcagcctcccaagtagctaggattacaggcgtgcaccaccacgcctggctaatatttttgtatttttagtagaaaccgggtttcaccatgttagccaggctggtctcgaactcctgacctcaggtgatccgcctgcctcggcctcccaaagtgctgggattacaggcatgagccactgcacctggcccataatatatacttttaaatatgcttttatatcattaatcttgttagaattttatgacatcttagtgatcctaaacctactgtatttccagaaaaaattctgaagttctaggccatttcacctgactttagccaacattcataatcatcaatccctgtgccctcccaccctctccttcacatatacaggtttgtgtcccactttaatgcttttgattgttctaagctgtattttctaatttctttgactgtattgaaggtaacagtctatatactccaagatggatcttattaataacataaatacacactcagatttacaaatattcatatatctgtgattaaaatagtcatgtttttggccatgtcagaaatgtatccctcttagtgatgttttcacttctgttggcctgtaaggattgttgtcacttggttgtctcctgaaactcctctaaaagaaagtcataaaattctgaattctgggacctatagacctgtaggaaaagtggcacataatttattttccaaaccagcatacctaagaaaggaaggggttactattaataattatgccaggacaacaattataaaccactactgtcccagggaaaccacatatatagtcaccctaaagggcagagacagtgtatttccatctgacatcctcaggcagttccaaggttcttggtctgattacattgcatgggagaagtccttcatgagaacagtaagctgagggcagtctatgtgtatatgtttctaacattcgagggttacttacagagttaacctttaagtagcttatgggaaatttttatagtacaatttgactgaacacttgggtcatactagttctggacttaatattttgcagcacttttattgttctcttcaaatgaatttcaagtcatgttaacctgccattttgttctaatgacactaatggctgaaattagtggcagacgatgagcttggcagtgacagcataaatggtactgccacatctctctttttgctaactttgtattatttccacctgtgtacagttagtccacaatgttttatttgcaaagcactgttaaatcaccagcattattatttgactcttaacatacatttgctagtgaatgtgtttgacatatgcttatgttaagaaagaaatttacatttaaatcttaaaggaactctaattgccggtctttgaagtgcttcattatcaactgctgaattaaataaataggtcttggtctaaagctgaaaggacttgcagcaaaggggcccctgaacaaagagagcccatgagtccaaagtaaggtcacaattccattaaatactcagatgataattgacttcaagcactgtcctgcattgcttacagttgaatctccagcacctagaactgtgtctggcatgtaataggcacacattaaatatttgttcaatgaatgaataaatattctttatagtgtaaaatatttgtagcatgtggttttactctcaagcattctgtggttaatatatttttttaatattcttgtcagtatgttgtgtggaggcttgaaaatccctggtttttcataattattgattaaattaatcagcagtttctatgatcttataatttgtgggggctagtatcatttgttttagtagaacgttttccactttcttcttttagttatacagtcacattctccctgactttcagttttaacctttgcttctcttggataggccaagaatccatggcatgatgtaaccaaatctcctccccgctcttttttttttactcttcatctcaagttttagctaggataatgtttctgttagcctagtttccaaatgaaatctaaagtactgttttcataaaggtgagatataaggaaaagttcaatagttaaatcttaaaagattatttcttcctatgctcagtgagatatatgagagatactgtttgtcgctagagagataatttccagatagaaatacatacatatatttcataactgacatatcattaaaaaagggaatattttctaacgtaagaaattttaggatgggcgtggtggctcaggcctgtaatcccagcactttgggaggccgaggagggcagatcacgaggtcaggagatcgagaccatcttggccaacacggtgaaaccccgcctctactaaaaatacaaaaaattagccaggcatggtggcgcatgcctgtaatcccagttacctgggaggctgaggcaggggaatcacttgaacccgagaggcggaagttgtggtgagctgagatcacgccactgcactccagcccagcaacagagcaagactctgtctcaaaaaaaaaaaaaaaaaaaaaaaaaatttattgtaagattcaggtctactctactctattttaattgtagttcctatatgcacatcatctccattattattcttaggaaaggaggtaagtataatagacacggtttatcttgggagaagccagggtgacctatgctcacttctttcttactcccaaggttttttaccttcctcatctttcagggtactggtgccatcatttctctttaccataaatcaaaacatttctctgatcgaattctgatattagtaatttttactttagtgttcatcttaatatatgtttcttccttaaagtgtttgcatcttaacattctctctaactttagcatttgtcttcataaatggaattttatcatcagggtgaaaattatgttttgccaggagccacaccaagcttcattaacacatacattgtcacctctcatatgcacttgtgtttgtacttgtacaggggcatgtttgttaagagtgaggctaagctgcatgttttataacagagacttaattttttctttcaagttttcatgtaccttaaacaattagaccttgtaagtaaggttggccttggttttatcatctggccagtattgggaatggatctatagaagcaaagggaaacgatataggattcatgcaacttctttactgttcgctatgaaccaaaaacatatttgtaaaataaaaaatagcaggtaagtagggctgtaattcatcttgttttcatgctagcatgatgaactatctctgaacactagattcttggattagtagtatttactctaggatgaaatgtgatatgaggatcgtcttcgactttatttatgatcacttatttacaaaacagcaaaaagaacattatattgtggcttcactcataaggcagtcttatggcaaagacttcagaatatagtgagacattaaaagattcattaaaataaagcaaagatccatgaattttgagttacagtgtacattaatttttaataatatttgtatttcaggtcagttgctccgattaaaaatgtttcgagaagatcatgggtcgtggatgacaatgttcttcagcacaattctctttctcttcatattttctcacatatacaacacgattcttctaatggatgggaacatggggtaggttttctttcccctttctactgtggtgagtgttatgtttgaaacttgtaagaatttaagagttttttagcttgtagtagtctaagtctgctttacaaatattctaccctaagaagaaggagtattttatgtatttttcttacctaagacattaacattttttttttccaggaagcatatagtacattacaatatttagattttgttctttatcctttaggacttttatatagggtggtgggagggcaggtactaatttcattatactgacaagggggtatgagaatcaggaaatcttattgatttgcatatattcaaatgattcatagagtggggctaagatgaaggtttccaggtttgcaatttcattggtctgcaatgcctggctaaataaaagtggtacaggaggcattttctttaactctcttgacagtcctgagagagagagacctttgttataaataggttgttttaaaagtgggccacagctgggcatggtggctcatgcttgtaatcccagcactttgggaggctgaggcagcggatcacaaggtcaggagatggagaccatcctagccaacatggtgaaactccatctttactaaaaatataaaaattaggtaggcgtggtggtgtaggcctgtggtcccagctacttgggaggctgaggcaggagaattgcttgaacccaggaagcggaggttgcagtgagccaagatcgtgccactgcactctagcctggcaacaaagcaagactccgtctctaaataaataaataaataaataaataaataaagtgggccaccctgtattaactcctagcttgtgatatatacttatcaaatcactaagacatgaaatatgtgccaacaagtagttgtataatttttctaactttcttcacttctttctttcattatataatgaaacacaaggattggtctttcagtataatttcctcttggtttgttctcagtaagtttatttgagaaggaatctcgctgttgtcagccagggctggagtgcagtgacgcgatctcggctcactcactgcaacctctgcctcccgggttccagcaattctccttcctcagcctccctagtagctgagattataggcgcctgccaccacacctggctaatttttgttattttttagtagaggtgggatttcaccatgttggttcgtctggtctcgaattcctgacctcaggtgatccacccgctttggcctcccaaagtgctgggattacaggcttgagccactgcatctggcctgctctcagtaagttttaaggccggaatgtaaggagattggcttagtattaaaattagatttgtgacaataataaaccactttaggtatttgttgtgtgttgaaatagttactgagaaagattttgatctattttccccaatagatcagaaagttaggtaatatccttttcttctaaatgtaggctaggcaggattattgtccagttccatgggaaacatggaactgttttgatgttacgtatagattttggctaccattgttcagtactgagagggaagctcatttagaatttcattgtttttccctcaccactaaaggagatgaatagcaaagggaaaaatacatttcacatgttttatattttagtttatactaacaagtgataaattcacgaatgtgattttagataaaatgttcaggctttagaaagttattaaaatactttgtaattatttcttggacttagaatgatagttttaataccaggtctgttttgaaggctgtaacctatggctagtcagaatatgtctcagccttggagcagtgcctgtaatactagaatgggtaatgattggagttagctaacacagccaaaggtttctctgtgagttgtttttgaactcaaagcactgagagcagaaggagaaggaacctctgtgaaaactacattttaaaagcaattgctggaaataatacatgatataatatataaaatatatcttctgctcagaagctgacttttgatataattctgttttttttttttttttgtttgtttttttatctagagctaatgaggtctgtgctaactggaaatgcttattctgaggaagggagcagatttgaaagcaataaattaaatgcaataagtaattccttgtactctgtaaagcactcaatagctggaaataaaatgagagttaatagttgttgaacatttacaccaggcatgaattatctcaattaaatctcgcagtgactccatggaataggagttattacctccattttgcagatcaagaaactgaggactagagacattttgccactttgttgtttaaaggagaacacaggtccgattgatggttgaccctgttactcattcaccatatcctattagcctttctctgtgttttattattcaagctgaatttgacaatgaaagaagcaggagatatgcttaggaaataagagaatagttagcctagaatttatgtgtagcctaactaaaattgaaagtggtcttttttattctcagactaaatacaatcttgcagatttttaggtaactgttgaactcttcaccattatgcctcatcttcataggaaaagcatcgtttactgagaggatatattaaaggtgccacattttagaaaaattcaaagcaagggacaaatggtttagttctgcagaaaaaataaatcaaggctgagcatggtgacttatgcctataatcccagtgctttgggaggctgaggcagcaggatcacttaaggccagaagtttgagaccagtctgggcaacagagtgagactttgtctcttacaaaaaataaaaaaacttagctgggggtgatggcacgccttgtagtcctagctacttggaaagctgaggcaggaggattgcttgagcttgggagttcaaggttacagtgagttatgattgtgttactgcactccagcctgggtgaaacaacaagactctgcctctaaaaagaaaaataaaaaataaaaattaaatcaccatttataaaagatgtataattaacttttatgacacatcatttgatcaagtgagcacattgaaataggagtgtaaacttggaggaaaatcagttcttagagcaagtggatacaactgtgctattggggttgtcctagaagacaccatgttttctgaggtattgcttcatcccatgtagcacagggaatgatggagccagagagtgcagaaaggacagtgagcacacagacatcacaagtaactggttttatgtcagaagattcttggtagtagagaggaattcaggattctttacactgaatctcatttgcattacactgaatttgtggggagtccaatgtgtctttgtttataggtctctctaggaatacgggcctagaattatttccaaaacagtttcaagaatatcctatgatggctagatctgtgttaatgtattttaggattcctttccaaactggaggagttcaggactagaatgaatggtgagtggctgtagggtttccaaggggaagaaggagttttcttagactggtctgcattttgtgtgcatgtatgccaattttaggaatggtataaatttaatctaaactggggtctcatgatctcttactatagagaaaagaatccctaggtttatctagaccggaacctcaagagtttttagcccagagttgcctggctcctgttcttctcattacagtggattccctgaagtatgcactaactcttatggctttagacatctctggggagccaagctgaaaggcagtcagatggagagggaaagaggtaagttagttggttgagctaaaaaggatcaaggctcagacaatccatatttgtagcaccacgaggaaaaaccttgtctcaaatttgactctctttctgcacctctgttccttataccactaaaatgctgcttattgtaacctcctttattctttttttttttgagactgagtctcactctgtcgcccaggctggagtgcagtggcatgatctcggctcactgcaagctctgcctcctgggttcatgccattctcctgcctcagcctcctaagtagctgggactacaggtgcctgccaccacacccggctaattttttgtatttttaatagagacggggtttcaccgtattagccaggatggtctcgatctcctgacctcgtgatccgcctgcctcagccttccaaagagaacctcctttattctttaagtcaccaagatgtaactaaactcatcattttataaatgttgagggttctgctgaggagaaggtgctgattctgggcatagttttgcatgtagccattttatgagtaacttctttttttttacaaggtggcagactaggtaacctgaagccttgcctactacaaaatctttagaacagctggaggagataatgcagcttggtatactcctttaaaatgcatagctgagtttacccaaaggtcaggaaaaatcccagaggacaaaaatgcagaaggatctgaaaactcgggcggtaagactaacaactgattgatactgagatgctcagtggaggtgacttaggcacttgaattttaacccttatgtagggaccagaaacaaggatttggctcatattaattgaaaaattgaaaatagaaatttccacacagatgatcccgcaatgggctacagtgggagggggaggtgaaatggaaaacatgtaactgttagcagcactgaatccatcggatctgcagcaaactggatttttgccttgttagaggaaagaattcagctaagggacataaggcagagtgagagactgagacaagtttcagagcaagagtgagagtttattaaaaattctagagcaagaatgaaaggaagtacagtacacttggaagagggccaagcggacaacttgagagatccaagtgccccatctaacctttgacttgggtttttatacattggaatggttctgaggtttgcatttcttctccgctgattcttcccttggagtggactgtttgcatgctcagtagcctgccagcacttgggaggtgctgcatgtgcagtgtgtttactgaagttgtgtgcatactcattcaaggcatttttcccttagcagtcaagtgttcccagaggaaggtcatatactagttaaactccgccattttgtcagttactgcacatgcttgagcccactagcccaacttctgagatcttgtcgggaagctgctgatcaccaagagtttgctatctgttgggagactgcctttccctggcactggctgcgaccaattattattttggagagactgtttaatgactgcctatctcctgatggtagcctgacattcctgaggagggccctctcctgccctgctcatgtctgcctagctacctactccaacaaaaccacttagcacaggcaagcatcaaggaagcttgtacttaaactgggctctgggggaaaaatatctcccggggaactgctaccataggtgcagttttgtgattttaatatacagtttcctttggattttagaacctcaaaacatccccagctattctcttctcccagtttcaggttcttacttttctctggacacccctccccaaataacttgaattcctgttttattatgtagagcaatttagtttccttttgcctcaacttctatccactttgatttatcaagggcttttcttttagtgaaaaaaatcatattgatgcattttccaatcaaaggaaccaatactctgatttgctgctttctcagaatatgaaagtgttgacctaaaaggaagaaactgaggcaaaattaatataagtagagtttgtttaggccaatcttgaggactgcaacccaggatcatagattcaaatggccctgaatatatgcttcaattaacagcagttataagtgttttgttaaaggaaaagaagaggcagattttgagctgttcaccaagaatttacattaaaataacacaagctgttgattggctatacagctggtcaggaacaaaatgactttaaacaattgcccccaggcatgggtgatgggtgtggtggaggctgggggtggggtcttgtggggttgggggcaatgactgaagtttcatactcatgtctttctgggcctgagtacctcacatagctcagactgctctgaactattttttttttctcaaaaaaaaaaagtgtacttttgttaaacagtctctccaaaataataattggtcgcagccaatgccagggaaaggcagtctcccattagatagcaaattcctggtgatcagcagcttcccgataagctctcagaagttgggctagtgggctcaagcatgtgcactaacagacaaaattttttttctcaaaagaaatattttcctcagtattttggctttgttttagaagtaacaattgtccttatttttgtaaattctactatcagtttaatgatctcttgtggaacaaagggaagatggtgggaggggccaagatggccgaatagaaacagctcgggtctgcagctcccagggagaccaacacagaaggcagatggtttctgcatttccagctgaggtacccagttcatcctactgggactggctaggcagtgggtgcgccccatggagagtgagcagaagcagggtggggcattgcttcacccaggaagtgcatggagcccagaggagtggggggacctccctcccccagccaagggaagtggcgggggactgtgctacccaccagggttactatgcttttcccatggatttttgcaatccatgaatcaagagattaccttgtgagcctacaccaccagggccctgggtctcaagcacaaaactgggtggctgttcaggcaggcactgagctgcaggagttttttacatactccagtgacacttggaactccagtgagacgcaagcgtccactcctttggaaaaggggcttaagccagggagccaagtggtcttgctcagtggctcccactcctatagagcccagtaagctaagaaccactggcttgaaatccccattaccagcacagcagtctcgaatctgcctgggatgatcaagttgccagggggaggggaagcgccattactgtggcttcagtaggtggtttgggaggtttggactgggcagaattccccgcagtgcagcaaaacagctgtgaccagactgcttctctagatccttcctcagcaggcagggcctccctgtagaaagtccaccagctccagttaggggcttacagactgaactctcatctccctgggacagagcacctgtggggaggggtggccgtggtctcaggttcagcgggcttaatctttcttgcctgccagctctgaagagattgatgagggctctgatcctgatgagggcgattccctgagcacagcacaccagctctgctaagggacagactgcctcctcaagagggtccctgaccccatgcctcctatctgggtgagacctccaaacaggagtcagcagacacctgatgcaggagagctctggctgacatcaggttggtacccctctgggaagaacctttcagaggaaggagcaggccgcaatctttgctgttctgcagcctccactggtgataacccaggcgaacagagtctggagtggacccccagcaaactgcagcagacctgcagaagaggggcctgactgttagaagacaaacaaacagaaagcaacaataacaacagcaacaacaacaaaaaagaccccacaaaaaccccatccaaaggtcatcagcctcaaagatcaaaggtagataaatccacaaaaatgaggaaaaaccaatgcaaaaatgctgaaaatcccggaagccggaatgcctcttttcctccaaatgatcacaatatctctccagcaacagcacagaacagggctgaagctgagatggatgaactgacagaagtaggctttagagagtgggttataactgatttcactgagccaaaggattatgttctaacccaattcaaagaagctaagacccatgataaaacattacaggagctgttaactagaataaacagtctgtagaggaacataaatgacctgatgggtctgaaaaacacagcaagagaactttgtgatgcagacacaagtatcaatagctgaactgaccaagcagaagagagaatatcagagcttgaagactgtcttgctgaaataaggcaggcagacaagattagagaataaagaatgtgaaaaggaatgaacaaaacctccaagaattatgggactatgtaaaaagatggaacttacaactgattgaagtacctgaaagagatggggaaaatggaactaagtggaaaaacacacttcaggatatcatccaggagaacttcaccagcctagtaagacagaccagtattcaaattcaggaaatccagagaacctcaataagatactccatgaaaagatctactccaagacacgtaatcaccagattctccagagttgaaatgaagaaaaaaatgctaagggcagcaagagaaaaaagccaggtcaccaacaaagggaagcccatcagactaacagcagacccctaagcagaaaccctgcaagccagaagagactgggggccaatattcaacattcttaaagaaaagaaattccaacccagaatttcatatccagccaaactgagcttcaaaagcaaaggagaaataaaatctttttcagacaaacaaatgctgagggattttgtcatcaccaggcctgtcttgcatatttagtgcttccttcaggaagcactaaatacggataggaaaaaccattaccagctactacaaaaacacactgaagtacacagaccaatgacactatgaaacaactacattagtaagtctgcaaaattaaccagccaccatcatgatgacaggatcaaattcatacgtaataatattaacctgaaatgtaaataggctaaatgccccattaaaagacacagaatggcaagctggatacaaagacaagacccaccggtgtgctgtcttcaagagacatatctcatgtgcgaagacacacatagactcaaaataaggggatggaggaaaatttaccaagcaaatggaaagcagaaaatagcaggagttgcaatcctagcttctgacaaaatagactttaaagcaacaaaggtcaaaaaagacaaaaaagggcattacataatgttaaaaggttcaattcaacaagaagagctaactatcctaaatatatatgcacccaatacaggagcacccagattaataaaacaagttcttagagacctacaaagagacttagacccccacacacaataatagtagaagactttaataccccactgtcagtattagacagatcattgagacagaaaattaaaaaatatattcaggacttgaactcagctctagaccaggtggacctgatagatatctacagaactctcccccccaaaacaacagaatatacatttttgttttagcaccacatggcacttactctaaaattgatcaaataactggaagtaaaacactcctcagcaaatgcaaaagaactgaaatcataacaaaagtctctcagaccacagtgaaatcaaattggaactcaagatttaaaagcctactcaaaaccacacaactacatggaaattgaacaacctgttcctgaatgacttctgggtaaataatgaaattaaggcagaaatcaagaagttgtttgaaaccaaaaagagcaaagaaacaatgtatcagaatttctgggatgcagctaaagcagtattaagagaaatgtatagcactaaatgcccacatgaaaaagctagaaagatctcaaattgacaccctaacatcacaactaaaagaactagagaaccaagaggaaacaaatctcatagttagcagaagacaggaaataaacaagctcagagtggaactgaaggagatagagatatgaaaaacccttcaaaaaatcaatgaatccaggagctggttttttgaaaaaaaatcaataaagtagattgctagtgagactaataaagaagaagagaagactcaaataaacacaatcagaaatgataaggcggataccaccactgaccccacagaaatacagacaaccctcagagaatactataagcaactctatgcacataaactggaaaatctagaagaaatggataaattcctggacccataaaccctcctaagactgaacccagaagaagttgaatccctgaatagagcaataataagttctgaaattgagggagtaataaatagcctaccaaccaaaaaaagcccaggtccagaattctaccagaggtacaaagaggagctggtaccatttcttctgaaactattccaaacaattgaaaaggagggaatcctccataactcactttatgaggccagcatcatcctgatacaaaaacctggcagagatacaacaaaaaaagaaaacttcaggccaatatccctgatgaacattcatgcaaaaattcacaataaaatattggcagcagactgaatccagcagcacatcaaaaagcttatccaccacgatcaagttggcttcgtccccaggatgcaaggctggttcaacatacgtaaatcaataatgcaattcaccacataagcagaactaaagacaaaaaccacataattatctcaatagacacagaaaaggcttttgataaaattcaacaccgcttcatgttaaaaactcaataaactaggtgttgaaggaacatgcctcaaaataataggagccatttatgacaaaaaacagtcaataacatatcaataacataccgaatgggcaaaaactggaggcattgcacttgaaaactggcacaaaacaaggatgccctgtctcactactcctattcaacatggtgttggaagttctggccagggcaatcaagcaagagaaagaaagaaagggtattcaggtaagaagagcggaagtcaatttgtctttgtttgcagatgacattatcctatatgtagaaaccctatcatctcagctcaaaagcttcttaagctgataaacaactttagtgaagtatcaggatacaaagttaatttgcagaaatcacaagcattcccatacatctactgcagacaagcagaaacccaaatcatgaatgaactcgcattcacaattgccacaaatgaataaaatatcttggaatacagctaacaagggaagtgaaggacctctttaaggaaaactacagaccggtcaaggaaatcagaaaggacacaggcagatggaaaaacattccacggtcatggataggaagaatcaatgtcatgaaaatggccatactgcccaaagcaatttatagatttaatgctattcccattaaactaccgttgacattcttcacagaattagaaaaatctattttaaaattcatatggaaccaaaaaagagctcgcatagctaaagtgacagttgtaagcaagaagaacaaagctggaggtatcatgctatgatgcctttaaacttactacaacaccacagtaatcaaaacagcatggtactggtacgaaaataggcacgtagaccattggaacagaatagagaactcagaaataaactcgcacatctacaaccatctgatcttcaacaaacatgacaaaaacaagcaatggggaaaggatttcctatttaataaatggtgctgggagaacttggtagctatatgcagaaaattgaaactggatctcttccttacaccttatacaaaaattatctcaagatggattaaagccttaaatgtaaaacccaaaactataaaaaccctagaagacaatctaggcaataccattcaggacataggcatgggcaaagactttatgatgaaattgccgaaagcaattgcaacaaaagcaaaaattgacaaatggcgtctaattaaactaaagagcttctgcacagtgaatgaaactatcatcagagtgaacagacaacttatggaatgggagaaaatctttgcaatctatccatctgactaaggtctaatatccagaatctataaggaacttaagcaaatttacaaggtaaaaacacaaccctgttaaaaagtgggcaaaggatataaacagacacttctcaaaaaaaaaaaaaaaaaaaaagacgtacatgcaaccaacaaacacatgaaaaagagctcaatgttactgatcattagagaaacgcaaatcaaaaccacaatgagataccatctcatgccagtcagaatggcagttattaaaaagtcaggaaacaacagatgctggtgaggttgtagagaaatagaaacacttttacactgttggtaatgtaaattagttcaaccattgtggaagacagtgtggtgattcctcaaagatttagaaccagaaataccattcgacccagcaatcccattactgggtatatacccaaaggatttataaatcattctattataaaggcacatgcacacctatgttcattgcagcactatttaccatagcaaagacatggaatcaacccaaatacccatcagtgatagaatggataaagaaaatgtggtacatacacaccatggaatagtatgcagacataaaaaagaacgagatcatgtcctttgtagggacatggatgaagatggaagccatcatcctcagcaaactaatgcaggaacagaaaaccaaacattgcatattctcacttataagtgggagttgaacaatgagaacacatggacacagggaggggaacaacagacactggggcctgttggggaagagtgggagtgggagagcattagagaaaagagctgatgcacgctgggcttaatacctagctgatgggttgataggtgcagcaaaccaccatggcatacatttacctatgaaacaaacctactcatcctgcacatgtaccccagaacttaaaaaaagaaaaagctataaaaaaggcaagatattcaaagaaaaaggagctaggcaaccaactatattaaaatgagaattctatagtaatcacagttgaacttttgcagtgactatacaatatgctgcattatttatatataggaatgaaggcttgagaaaatgagacatcaatagaaaactattttcttccatagtaatgggatttgacttgattaaaaattattccaaatacattttctaatttcctctcttttcaactatgtaccctgaaccagtctatttagaaattatttatttggtattaataaagagaggcatgctcccaagttcaggtcaaaatctttactgactagaaactgaaaaggtcacccagggctgggaaggatttttcagttttgggtacttcaaacactttttgaagttgtctttctgaataatttcttagtaatgtaatttttatagcatccatagtataaagccctaatttaggaaaggcttgcttggtcttttcaaatattcctgttccccaaaggatgataatgtataatgtacaaggaaggaagtggtgggggaagcagtgctagcacaccatgacgttgatcagaatattctgaaaagagccacttgatggcagcaaaaggcatgttttcagcactgattgtctcattaatgaatcacaggaaaagaagggtatcttcccccttctgaatttctgaaacttggtgttgaaatattctcctgctgtgttgttaatgggctttttgaggaaatacatagtgaactctttaataagcacttgttattttgtgatgtgcttggccccttttactttatgttccaaaacaggtttaagtaacagtatgcatagatacttatatgcttgcatatgcatctatatgtttatagacttattttcatattataatgataaatactgtgtctagcactgagggaattagacatttgactcactggtaaaaatccttctgtgaactggaatgtttccaaagagcgcatactatttggggcagaatatgaagaagctgatttttttagtgttaatcaaaaggaaaagttccatttttcttgatacaaagccttttccagagaatcaattaccaatattaatacatcactatgtgttaagtatttcagagagagaaattgagaaataagacaaagtgatacaggcaattttgaaaataaatgttactatttatttgaaaataaatgttacgtattcaggacctgaacaacgtgaaggtgaaagttaggtggtgactgtaatgagaatggaatagactctgtctctctgttctgtttcctttttgataagctttagtaagaagtcacgtggagaactcatctggctgggtgtggtgagtaccctcagtaagtgtgatctgaccaggacgactgcaccaaaggaggtggcaggagagaatatctgaaatggagactttcctaaagtgtaaaatgcatggtttctttttttgttagtttgtttgtttgtttttgagacagagtctcactctgtcgccctggctggagtgcagtggcgggatctcggctcactgcaagctccgcctcccgggttcacgccattctcctgcctcagcctcccgagtagctgggactgcaggcgcccaccaccacgcccggctaatttttttgtatttttaatagagacggggtttcaccatgttcgccaggatggtcttgatctcctgacctcgtgatccgcccgccttggcctcccaaagtgctggcattacaggcgtgagccaccgcgcccggccaaaatgcatggtttctatgtgctgagggggcagcaaaagcaagcaaggataaataggaaaaataaatgagggagagactggcatagacttcgaaggctgaaagaaattgttcaagatccaattaaagtccatgcaccaagctgacttaggccttagcctctggagctcttacatttatcccgatttttgaaagaatcactaatacagtggttcataagtatgaaaagactctctggtttgtagcttcagtttctgtcgtcacagttgtaggcttcagcacataatttttctcaaggctgatttatcatttagtggaaaaaaatcagggtgaacttttactttaagcagtagtttatttttaattaaatttttgttaagttcaccattttcaacaccttcagtaatgctttctgatcccttacacaaacttttttccttttctagtcaatattgattgagtagtagaagcccaggtgcacatttttactgataagaacagtgattttcacttcttattgctcttcaagtaataaggtggtcagcctgcttccattgtttacaccggtagcttccttccaaggaaggagtgtttgtgtgtttgcttctttgttttatttattttgggaggtgatatttgtttgttttgggaggtggtatttgtttaatttattttgggaggtggtaagaaaaaaattaaatttaataaaatataagtgacctaaactgatgaaactattgaagtacaaagctaccaactgtagcaaattaaaaaaagagatacaatatgatttccaaaggtatgtagctaaacacagcatttaggggtgggtaaagaatggacgactgggaaagggttcaggagctagtgtgggaagagagccgagttgtatgttttaatgaagcccagaactccttgattcaatagctgaaaagcttgattggctgctcatacaaggctggatgcaaattctgctggagtggtgctttagataatttgttgggttcactcttaattaggctaaacattgacttgcttgtacgattaattcacaataatagcacaattaattactaaggctgggagtaaggggcagagccagttgccgagaaagggctggtggcaagaaaggctggaaatgaatggctgattctggtcaagggggttgacccagggaggccctggagaggggggttgagtaaggggagagggagaaggagagggaagggggtaagagggaggaagaagaaagagaatgagactagacttatttagctagaggaaacagcagtagggcacagtttgctgctgttaatactattggttttgcattacttggttttaatagtacaaaggtaaaatagcacagcatatccaaattatcacgagtttagttagtgttgtttgaattggtgaagttttaaaacattagtgaaaaacatagtcaatgttggatccttgttactctgtgggagtgctttattacctattcagaatgaacactgatttgacacacttaagaggtgttctgtgatcgttattcatggttgtttactccagctctcttattaaatattttatcagcttgttagagggggaaaattctgatttggcaaataaaatacttgaatgttagccccatcttaactacatagagcaaaaataatgcggaaacgttagacagttttctcattttctagaaatgagttgttatatcatttataattaatgatattaatagtgatattaatattactattcctgacatcatcatcatcattaatctgggggaaatgcatgcttccaaggtgaagaggcaaactaaatttttaaggttgcaaaaaatcttggttgtctttggctttattttatgtgggaggcagtgtgatataatagaaacagcatggacttttgtcccagcattctttagccatgtgactctgagtaaactatactttctgagcctcagtttcctcaagtgtaaaatgaggatgttagtacccatttcagggttgttgtgacaatcaaggaagataataaatgcaaaacaattggtatgatgcccaccatataatgaactcttgataaatattagtagctattataaaaacagaaaacatatattttagttgaagtactttagctctcaataaatattaattgctgtaattaaaaacaataaataatttggccaatataatgaaatgacctaatttatggcaataatattattacgttatcatgcaattgtaatagttattattaatttcatacaaaatgcccaaatgaatacctggctccagtaggtctttaataaataggaaagtcttatgccatagtacttaatgtgtaatcttaaagatacttatagagtgaaattagcccatggaatatatggcacctggcttgaatggtattggaatgcatctttatgaatgtaaagcagttccttatttgattttccataaatgaaaagtaaatattaaaatctataatatttcattagggttcacaagttatattaactaaatgattatttgataattctttttaaaaagaggaaaaatttgatacaattatggatgatagcatgggaattaataactcagtggcctgtgtgtatgcacatgttgtgtgtgtattcgttatctagagcccatacgataatgaatatctttagatctatctgagttccttcttcccagtggtgagtatgtaggaaataattactttctagtcatggaaaattgatgtatattgatagcctgaggtttcaaggcttaccaaaagttatatagtctgatttaataaattaataagagatcgcccagcaccatctgagaaagtgatatttctgtggcaggttatcctatttgttattaactccatagttattcttgaggaattgatgaaaacagttaacagagtcctattaagaaaatattttaatatttaaatatttccctcctaaggtagcatcagtgacagtacaactgttatacattatccttgctcctgagttaggaatgtctacaaactcttctaccgttctggtaccaggtcaggaaggtaatactttttttcatagtggacttaagtaagctgcctgtgctttcttaagaagagcatcacattggaattggttaacttttctctatttcatttgcctttaggctaccaccagggtaccctgacactctactttttctttttttctggagaagcaaatatgcataacataattaagttagtgtcagaagatgtgggattatgggacttgaaagagcaaaatatttacaatagtaaagttctttagaattgggacactcaaagactgatactgatttaagtaacatactaaattaatatccttatttaattttaagaaccaccactttatgtcatttacaatagaagatcaataaaataaaaacaaaatatgaagaaagggaagtattggattttgatatatattttgtagcctacatagtttaattctctctccctaaaatacatattttaaaagattaggaggggccgggcacgtggctcacacctgtaaacccagcactttgggaggccgaggtgggcggatcacgaggtcaggagatagagaccatcctggctaacgtgaagaaaccctgtctctactaaaaatacgaaaacaaaaaaaattagccaggcatggcggcgggcgcctgtagtcccagctagttgggaggctgaggcaggagaatggtgtgaacccaggaggcagagcttgcagtgagccgagattgcaccactgcactccagcctgggtgacagagcaagactctgagactccgtttaaaaaaaaaaaaaattaggaggatagttcctaggcatattgaaaagcatacattattcagcatcctatatagtaataggaaattatatatatatcacatataagatgcttatattcttttagcaaaaaacaattggtttttattgcttcagtattgcctcagatttcaatgttgcgtcaatatttgattgcttaaatatggttaatacagctacatatgcatattctgttattttaaatatattataaattatattttaaatatattacttaatgtattctagtatacactatatatatatctctatgtgtatgtgtaatatccattattaggtaataaaatctagttattaaagcattttacttttattagagaatttgatgtacaaacttacagctgagtatccaaaataaatcactgatgataaaaagttatgagtaacaaagagatacattttgaaccctacagaggcatcttaagtgtgtggagatatagttcataaaactgagacatcaacaacatttcatagaatagatcttaaaggagcaacagatgtgttatttctgttgggatgctgtcaagttaatacagggctcagcagaaaagagatgagctaggaaatttcagctctagctgtagtttaaagacagatttccctgacatcaaacagagttggttcaagaagtaggacattgacacattttgtcatagccatacaatgagtgatgatggcttacaaaggcaaggtaagaatttaggactagaagatgcaagtcaaggttggcatgattggagatccaagtcattaagattgtcatttgtggtaatagtctaaactcatggattacttaggaattagcaataagatggagctaaagtcaggagttttggagaatttaatgaactccatggacccacttcctccagcctcccaaattttgtgtacaatgtgagagagtttacagactcccagccattgaactaagtatctcagaattaggagagtaaacaggagacctcaatgataagcacttaaaactaatatgtatcaatcaggataggttagattatgcctcagtaacaagcaaatccaacatctcagtggtctgaaacaacaaagtttatttcttgctctcactacattttcattgtgagtcagctggagggctctactgcttgtcgctgtctctctgggatcaaggctgaaatagcagttgtaatgtggaaggttgctagtagctctcggggaggtctcagagcagtcagtaattgaacattctgcctggaagtgacataaatcacttctgctcacactctgataagaactaattatttggctccacccaagcacaagggcatggtaagtgcatgggcctgggagggggagaaccagaagcattttcaggaacaactctacagactactacatgagaccactcctacctctcaactagaaagggattatatacttcctgatctctttcctaaaatttctctttcctacttctttcctacttctctttcctaaaattcttctccaccttctaacacacaatgtccttcttcctatgaaggaaatatatagaatatttaaaaaatcatcccatctatggcttgacataaaaggtgtggatgcatttcacatcaaaatctagttctttttccaactatacgtcatagtgataccagttggccagtcaggataagtgtgcaataattgaacagaggagaaatctatttcatgaggaaggtaagatgtcaggattagttagacattggactgactggtggctactacgctctggttgggttcttatctataattagtactgtatacattctgatacggtcactacattcattctgattggtacttcttatgccattttggttctaaatacttcgaatgtcatccttagttaatagaaataaattagttaagttattgaatttcgaagaaaaggaacaggtcaacagaactttatggagatatggataaaacatgtataataagtcagaggaattataaaatgttataccttcttatgtctacaaatttaaaataagtcaagaacacagttggaatttgatcatttaaaatagaggctccaactgtggctgaacttttgcactcgtcctggttgccctagtaacagggctccctttctatgctagtaatgttacagtgtgagtgaggtaataattggcagtagagacatacgcattcaagtcagctcctacttctgggtaagttaggagtttgctgaaggcaaaggatgaggtcataaagggacgaatttgagttaaaaagaaaataaggaaaagaattaagttgagccttatcttgacattttctgagcagagccccacacatcacatgcatttctcctgatcttggttgaagtcagggtagacagtaagtcatgtgattgtatatctctatgaggtcttccatcacagcccagaggaagcactagactggaaaattgtaacctgtgcaaattggcttggattagagccacctgtccgtggattactctgtctctcttagagttacccagaaagttctcatctgcccaaaaggttcaagagggagtcaaaacaggcttgctcatatttttctgtaaatgttgtttactttctgtttgatattgtccttaggcatattgtatccttgccaaatgtatctgttcgaattctgcttaatggtctgagcctttttttgctttcattaaatatatgtcaaatgtacaccactgcttggactgagattaggaagagtaagcaatgagcacttcactattttttctttttataattttgacttttattttagattcagggggtacatgtgcgggtttgttacatggtattgcgtgacactgaggtttcgggtatgattgatcttgtcacccaggtagtgagcgtagtaaccaatagttagttttttaaccctagccccactccatctctccacctgctagtagtccctaatgtctactgttgccatctttatgtccatgtatactcaatgtttagctcccacttaaaagtgaggacaagtggtatttgggtttctgttcctttgttaactcgtttaggagaatggcctctagctgcacccatgttgctgcaaaggacgtgatctcattcttttttatggctgcgtagtattccatggtatatgtgtaccacattttctttatctaatccaccattgataggcacctaggttgattgcatgtctttgctattgtgaatagctgagtacttcactctttcaatctgttttctctttatctaaaccttttccactagaaaaagaaggggataagaggtgcttcctctgttccactctttaaaattcctgaaacaaaacccaataaaactataacataaataaattaaaataatacacaacattacctaaaaataggatggtttttaatttgttattcaaatgaggacacctttgaaagtgaaagaaagtactgttaataataacacagaagaaaacacatagattatgatgttcatgcctaacttaaaaatatagtcaccatacctaaagctagtaggagagaacagagagataaggagggaaggagaattaccttgggatactctaaggggaaatcttcaccttgatgcacactgagttttcatactcacttgtaactaatttgcagccaagttcagtactattaataatagagaacatgaaattattttaagataaaagctcttttccaggaataacttgtatcaggctgactatttaagaatgagttactaggcaaagaataaagtcatagaaatccatattcatagtgaagcctcagaaatggtcttagtgattgacaaaagaattgtcaaattaaggactaactcactaatttgattgcattttctgtgcccatgacaataatttaagaaaattaaaatgaactctacttttcttaaggcaaatctgtcatgccctgcctcagatttcaataggactaaagaagagtccctagaatgtgagaaatgactataactgtgtagtgggcagcctctgagatggtctcagtgatcctacttcctggtattaagcccaatcctttattcttttccccttaagtataggtcgaacccagtggatcctgcttctaatgaatagaatttgataaaagcaatgccatgttacttcttcttctttttttttttttgagtgaggcgtcattctgtcacccagtttggaatgcgatggcgcagtcacagctcactacagccttgacctcctgctcaaatgatcttctcacctcagcctcctgggtaactgggattacaggcatgtgccaccatgcccagctaattttttgtattttgtgtagaaatgggtttcacatgtttcccaggctggtcttgaactcctggactcgagcgatcctcccacttggattcctaaagtgctgggattacaggcatgagccactgcacccagccacatgttacttctgaggttagggtggcttctgtcttgcatgctctttcttgccctctctctgggagcccttactctgggggaagcaagctgccacattgtctgtatgtcgtcctatggagaggcttatgtggcaagcaactatctccagataatagccaggaaggacctgaggcctgccaacaacctcatgagggagtggaagcagttccttcccagatcaagccatgagatgattatagcctcagccgatgtggtgattatagccttttgagagatcctcagccagaggatccagctaaattgtgctctgattcctgacccacagaaactgagataatgaatgctttctgttttaaactgatacatttggtgataatttattccctagcagtggataactaatgcactgcatataaaataaaatagtgtgttctgaatgatgaaaatacacagaaacatgcgtgtgcgtgtggacacgcacacatacacagaatggctacaaaatccttatgtgtgaaggataagagtttttcctatgctctcctgcattctctgcgctgattttattttttgccatgtgtttttctggatattttcttctatgtttatggtagggggactttaaaatggttccacagaatattagcaaataataaacagaagacttaggctcaggcatagagaccacatatgatatttattatacagcatatatttgggagaagcactattgatctttcttattgaatgcaaatttttcctgtgagttttcataaagaggattctctaaaatgtagagaacaccttcagtgacatttctaacaacatccttaccgtaaacagaacaatgaattttagccggctttcttttcaagtctgtcagtatggtctttatttgcagttttaaggactagcctaattgtagcacatggcacccaagtggaacttactagcctccaaggagaatatcttgcatatttgactttttcaacaatatcaagtgtcatgacaaaggagttcatcaaatttcttctgcagatggatggttgtcttttgggaatggtttaagttctacttgtgacaaaggaaaaaataattggcaggtaacaccatttttccggctatatagttctgtgatttgttgtctataacttaacttttaagttatttgttccaaaaaggtaaatattcagcttgaaaagctgctgaaggaagattaagtccaggctacatctcatcctattctgctataggggtagctaaaaccctttgcagaattaaaaaaaaaaaatctctttagcacaatacaaattattagagtcatcagattatagatgccatataccacattaatctaggaatagtggtgtaatgctgtttcagttatttatgagaaagtacccgtatttaaaactgtttccagaattggcagtttttactgcagcctgcacatggggaaataattcttattaaaatcacttaacacttccttatgagctttgtgtgacacgcggatttatgtgcatgtccttttagtaggaaatgagtttgaattttactttgggaagtaagatttatattgtaagcggaaatataaaaagatataataaaactgttttggctggtaatgtcacagtatcactaatcaaagaaagcacaacagagccatagaaatatctttttactttacagaatgaagtagaaaatgcactttaattgctgtcaagaaaagatagaagcaaaatattgtttgtgatagatatctgttagtgtacagtacagatttatcaaccctttaaaacttaatttaaaattggccgggcgcggtggctcatgcctgtaatcccagcacttcgggagactgaggtgggtggatcacgaggtcaggagttcaagaccagcctggccaagatggtgaaaccccgtctctactaaaaaaaaaaaaaaaaattagccaggcatgggggcgggtgcctgtaatcccagctactcagaaagctaaggcagagaattgcttgaacctgggaggcggaggttgcagtgagccaagatcgcaccactgcactccagcctgggcaacagagtgagactctgtatcaaaaaaataataataataatttaaaattatattttcatcctcgtatgaaaacccttggaggcttctggcattcaacttgtacttcttccattctgtcatctggcaacttgctgaatattccttctctctcactaaaaggtttctgtgcctgtctcacagtcttggtctttgcttcaagtcttgccatcatcttgggtgtttctaaaatccatacggtcacctagggactctgtcaaatcatccagtggatgcttcccagtcattattctccttaacctctttctctctccatcccttgacacttatcaccattcctgcctcctggaaatactgtatttccttggttcctaacaccattcactctcctcctctctttaatctctcctctaggtatagcagtatctccttatccccagtttttctttgcagtttcagttacttgtggccaaccatgatctgagaatattaaatggaaagttccataaatgaagaattcataagttataagttgtgagtcattcttagtagcttgatgaactcttgtgccatcctgcctgggatgtgaatcatccctttgttcagcatatccacattggatatgcaggaggcaggtctcggttatcaccgtcttggttatcagattgactgtcaatgtacaacagtgcttgtgttcaaggaacccttattttacttcataatgacctcagtgtgcaagagtaatgatggtggcctgttgttataattgctctcctttatttatttatttttattattaatttttttttgagatggagtcttgctctgttgcccaggctggagtgcagtggctccatctcggctcactgcaagctccgcctcctgggttcatgccattctcctgcctcagcctcctgagtagctgggactacaggcatctgccaccacacctggctaatactttatatttttagtagagacagggtttcgccatgttaaccaggatggtctcaatctcctgaccttgtgatccgcctggctcggcctctcaaagtgctgggattacagacatgagccactgcacctggcctgctctactttattataaagtattgttgttaagttcttcctctgcctaatttagaaactaaactttatcataggtatgtatatataggaaaaaacagtatatatagggttcagtattatctgtggtttcgggcgtccattggtggacaagaggggactactgtactgcttttcagttttctttgggctctcatcactcagggttttaatcttgttttcttactctagttaggctacttgtatggacctacctttctagcttgattcactgtctttatgcaggagattctaaaatatgtatgtctacccttgatttttttttcagctgaatatcatactagctactagaaacagccatttgaatatgtcaacggtattcaacctgatagtctaaaattgaactcttcacttctctcaccctacccttgccaccctctctgttccatatcaacaaatagcacagttatgtacccagtagctaaggccagacttacgtgtgttgttcattcttttttttcttctcccttacctcatgcatatagtaaatcacaaaggcttattgattctacctgctaagtatctctcaaatccatttaattagtcctaccttactgatgctctccttattatttctttcttggattactgcaacaattgcccttcctagttcaatatgttcatgtggtggtaattcctctaaaacatttatgtcctggcttctaactgttcactgaacaacttatcattgtcttcaaaattaagtccaagtccttcccgtgacttttactactctaagtaacggccccagcttatctcattattctgctcttttgtaatttttgcccaaaggctaagttccatccaaagtgaacttcttttagttctatgaagaggactttctttttcaaacctctaggtcttgatataaaccccttcagcccctaccctccacgccttcactgcctataccctggcaagctcatacttattcaggtctctgcttagacatcatttcctctgggaaaactttcctaacgccttaaggtcaggtaaaatgtttcttctgtgtgttcacatggaaccatgtgtcactcacatcataacatgtagcacaccatgtccctcccacctccagtactctagatgaaaattattgtttatgtggcaagaacacttaacatgagatctgtcctcttaacaaattttaaaatatacaatgcattattgttaactgtaggcacaatgttgtatagcagatgtctagaacctaatcatcttgaataacgaaaaccttatactcattgattagtaacttctcagttccccatccctccagcccctggcaaccactactgcactccctgcttttatgtgtttgaatattttagatacctcatataagtggaatcaagtttttttatttgccagttcttaattggattattggcttcagggtggagcccttggaggaacagggccaggataacatgcattgttagggcctaataggcacagctgaaggcaaagacaaatccccaaaattaagggtcccattttatactggatcttagatccccaacaggaaggagatactatgggagaagacagcacatatcatgcatttcataataaggcaacccaaagccaatcaacttattttgtaatcagcccatcccccatgggaatctcatctcttagtgtggggggtggggatgtttctgtgtccagagttggttccttccggtgggttcttcatctcactgacttcaagaatgaagccgtggacctttgcggtgagtgttacagctcttaaaggtggcatggacccaaagagtgagcagcagcaggatttattgtgaagagtgaaagaacaaagtttccacagcatggaaggggatgcaagtgggttgccgctggtggctggggtggccagcttttatttccttatttgtccctgctcacgtcctgctgattggtctgttttacagagtgctgattggtccattttacagagcgctgattggtccattttacagtgtgctgattggtccattttacaaacctctaggtagccacagagtgctgattggtgcgtttttacagagcacagattggtggattttacaaacctctagctagctacagagcgctgatggctgtgtttttacagagcacagatcggtacattttacaaacctctagctaggtacagagcactgattggtacattttacaaacctcttgtaagacagaaaagttctccaagtccccacttgacccaggaagtccagctggcttcacctctcatttgcatatctttcaggtgaccaagagcatgcttctgtgattcaaatgtacaaagagttaagtatccctccttaactattagttatcttttaaagtatatttcctacctagttgttacatatcaaagctctcataatatgaagtaatttgatacccccaaaactaaaaacttagataacacagtgtaaaacagaacagagcctatgattttgagagggaactctctgcttttaattcctagggtttcatgaagaaaaaaggtttttttctgaaaacaggttttttcccaaaatagggtctgtgacacctcctttgtttttcccaaggagtcccaggctaccagaatttatcttaaggcctctcatgtgtgctttaagagtggcaagacaaaaaatggagaaaaataattcagtcgactgagaaggagaaaaaaatttccagaaaaataagattcaagaagagaaaaatgtaaaggccttttaaatatacttgtaacttggatatccacttttaattaagctgagcactctttaagaaaatccttctaaatcccttgttacttgactttagccacaccaagcagttaagattttcggcttttgaactttacaaagagtaacctcacaggtgaaaccaagaagtcttaattaggttatgacttaactgcgagtgtacaaggaattttcaaaggggtgataagcagcttttgaaactgtcattgcatttggttgaaagtgtgagacaagatcagcagctctttgcaatggcatgtaatttcagattatcatatacttactgttgcaagagcctggtattcaaagctgctacagcaatttggggttcttggctttggactggtttcccagatgttataattctttctgggacacttatttagaagtctactgtcaaggaagccacatgtgaacttctttgactattcctaaatcaggatcataacccattttcatatgccacattatagtgactttaaaatcttttaagtagaaatgtttgcttgggtagtgagactttttagaagcaaaaatactattttgtatcttttttgtcagtttagattatgttaaacaagaagtcttttggattataccagaatttacttggctctttctgcaaaacttctctagtcatcagaccatagaaagagggcttgattaaattgaatcaagtaactttttctatacccttcagtgatttgactttaagccacagttggaagagaacagtttcctgcctttgtcaggttctggaaagatttatttgtttcactacctatttcttcacttgacacagagtagtggcacgttattgttttttcttggagactgcagtgtctagagaaactctaattgtacttctctagttgaatcccaatattaaagtcttttaagtattttataaaggcttttaagtattataaaggctttagcattttaaaatctgactttattcagaaaacttttccttttataggagaatattaatattatttatttaaaatgaagggatatatagctgggaattatcctttagaaagtatgttttgtaaaggacttgttctatttctgagttcttgtttctttcacatgttttaagaaagtgctgaatgattgattaaataaactttagatcggttaacacctgatagtgagaagactgctccttggaatttctgttttaatttctctttatcctcttgtctaataactatgataggcaaaatttatgatctgtctctctatctcaacttaccttgttccagatgtacatttttgatgtctgttattccagttatcatgtatttaatataatttcctcatttgctacaacatggaaataggcttttttactaaaaattataaagtaattatgtcttctatgtttatattcttaataatattgacatatctgttaataatatgtaatgctaatgaataatttagtttccttagtgatagtttccatgatgttataactaacatccctacctatgaaaatgtagggagctgtctgaagcccaggaaggtcaggaaggtgttaagaaccaggacaatgtatttaacctatcacaatcaaaatgccattcagcctttgccctcaatatttgacagcaaatgaatttgtcattttctcacaaatatcctgccttgagctaccacttgtctgccttgtaactcatcttttccatgacctagttcttaacctggtttttgtctttaagttgtcactataaaatctctaactgggagatatctttggttgcattgttcctcttattagtctcaacacctcatatttattattatatcaaagggtatggtcaggaagacaaattgtatttgctagaggaaaaataaaattagttctgtgtgcccttgactctatatatttgtagtggttttggggtcagactctgcttcaaatcctgcttctgccacttctcaaactctcttgtcccaggtataataattatagataatagttatcaagacctaactctttgccaggtgctgtgttacatgattgatgtgtatcattttatttaatgctcatgacagtttaggaggagagacagaccactaacagaggttaagtagtttgctgaccatcatgtagctgatatcatgtcaggcagagtcagaattcaaatgcaggctttctcgctccagagaactggcagtgttagctacatggagttttcctaggtataaagtaaaaatgataatatcgtatctacttcataggattagtgtggtgattaagtcatagaatatctgaaaaatacattctcttctgtttaaaataaacttttattcaccaaacattagcagactctcagggaacattgcttttatccattaaacaaaggtgatctttgctggaaacccagtggctttgtgatacaattcattatgctggactaaaaagcagaaagcattatggctttaggatgacatggaaaaacatacactgaaaagactgatagctggatgaccctccacagtatctagcagcatcccactgggctctggatctgccagattcctcagcctatcagtctttgggatgatggtgagagaagtagctaaaggaatcagaattacaaaaagtatccataggatggtgtgatggcttgaaagtaccaggactaaaatgagagacaactttaaattctacacttgtattaagtatctccccgaaaaatagagaagtttgtttttagtaaagctcttacacttctagtcgactggaggctaaatgggaatcaccagtgtgacatgactgttaaaggagctaatgagtcataggtagcattgttttctaaaataaggaaattaatagtacactgcagtatcagaccatgttgcccagtctgtcctgcagactgtggcagagcaacagatgaaaggatttctcagacacaggtatccagtaaaagagtgggctaggggactgctggcactaggggcccaagagagttagcagcccccctaagctggcaacgctcacatttatttagtacagatttaatgacaaaggcttggagcaaacacaatttgtgggtaataaacattgtcgaccccctgagtagagagcatcctaagcacgaatcatcaaaggttggtttctggagacaggagtaaacaaatttatctagatcgatttctttacattcccttattatctgccctcaccctttgccagggtaagaacagctgctttcagctcattcttccctgaagctttgcaaaacctcctggccttccaagaaggtttgcctttttccctataatttttataacttttcctaccagcctgactgatctcctacatctcccccttttctgatttttgcatcaggttttgttgattgaagagtatagatgtgtgcagcaacaggtttgtcaggtgccacggttataactcatgttctggctttgcatcctagaattagtaaataacataagacaaacatgagtataatcagtaacattcttttctaatcaaggagtgacatgtagtattacttggcacctcagttcaatgtgtgccgttactaaggaaccccccactaggggtatgttaacccctttcagctaagcagttatgttattagagactgcccaagtaacagggtggaagaaaggcagatctaagagatgagcctaatagagtgtagcaggtgcaggttgcaggcagagcgagagcataaaaaggataaataccctatgagagttgtgatgtacaacagagagtatagcaaggaacagattatctgaagtgaatggtgtctgtttctggagcaggattcactcagcctcctgagttgtcttcttcagcatttcctaggtaatgtccggggcttgtgtcatccaaggaagctgcatcatccagggctgcgggttctgcagggacatttccttcatttctgataccaggttgggtcctagccacaccatggtatgggtttgatgtgtcgtgctggaatccacagaggacctgagggggtatgaacacaagcatattctcttccccatgttagcaatttgtttggaccactacatacattactgtttacatctttccataaaactgcgggttttatgtctagagaggttttagcaaagtgcttttctatagctaattggaatttattatttaaatttaaaaaattaaaggtaaataaggcttgtgctagtagtgttgcagggtccttactcatattcccccttttttgttttctgagcatatttttaagagtggaatggacacattctactgtggcctgcccttgagagttatatgggatgcctgtggaatgttggatgttccacatgtggcaaaatagttgaaattgtgagctggcataagtcggaccattaccagttttaatttttgtgggccaccccataaatgcaaaagttgagagaagatgtttaataacatattggttggactttccaggaagagcatgtgtgctaattaggtgagaataggtgtcaatggatacatgtacatatgtagttttagttttctgaattcagggacatatgtaacatctgtttgccaaaactgattaggttctagtcctctagggttaacacttgttgaaggaggggacatgcctgtgagctggcaatctgggcattgcaggataatttgtttagctagtctttgggtaagttgaaattgttcagttaagttcctccagttttggtggaaaaattgatgtgattgggtggcttggtcaagcagtgaggtcataacttgcaggtctgcttgattattactgtaagccagtgggccaggcagtgagctgtgggcttgaatatgtgtgataaaaataggacgtgtatgttgatccagcaattgctgaagttgaagaaaaagtgcacacagggtgggctcaagagtggacttaatgagagctgtttcaaggttctgcaataaatagagtaagcagagtcattaataatattgataggctgaacggaaaaggtctccagggccaatattaaggctctaacttcagctctctgaatgttagtaagtccagaacgagtgagggaattatgtggtctccaccaaacagccacttttccatttttaccagagctgtcagtaaaaggtgttaaagctttaggtatgggggagtgaactacttttgtaggcacaactacaggagtacgagataagaactgaattagtttgtcagcagaaagggcatgctctatatggcctgtataatcagagagtgttatctgaagatctagagataggggcattattgcttaaaattgctttttacttgaagtaattcttatgacatcagggtcataacctagcaactgattgcatcatctgtggcctgtatagatgagtttactacctagctggatatagggagatagtgttttagtcccggtatgtgagcaaaaatctcattctaggaagtatagccttggggccatctgtcctattaatcttgttggggaatgtttagtaggaaaaacaaacaattggactgaatattttgggtctgtgcaatctagttgcctctgagaaatagtatgctctatttccttaatttccctttttgctgcaggagttaaatgcctgagagagtctagggttgtattgccttttgggatagaaaacaggttttgtaacttatcagtagttatgttcaaggaggggcgaagccaattaatattacccagtaatttttgataatcatttaaggtgtgtaagttgctagtatttaaccttttgaggtcttattgaccaggaagttaatatgtatccaagatacttccaaggagaagacaattttactttctcaggtactatgattaaacttcctaactgtgtgttctttatgacagaggcatataaacttaaaagtactggctccactggggctgctagtaaaatatcatccataaaatgaataatcttgcaattaggaaattttttttctactggggagcaaagcctgatttacatgatactgacacatggtaggactgtttagcattccttgaggaagtactttccaatgaaattggtgagctggcctttcattattgatagttggtattgtaaatgcaaatttttctctgtcctgttttgcaaggggaatagtataaaagcagtcttttaagtcaacaataactataggccaatcttgaggaatcgctgtgggggaagggagggcctgttgaaggggccccataggttgcaaattagcgttgatagcccataagtcatgcaaaagtctccatttgcaagatcttttgggaatgacaaaaatgggtgaattccaaaggctgtttgatattctatatggctggctttaaattgctcctcaactaattcatgggctcgtaatttctctccctttaaaggctactgttctatccaaataggactttgagagagctatgtcaggggtaggggaggaataacagtggccgttattagaaaggggtctgcagagtgacctcaattaaccctcttgtaaatgggctagcggctccattttctctaatgctttttcttatctcttgataagcgtcaaaagaaatgggttcatagaactgattgccttgttgatcttgtattactgggcaggctaagagctccccttctaatgacacttgcctaagatagggtcccacagctgtagtgtatcccttgtcttttttccaatttattggaggagggggcttaggcaaaacctgcatttcctctttgttatttttgcccagtaatggcttggctgagggagaaggaggaggtagtaaggtaggtgatagttcttcctccctttcccatttaggctcttctgtgtggagtgggatcaaagcagccctaactaaagcccataatgttagagttgttactgggaccctttgcctttgtgcatgatattgtttaagatttcttcccacttgttcccagagttctacatctagcgtaccttcttctaggaaccatgggatatgggatacaacagtttgcattaggtcccttaattgagcctatgaaactgaggctgtggtagctttaagcagctgcttcaatacttttatatactgttgctcttgagctgataactgttgtcccatgatgaaaccctagcctgaataattcccttaaacttggaaatcccgagtgggcaccaatgacttactgacttactgactgtgcagtctcttcacttccattttagagggttccattgtgatctgttgcagtattcctcacatggggtaccacctgccaagtctgtcctgcagactctggccaagcaacagatgaaagaagtactcagacacaggtatccagtgaaagagcaggctaggggactgctggcattaggggctgaagagagttagcagcccccgaagccggcgatgctcacatttatttagtacagatttaatgacaaaggcttggagcaaacacaatttgtgggtaacaaacattgttgactccctgagtagagagcagtcctgagtgtgaatgatcaaaggttggtttctggagacaggagtaaacaaatttatctagataggtttctttacattcccttattatctgccctcgccctttgccccagggtaagaacagctgccttcagctcattcttccccaaagctttgcaaagcttcccggccttccaagaaagttagtgtctttccctataatttttataacttttcccacaaccctgaccgatctcctacaccatgtctagcacattttcaccacatctcaagtctatattcttgaaggttcattggccatttgattatatttggaggccagaccacttgaataaaggcttttctgaccattttatttcaggaattgttcaatctgggttttagcttggggaatattatcactatcttcaaatacttgaagagctgtcatgtataattgggagtagacttaatctgtatagtgctggagcacagaaagaggaaggatgaatggatcatagttatagagcttcagttggggcttaatataagcaataactttttaactgttagagccacgtaaaactaaagtgcctgctttgttggtaaagcaatgagttccttactggtagaagtgttcgagaaactgtgagatagactgcctatcagggagaatatagataagatttctgctttgagtgattggttaaaccttctgacttctaatacctctacctagtccaaaattctttagtattacaaaaaagatacaagtgtttgcaatagagcaaagtattgcctcaaaatgaaatctaaatgaagagaaaatgggttctactacaaaaattaccttttcaagagatgttcactcatatatggaattgcaaagaaaaaaaatgtaggtatcatagaagcagagagtagaacagtgattaccagagataggaaggtgagggggaggagagaatggggagaggttggtcaaagagcagagagttacaattagataggaggagtaagttgtggtgttctattgcacagtagggtcatgatggttaacagtaaggtattgtatattacacaatagctagaagagagcctttgaatgttctcatcacaaagaaaggataaatgcatgagttgatggatacaccaaataccctgacttgatcattatgcaatatatatatgtatcaaaacactaaattgtaccctgtaaatatgtagaattacaatatgccaatgaaaaatttaaaaatttcattttaatgtataaataggaatgtgagttcattcttttaaggtgagactacaaatgtcagagaaaccagatgtgtgggtcagctaaaatagtttccccgaggaatacaaaatgatcagaagggtccagggtgagtgtgaatctgaataagggaaatgggtgcactactgagtggctaatgacagcaggttctaatgtatccatgttcacaaaagggagatgtctggtaggcaaactgagtctacacactggcttcacgttaggtacaggaaaatatggttactgctaagaaacccccatactctttgttttctaacctttttttttcaaattaaatgcattaaaaaataataccttctaccttttctacattatgtaattatttaatctacttccctacatatacttgacaaattattgagatggcatcttaatattttctgcttagctcattctgggagaagaccttcttttcctcttaaaaattatcttgtgtgcttatccctttcaggaaaaatcacagaacaaattcctcagtcacaatctctcctgggagataaactgtgaatagaatgactcttcttttacttgttctgtcatattgccaaatagaacacagagcgtattcacatattatgtattttgtttagaagctcagctatcaaagacttgagctatacaaatttcccggagaaggtattttgaccccttccatatgctacctcattttccctggccaatgatatccttaatctattattctaaagcagattaacagatctcatttttaaattcttattataaagttgaataaatactatgcagttaaaggagttgcatcataaaccacctcaatgtttagaagcttgaaacagcagccattttatttgattgctgatctgtgggccagcaattcaggctgggcttagctggatattcttttgcccatctcaagcagctgttttctgacatgctttaagatgaccttactcacacgtttggtggttctggctgtttgcaggactacaagtctctggtaggctttgcaggtttgtttacatggtggcagccttctaaaagtagcaagaaagagttcccagcaccaagagggcaagatccagtgcaggagcaattcttaaacttctgtttgtgtcatgttggctaatacctctttggccaaagtaagtcccatggccaagttcacagtctgtgaggaagagggccatgtagggtcatggatacagcgaggtgtaatacactaggagtcactgctgtagcctgtatcacagtttgcacatgaatttataggttggtgcaaaagtaattgtggtttttgccattacttccagtggcaaaaactgcaattacttttgcaccaaccgtgtgtgtgtgtgtgtgtgtgtgtgtgtgtgtgtgtgtgtgtgtgtatggttggcatttaatatttggctttgatcaacatagtatgaggatttactttatatataagtaacaaagagtagtgtgaacaggagggaattaatctacattgagaacttatgatatgccaagaactttacatatgttatctcatttaattttgtaaactcagagtgaaaaaaactgagatacaaggaaggtaaataacttgtccaaggtcacagttagcactttacactccagtctatgggactcaacaagcattaaaaaaatcaaaaaagaacagaataaaaaatatcagtaatgcatatattaataataggtactttttcataaactgtatttgcttttttgtgttggctcacaatgcataatagaattcttgccatgaattgtttgtttttgtttttaaactggaaagccactgttaccccatatagactcccataagcatgtgaaaccagaatggtcagaaccagaggggattaaaagtatatcatggctgaatggggtggctcacacctgtaatcccagcactttgggaggcctaggcgggtgggtcacttgaggtcaggagtttgaggccagcctggccaacatggtgaaaccccgtctctactaaaagtacaaaaattagtcaggtgcagtggtacacgtctgtagtcccagctattcgggaggctgaggcatgagaatcgcttaaacccgggatgtggaggtttcagtgagctgagatgacgtcactgcactccagcctgggcgacagagtgagactccgtaacaacaacaacaacaacaacaacaacaacaacaacaacaacagcatatcattagtttcccaatcctgatttagctgaaaggtgtaccatgactactatattacattgagatagtgttttcatcagatgaacacctgactctttccactgcagttaatctccttttatcagtatctgctaacatttctttgtgacttacagaaaatcattatcatagggagagatttgaattctgggtggaataaattagaacatcaatttcccctattgatagacccttgtaggaaccaataactagtacaagagacacttaaacaatttggatgtaatgccttgtgtttgaaccaaagcatttattactcaaatatttagtccaaagaggtaaaggaaaagtattattttgtaatctgtttttttttgttaatctcatttgtcttcagtcatgcaaaatggaacgtttgttttaaaatcagcccacataccgaaatgtcttttatttgcaaaatgaaaccatgccattaaatgttgaaggagaaagattcttttaaagaaatatcaatgaaatgggagcatttccaatagaaatttgagctgaaataagttcctgtgtgatggctttatttgcaacttctctctttgagatttttttttgtacttacctaacatgcataaagattgcatattaataaactaggaatcatttgatagaaaacaatgggagggaaatgtccataagttcctacatatctctacatgcaaagaggtcaaacggttgcttgaaattctcaagaatgttttatagattgaatagagattttttttaaagccgttatcttctgtgctcaccaagtaaagtgtgggctagaaagttattttaaagtcattttattgcaagaaaaacagcaggatcctgccaaagcccaaaagccagtaaaattgcaatgaaacattgaaaattacaaggtcaaagctttatattcatatgaaagtaatatttgaaccaaaaaaggtgatatacttttaaaaaaatttggcctattccaaagaaacactgaaaaacaaaatagctgggttatttatcattgtatattttgattgttaccccaaatttaagaaattattagtgaagagcataactttttacatattaattatgatagttattcatttaaaaagtgcttgcaaaaaataattgtggatgattatttcttactgattttattttcaaatgtttgtgtatggaacattgttttggaaggaaagatttagcagcatcactcagcttataattagtgtcagatatgttaataaaaactaatcaagatgttggtaagcaaatgctagaaactgaaaatgaaggtgattaaaagaaagtaatttctgaaacaagctaggattaactgaggatggaatcccaacaggatttctgcttttgttcattggccttgcccgtcactgctaacataatatgtcatgctgaaagaacaaaccttcactgaggggtccagaggacatacttcaagttgaaagttctatgtttgttggttcaacaatgctgagttaattacattttataattctgctatacttgaattctaaattgcagtcccacgtcttgtcttaaattgttattattatttttttggtcacacattttattgggaaagaatcaaagtctgaatgaatgatatttattctagtgggctctgagatgtaatacaccaggaaagaaaaattactgattaaagtgaagaaaatgactatgaagttattctgttcagttgtcttaacaaagatgaatgtgttttaattaatttttttgtgtaaatgtaaattgttaatgttaaaatgatagaggttaaaaaaatcaactgattacagaaatttttgaaaatacagaaaaatataaagaagaaataaaaatcatctacagttaatgtacttagaagtactcatgattaagtttttgatataaagtatttttcttttccttttgcattctcttttaaatgatagtataactggatataggattagaatttgactattattttccatcagcactttgaagacattactttgttgtcctatggcatctattattgctgatgtctttatgatttttttccttccattactgcttttaagatctccttgtatttgaagttctgcacttcactacagtacatctaaatgtggatttcttttcatttgtcttccttagaacttcgtggtattcctaaattttagaatcaatatctttcagactattggaaaattctcaaccattatctctttaactattacctctcacttctgtaacatcctttctggaatttcaatgagacataaattgaaccatctcatcctattctcagtttctcttaatcattctgtcttatccttcacctttctatttctctgtgcatattgatgttatccacaggtgttttccagttcactaattctcttttcagaactccaaactgaacttctgctgtttaacctaccaattagattttaaatttaaggctatatttttttatttccataagttttattttattcttttttaagtcatattttctcccttctatacagttatgggctaaagggctaaatcatgtccccatctcccaaattctttcgttgaagccccagcccccagtatctcagaatgtgattatatttggctacagggtctttaaagagatgattaaggtaaaatgaggtcatatggataggccccaatccaatatgacttgtgtctttataagaagagttaaggcaccagacacaagcacacatagagagaagacagtgtggaacacacaccaagaaggtggccatctgccagtcaaggagagagcctcagaagaaaccacacctgccaacaccttgatctcagacttctagtctccagaactgtgagaaaataaatttctgttggtttagttacccagtacatgggatatttcttatggcacactcaccaagtcatgcacatgctagagtgattttttaatgtgacttttatcattttttgatgtctttaattctgtttaacatattttaatctattttctagctttttatttctgttatcttgtccctatgatactcacattgtcttgtttagaatgtacattttactgtgaattaacctctcaatgaagcttttagttagttttttttttttcccttgggagtcttatgtgccctgagtcagttgaaaacatattaatctaatggacaaaaaattgagtattattttaatttgtgttattttaggtactaatgagttagaactttttcatgtgcttgttagcatatgcatttcttctttcgtaaagttaggagcagtgttcatatttatccctataaaataaaaacatgtacattaatcatggactacattttgttctgatgattcagtgttattgatttctgagctctgtaatatctgcaagttataagtctttcttggcttcctccaggaagttgaaaattaatatttatttctatatttgtcaggaaaacacatgaatgtttgaagatggggtgggatcttgtttttaactctatataatatctgcagttaatcatggcaaaccaccagtttcaatttgtcagggtattgttatcatattctaattttgtatcaactaaaataatatatttctttttggttgaaatgcctttagaatcttagaacaagccttaggaaagacattactacctatggaaaacatgaaaatttgaaatattgtaatagaaaggtttcatttaaatatctttttataatagagtaaaataagatactgtgtggtaataagccttcacagaattgggcacgttggattcacctatatattaaaaaatgtgtgtatgtattagatgcctggcagcatctagtaaaatgagatctacatgtgtgaatttgtgttatttaacccttggcttaaaagtaccactcacagaagtagaagtgtgagtgttaaggttttgcttatgtccatatatatcacacacatttttcatattttaatgaccaaaaatttggcagtgttacaattaaattacattcatatggtagtgctttatttcttctccttcaggaaagctgttattaaattgcagcaaattagaatgaaagtatgtagtcttgagaacatatggactgtaatgcattggaaaattctacaaagaacagcatgaagtatttcaatggttagcaatgggaattgcatggtgataggttggggtgtgtcagtaagagttttgtgggtacaatgtatattatttgggtgatggataccctaaaagcctctgatttcaccacgctgcactgtatccatggaacaaaattaatgtttaccccataaatttatacaaatattaaaaaacaaaatgaaataaatatgaggctgctctgaatgatcgttggtattttgcaaaacgtttacaagtatgtatttaagtgtttgctaaacataatacgtaaataagaaaccactgctttttaattataagcaccttttccttatgagtttctaagttgtagataggaaatagctgtcacctcagaacacaactacagttgataggtagtgactaagtggggcaatgttttcaaaaggattcaaaaaccctccctatactcagtgagaaactatcatttttcaataagttatgtttactgtgggcaagggaaaagggagcggtggtaccagtatgaggcatttactgactcttctccaagtgctaataagatagcacatgtcatgttcaattttttattggtcctgatgaaatatttaaaaagtaggtttacaaatagataaaactttatgccttccaactttatatttctgggacaggttttcagaatctgttcctcttgggcgtatgtttatattattcattgctttctagtcactgtgcttgattcagacctccctggaatgggaagtaggctgacaggtagttttgcagttatgctttcctgatgactcatttgtatttgaaatttagttttggtttcataaatataagacctagaatctctctactgctacatttttttttaaacggcaatcttattctacattctataatttgttctacccgtggctggtttctctcttttttcaaagaatggttgatatctgtgaaagcagagtaacatttggatattagaaatttcaattgcaagattccaatcagagatcgatgacctcttttaattcaaatgtatttatttttctggacaattgttttctctgttaggggatgctgtacttagctgtttaagccttatgagaatgtcatagctcttgttaggaatcctagatccataaaatctgttcctctgttcctccagataattattattaattattgttattattttaatttatgcctaaaattttagcctcaaacaataatctggagtaattgatcttcatttaagaacttagatcttaaaatctgtcttatcttgtggatcagtggcattttctgactctgaaacaaatgtttatttctgtgttatttctgcataccttccatacaatgcctttgaataagacagtgactgtattatctactagctctcagatggcattttagactatatttctaaaatgggaaacatgccctttggtaagatttaagctagtacataaatcaaggccagcatttcctaatatggaagctgatctgccttaggaaatattaattataagaaaattgatttaaaaaactcttaaagatagttcttgaagtagaggatattagagcaatggatcatcatcctttagtctagaactctgtcattcctggcagctgttaaccatctgcctgctttcaacccacgtgaaaaatgtagatgagcacaggaattgagggtcaaatgaatctgaggtcttttttcttgcagtttaaaaacttagactttacactattttattatccaaaaatgactttaaggtaactccagatttccttttaagatactatcatgggacatttcactatcctttgaagttttagaaaaaagatggaattgagcactactggcttttaatctaaaaggagagggcatttataaagtgatcttgtattttaatgttttcatacctcacaccgtaaaagattttttatataacttatgatatcatggtccattcctctgaaatatatacatttaataggatttgtgtgcctctttaattctttaacattaattaggatttagtgtgctggatctttcatccaaagatctcaaagcatcttgcctgtctatattagctcattattttttcagtatgtccctgtgaggtagctgttaagtattattccttattttacaaatgaggtacagatgaagctgagagaggcataagagacctgcccaaagtccccgagcatgttaatattagaaaagcaataaaggcacagttctctgatttgagagattttcaacctttccttggaatatatccctaattccattctaaaatgctacattgtccatggaaattagcatattattatacgctggtgctttagggaattaaagtggacttaagaatttaataaaatatcactgtgtctctactatactttgattaggttttcagggaaatatgtgtgatcagtgtcctgtcacacaaagctaggtatttccgtttgccctgtcatatggggagcactgaaagagggcctcagaaatagtagccagagaatatggtgactgcaagtgtgggtgacactagcgatgattttcttactggtggagaaccttgcaagctcagaggtttctcttttaatgatcaagtcatgcatcctttaaattcctccaattataaagtcgtcggaatgttagtattattaggggccttaggattttctgagaaaaacttccacacaatataggattttgtttcaaaatatccttgacaaatcgtcacatagtctccatttgagcacctcgggagataagaaattgtccaagaaattttgttccactggataataattgtaataaccaatccacaaatatttattgttatctatctatctatctatctatctatctatctatctaatctatctctgtctatctatctgtccaaaatgaaagaaatataagatattgtccctgacctcctcaaggacctcggccaagtaacttgatttcaatctgtttcctaatgtatataatgaggaactggcttgttttgaggattaaaggaatcaaatataaagcacttaggaaagagactgctacataatatatgctcagtaaatattagttctaattattatctacggacaaaatgagagagagagagagagcaagagtgagagcaagagagagattgcttattacatcttattttgttttccatactatcatcttaaatgagaccgtcatccattctcatttgaatgacggcagcagcctccaaactgctctctccgtttccagtctcagcctttgtgacccattttccacactgaagccaaactgaacttaatgcaagtttgggaggcctaggcggacgggttgcttgagcccaggagtttgagaccagcctgggcaacatggtgaaaccccatctctaccaaaaaatatacaaaaattagctgggagtggtggcacatgcctgtagtcccagctactcaggaggctgaggtgggaggatcacttgagcctgggaggtggaggttgcagtgaggtaagatcgcaccactgcactccagtacactccagtctgggtgaatgagtaagatcctgtctccaaaaaaaaaaggcaagtctgagcataataaccactgtcttaaaattcattgctctccatgtacttccgaattagtttattttaattttaacttaatttaattaatttgtttaatttagagatgaggtctcactgtattgcccaggttagaatgcagtggtgtgtttctaactgcagcctccatttcccaggctcaagtgatctcccacctcagcctcccaagtagctgggactacaggtgcatgccatcctgcctggctaatttcttttttgttttttaaactttttgtagacacgggtctcaccatgttgcccaggctggtttcgaactcctgggttcaagcaatccttccatctcagcctctcaaagtgttgggattataggcataagccaccatgcccaacctgactgcttcttcaggcttgtttataccacatatgtcctctgactttgtgtccaaattctgaaatagacagtgttccagctctccatgctctctcaggtatgcatgtgtccaggtctggcccaggcccccagcttcacttcctgcttgagctgtggcacaagttgcattattggaccccattttgcttcctttcctcaggctatgttcgactcatcattcaaggtttggtttatatgccaactccaagaagtcttccctgatcccttaggtgtaataacctttatgtccttgttcatctttaaacccaagaggcttgaggttaaagactacatcttgttcactggtatttccccagagtccaaatcttggcacaaggaagatactcactaaatatatattgaatgaataacaatacacagcagtgtggaacaaatgttcagtagttcagacaaaaagtgcaagaaaagctacagaaagtagacactgccttgattatgtaggcagagaaaaggtcacataaatgtgatactttagctaaagtcttttgcttggtctttctggaataaagacattcaagtaaacctctagggcatcagttagacaaactgtagtctttgtgccagaatgcaatcccaactgagctacttcctggctataaaatattgtacatctgtaaaatggatgttatagtaacacctactttacagatgtgttgagagaattttatagtatgaaatgtgaaacacctggcacagtgcctggcacataatggatgctcaacaacgggtgtttgttacacttatcattatcacttgtactatatgcctcagctcaattcaagggatccttaactctttcaagggacagattacatagatgtaagcatttcctaagcctaatgattgagcacacatatatccctggtgcactagactcttgtgttagggtttgggattgagaggagagacttggagaagatggaggggggtggaagatatgaggagaaaatgggagggaggtgaaaaaaacatcactatgtatctatctcaggcaggcagcagatatagaattgtttatattaaattaaaaaccacctataattcagactttttgtctcttttttctatttttttgagacagggtctcactcttttgcccaggctggagtgcagtggtacaatcttggctcactgcagcttcaacctccagggctcaagtgattctcccaactcagcctgttcagtagatgggactacaggcatgtgccaccctactcacctaatttttgtattttttgtagagacaaggttttgccatgtcgtacaggctggtcttgaactcctgggctcaagtgttccacccacctcagcctcccatagtgctgggattatgggtgtgagcaactgtgtctggacaagatttttattttctttcaaagctcatgagaatgttttcatgagaatggagatgttaatgtagaatattttgatgttcttaatcctgctaagtcagggaccaacctgagtccatggaaggcctataaatgtcttctggttcaggtcagcaatgccaaatttcatacttgcaacttgtctgtttttgaggaaagggaccatcgtattaaaagtttccatgctctttccagaggtaaagaaacattgttatttttgtgctttctccagtcagaactaaggcagtaagctacatctctgaggaatggaggcatgtttattaataatagaccccttaaaatatttggtgactatagaatatcatgattcaacaagaaaagtctttatcttatattcctatctctcattataataaaaaagagtttcctaagtgattttaagcctagcatttgatgatggccaaaatttttttcccatggaataacttttgtgcaatctttaagctttgttattttggaggatcagagattggaaagcaaaacaaacatgcaaataaacaacatcaacaaaacagtagtaaaatccaggattttgtttattagcaatagttacatggtccaaacatttcatatagttttttcttttttatctagtagtgtattttatagctactattccttttcaattaattgaaagaaaggtttataattatccttttctcatagtgaatatatatgctcaagagaaatcatgttttgcatttatttatttaacatattatgtttgatggaaaatggtcttcgttggactgggaagaggaattgggatgggagatgaaggaggaagtgaacttttgatgagtgcctattgtgtgctagaagcactacctgtgataatgagaatatcatgtgttatctcatccaatccaacagcaatcttatatgttagaagcattatctttattataggtgagaaaattgaagcttcagaaattaaggaattcggttgggtgtggtggctcatgcttgtaatcccagcactttgggaggctgaggcgggtggatcacgaggtcaggagatcgagatcatgctggcaaatatgatgaaaccccatctctactaaaatacaattagtcgggtgtggtggtgcatgcctgtagtcccagttactcaggaggctgagggaggggaattgcttggacccgggaggcggagcttgcagtgagccgagattgcaccactgcactccagcaaggctctgtcttaaaaaaaaaaaaaaaggaaattaagggatttgctgaagaccgcagagcttgcaaaactggcctttaaactttgactctgaagcctgtggtttttttccctctgactagataccttttgtaaaacctggtatctcctaaaggtgattgattttagatgccttagtgtttacacagggattgacattgttgttaccagatagattggaactctctctccatactctttgaagcactgtaaagaagccatcgctagtgattacttgtcttcttgttttttaaaatttttaagtcaatagtttttggggaacaggtggtgtttggttgcatggaaaagttcttagtggtgatttctgagattttagtgtactcatcacctgagcaatatacactgtacccaatatgtagtctttcatctctcacctccctcccattagataatgctagctagtgatctggactttgtatgatctgtggaatactgaatgctcagatatcacaggctacaagaaaacagactaataatccccacattaccaaaacaataacagtaatatgataaatttccagattataaaattaacaactgatgtgattttaatgaatcatctctgaaaactccttgttctggagttttgtctccaaataaactcatatattctctggacaactttcacaattactgtagaagtcacaagaaagcttgtagaactttgtctcattcccctggattttaactagggttatgtatgagcctgtcttaatgtgttgcagaatttaacctgaaacaaatataggtaatgttaaaaaaaaatgacaacagaaatcttttactgtttcatgctgattgtaaaagtaatacaagcttattgaagaaaaaatatagaacaagtaaaacatttagaaaaaatgaaagttattcatgattctattatccaagtaaacactattaatgttttagcgcattttcttacagtgattttggtatatattatgctttctaaagttgagattgtttcctagatacagttttatttcattttcacttaaaagttaatgaatccattttcactgaaacgtatcattaaaattttaaagaaacattattggctggggccagtggctcacacctgtaatcccagccctttgggaggccgaggtgggcagatcacaaggtcaggagatcaagaccaccctggataacacggtgaaaccctgtctctactaaaaatacaaaaaattagctgggcgtggtggcgggcgcctgtagtcccagctacttgggaggctgaggcaggagaatggcgtgaacctgggaggaggagcttgcagtgagctgagatcacgccactgcactccagcctgggccacagagcaagactccatctcaataaataaataaataaataaataaataaatttagggaatgtctgtgggattttctcccagcatgatcctttcttctgttgtctactatggttactataggagcagccatcatcttgtataaccatatcccagtggcagtctttagtcggatcagagatgggcacttgactcaaaatgagcttagtggagcactaccttaggaaaaaaattttaacttggaacctccctggtagctgaagcagtgggaactttcactgggcatatttgttggtgtcagtaagaggaaattaagttgacaatatagagagcagatacaagagtcagaaaaattatccagacagtgcctgtgattccagttgttctggcggctcagtcttaagccagtagattctttttgttgacgctagtttgagttggatttctgtggcattttacaaaatgttctaatacatttgctttagaagggtaaagattaaaaatctgaggccctgagagattgggtaagctggaaagtggtagaactaacatagaacccagatatatttgactccaaaacctgcatatgcaaccattaagattcatagtcttgaagcagagtatttctggaacttctctctccatgtggttctctccaacagaaatagcagcaagaacaggtgaaatgatgcataggtacctgcttgttttagttttgtttccatttttcttcttatttttttggtataaggacaggggacttaataagaaacaataaggagatcttcctttttttctacttgaatatctccacttctattttcaatatataccctgtccatcaagttcagactacatatttaactgggactagttatcaatttctttgctaaagatgactggtttctttctgcttcttcctttgcatcctccaattctattccccttaagttctaaaaataagaacaccttatgtagaacaccatatatagaatctgtaatttcttattttcattatcatcattaccattgtcactggcattgtatttactgagtgcttgcatgggcctcgcatgaattaggcaaatcaatattatctcatctaagttttactataaagccctgtaggcccacctcctctttgcctcctactaccattcttattattgatatgccattgttgttatggttctctccattttgtatatgaggaaactgagcctcagagagcttttctgacctttcccaagatcacatacctagtaagtgttggtgcccagatttgaatccagttcaatctccttttaaagttcatgcatgcactcatgctaatattaccacttatgccagattctgtgatagagctggttctcacaactgcatagggagagggagataaacagatagtgttcttactagtctagtagagtgtctggctgctaggctataagtccaaatcagtgtttaaagcgctatggaatcaactagggaaggtaaaatctatagcaaaaatccctcacaactggtgcaatacctagattattttgtagataggatagtggttctgcctgcaagcacaggacttaaattactgcttgggaattccagaaacaaaatcatccagacattggtagagggaaaggcaaggactggaaatgttgtcagggctccagccaagaatataactttcttttaattagtgttagcatagtatatctttatctatccatttacttttaatctatatgtctttatatttaaagtgggtttcttgtagacaacatatatttgagtcctggttttggatacaccctgataatctttcttttaattggtgtttctagaccattgatattaaagtgactactgttatagttaggttaatgtctaccatatttgttactgttttctatttattcattttggacatatcacattttatttaagaaatcaattccagatgaagtgtaagtctaaacttgtaaaataatacaactggaaaattaaaacataggaaattattttcatgattttgagtagacagttatttcttcaccagaactccaacagcactaataatgaaagaaaatatttgataaatcggactacattatgacttgaaacttcccttcatcaagggacatcattaactgagtgaaacagcaagccaggaagtaagagaagatatttgcagtatatgtatctaacaactcaaatttagaatcaaacaaatcagtaagaaaaaagatagacatagaaatatggtcaagagacttagcaggcacttcacaagagaatattcaaatacccaaacacatgaaaacacatcttaattgatcatcaaggaaatacagattataaccacaatacagtactacaattcactcactaggaaggctaaaatgaaaaagacaatctcaaatgttgacaaggataaggaaaccctcatacactgctattcggaatgtaaattggtacattttgaaaaacactttggcagtttataaagaaggtgaacatatatcaatattccagtcattccgctcctagaatgctagaatgctgctgtatgttatttttcttgatctggatgataattacaaggatgttcacttagtaagaattcactgagttttacactaaatactcctgtttgtgtgtcatgcttccaaaaaggtttcttttaaaatgcatataaatagaaaaactttcttgtgaccatgaggctaagtgctatgtttcttctgactgagctattacagttattaaatgcttttgatcaaaccagaaaaatgttatacatttaaataattatgaggaaaaattaaaatgtattaaaaatcccacttctaatgatgcagatggtttttgtttgtttgagacagagtctggctgtgttgcccgggctggagtgcagtgttacagtcttagctcactcactctgcctcctgggcggaagtgtttcctaccacctcagcctcccaagtaggtgggactacaggcacacgccaccacagccagctagtatttttgttatttgtttttctttttttgtagagacggggtttcaccatgttgcccaaccttgtgtcaaactcctgagctcaagcagtccactcgcctcagcctcccaaagtgctgggattacagatgtgagccaccgtgcccggctggatatagatggatttttgaaattagttcataccatgaattaatattagttatttccagaataaagcttggctcaccaccaattaaatctctatttcttattttcagagatggtatgttaatgggaatgaaaggaattttcttataataaggtcattcaaaattttaaatttcctttagagttatatggcacaaattaaatcctgaactatcatcaattttgcccaatgatcagctgactaattgatgaagtccttcttcagttctgttgaaaggaaaacacaggaaatcatttgctatgcaggatttccttcccagcctttcctcctttcctgggctaggatattttgaaagcccctttggctcctgggaggtggtaaactctggggcaatgtacccgggtaagttcagggaaggagaaagtggtggaagaggttagtgaaaggaaggcaggagagaacctccctcgaggtttctcttggataggtctggggaagaagtatgtatggaactgaggatttgaaaatagattcctttagaattcttcatgcccactattcccggggcagtctttgtgtactcccagaggcaagtgacccttgtttgaatacagctgactaaggacttctcaggacttgctcctcagactgcatctccagaggcctctctgggtcttaaacacctgtgcagctgctgacttgtaggggctgaggagctgcaggccccagaggtgaggactctctgaaaccactagagggagccccaactttctcagaggactttggacaggcctgggcaactgggctgagtcttactcagcacactgtcaactgtacctccgggacactggatggatctagcccttgcccacctccagaatgaagcaagggctaagagtgttcagagaaaattgaatctccctggagagaagtaggtccctgcacttccctgctacatcatttcaggcttctctgtgacctcttcccgggtcggttttcagtggggacagcgtgcaaggtgggctgagttgcagagggccaacaggtagcaaagtggaggagacacagcactagaaaagagaaaaaccagtttgcagagatgattcctgggtgttgaggtcagttccacccttagaggtcaccagatcccagaggtcctcactatgtatccagctttgaagttgtggtgactgatgtgcaagggcccagaaaagcagatggaagaagtgctagttcatgagttcctgctcatggagacccagaggtcttcgactcctcgaaggcttctggcagtcccggagacatcaggaaaattaggaagacaggcattggaagcttctacattgagggaacatatggagattttgtaccactcttaattattggtgcagatttgccaattggatgaaaataaggtacatattaagttcacatttaaccctaaaatggtcaggcccatctattcagagagtgtatatagatacctagctctgggccagcctttggtagaattactaggcttctaaggcaacccctcccctctggagaaagtacaggagaggtgctctaagatagtagttctccaagtggggttgctggaacatcagcatacctgagaacttgttagaaatgccagttttctggccctactccagaccaattgaagtagcaactgtggtatagggacccactgataggtgtttaatcaaattctggattccagaagctgttctaagaggacactatgaagtgagtttgtgggggctacacggaggaaacagggtgtgatgccaaagaaaggatttggacaggtcaggaggcaatattaggggctaaaaacaaagcataattgaagacaaattcacagcctggttcagcatctagtatatgtgagctggaacagaggagagagagtggctatcatccagggcaaggcgaagtaaggccttgaggctgaaggagggagtgggacttcaagggtatgggaactgggagctgttgcagctttacgagtggaagagtgacattgtgaccattgtatttgagaaaaattactgaatatttggcacagaaatctcaagctgggatgttttgaggattctgcctttccaggggaatttcccagtgtccatcctttcctgtgactctcctgcttcagaatgggtagaggaggggcaatcagactgtatacagggacaagaagtgctcctggaggacatggcaccacctgttaacaggccagctctttcttaaagaattcaggagtgaaacctctgctgaggggatatcctgagagaataggtttggaaccctccaagaggaacaacaacaaaaagcccagaccatcctaagaagggattcctggacttataggagacagccaagagaacacctgcacgaggcttcaacatagagaatgccaccaaaataaggtttttacactcttgtcacttacagcagaatgggcccaaggtgaagaaataaaattagaataaccccttttatggaagctgagggcctccctaatggaggccttggagatgggcagatgcacgggtacaatctgaagagacaaccccctttagggatgagatcttttgctaccaaactcagagtccctctgaagtgtctgctgcagctctcgggttggggtcagttcctttttgtcatccaaagtctcaccctgagatacccagagcctgaggagggacaagggaaatctttctaggcattgcctagctcttcctccctacttcatccctaactcccagccctggagctgggagtttgcttcccaaagctgacctggcctccttccctccctcctttccctgggttgtccagatctaagggtgacattgtccttctactgctctcaaacatggcttctgacctctcccctcatatctcatgattatcgatccttgagagtttccctggctccctgtcccttcttccttctctaccagtgtcccttgtctgaacccacagtggtaggaaggagtgggcagcatggacggagaagaggaagttaaagaagacaagaatgagaatgggagggctttgctgttgagccagggacaggactttgtaggtggctccctcctttaggttcctccccaacatggtcatcaccatgcccacctacctgccatttactatttttcaaggaataaagaggaggtagcaaggagggcctttaacttacttgacaaagactaggccatcattcttttttgtttattcttttctccccaaccctgcctgccattctcagttattgtgcccattcttctgggaacagtggaacacagtaacactcactaggccctgcctctggccccctcctcctctactgccctgggaaaatggaagtggcaaagtggcaggagcaagattggcttgtggcagagggaacaaggtaatgaaggaggaagaggtttcttgggagtggagaaaaacctagaagaaactttaaaaggcccatgggtagaagccatgtcattgtctgctgggagggaaagatggagacctgaatctagcacagggtaggcttgacccactcacatgctcttgtgcctcagccaccgcaaacaatggcattctgtgcctgaattcctgacttccaacctcaggcctcacaaatgcacacaggtggaaaaagcctgcagtcctctgctctcacagaccctttcttgtctttctccgctcagcccatcttctctgggagactgaaatatgaacccacaccccctcacacttggttcaggtcttcagttccatctctgcctgtgggatctggagttggagcattccgcctcttcactctgtcccatgcatgaataatctgtccatttctctagtccctgagcttttgtatgctgtctttctcttgtgtcctcagaaaggcaatggagtttatgtctcttagccatgtgctgaggaggtggtgggcagatatgcagtagaatgacatctttctcctttatctcattttgccatttctttccttactgcccatgtctccatggacatatgatttttctctttttctgtgatggcaaggaaatgacatgagtagtcaggatgcataggcaatgtggccctgggggactgtgtcagagggctgaaagggcagacttggcactaatgagtcagtcagaagccctgacattctggtcctgttctacaacctcagggatgagaatatgcttttttctggagcccttgtactcaaataatggtggagtatctgaacttggaataacaaatctcaattctctgtttctgctcagacacatctaaaggtaatcatttcctgccacctgccataaataattgatctctcaaatagaaccatgtttcctgctctcgaaccctgctggtaatgatgccagtgtagatggacctgcacgataagctttgaagctaacagggattataacaggggtaagcagctttgggaaaatggagtgctcttttgctgacttgtttctggggactttgctgatcctcatgaggagcaataactgctgggtccattgatctagtacatccttgaatttttgagttaacttcctttctttctaaaagctacatgaataaattctttggaatgatggtatgctagcatctatccgggatgccagcaaacatggatttacacaaagagaatggagccctctgcaggaagttgaatttccccttttaatttcaagggcataatctcagatcattgtagggaggatggtggcacagtcataatcttcagcctttgggaatataatgagatcttttcctcccagatcgcttcctcctcttggcttagcattttcattctttttagtggccagtttatatgatcacctctttcctctttcatttctactttattggcttgaggatgcacctaagagcataaatattgtctacaaaaattccacccccagccatcacctcccctccattttcaggaatgtcaagttgggggtttctagtatatttttgttttgttactcatgagcagtatacctagctgagttgggacatcagtatattgtttcaggctgactagagaggagcacctccagaaagaaatatcatgcagaaggctaccattctgaccattattagtgggcctaaataccagctagaaatgtgggaaaactcattaatgaaggatgcttaaaagccggacaagtagtagacaaagcttattttctaataactagctgaaagaagaatgaagaaagttccaaatgtttaggaaacatctactgtggccagtcattgtcaggcatgctcacatgtgtgcatttaattctcacagtagccctaggaggtaggaattattatgctcattttacaaatttgtaaacaagattagaacggattcttggtagaaaaaatacctgaagacctctgttgcaaataagtgaacattggccatttctgggtgatttggtaacaaagttttgtttaatgtctaaatttaacgtgaaacgtcattttcattaaaaagtacaattttatgaaatactaaatatatagaagccttggccaacattataaaccaggatctgacataaatccataccttccaacttcctttgacatcacattatcttttcataacagatagtcacattggctaatagggtaaagaagaaaaccaataacatcagaaaacaattccatccagccttgctctgactggggtcatcactctaggccacatgccttattttgctctgacacttcaggatgtttcctgctggtattagctgtgcatcaaggctaagaggtcacagcgctgtccttgccattctcaataaatcagttttgcaaaatctccaggccttcttgcagaggattcagacatagagggtgatataggtgatatagttttgctgtgtccccacccaaatctcattttgaattgtaactcccacaatgcccacatgttacaggagagacccagtggaaggtcattgaataatgggggcgggtctttaccatgctattcttgtgatagtgaataaatctcacaagatttgatgattatataagggggagtttaccctgtacaagatctctctttttgcctgctgccatctgtgtaagacatggctttctcctccttaccttctgccatgattgtgaggcatccccaattacgtgcaactgtaagtcaataaacctttttttcctatataaattacccagtctcgagtatgtctttatcagcagcatgaaaacggactaatacatagggttgtagcggatcagctataaagatgggcctccctttaggccctgcagcagtatggcaccagtttgaaagcctccatccagtccacataatgaaaatcagaaaaagaacattcaccacttatctgtgctttctgcaaagaaacagataccggggtgaggaccaagactgccttcttcttcatgtcattttgtatgtctgtgtagacagagtcggcaagaagggagatatgaagtgcttgcaaggtacctagatctgtccttgcattcagacattcccttgctacttgtaattccttgacagaagacattgtggtagtgggtacttaggagagaaacaactagaatggggcatttttcccaaggcaaacattgaatcctctcttgctgttacagagtaaaattccctgaggcctgggcttggtttttcatgcagattgaatgatagcttttaatactgtctctaatttagtaattctctgtgagctcccttgagaagagggcccaggtactcttattttccatctctcacaaagaatcaataatgaaactaagtattgaccattatatatgtcaagcatatgatatctgaagaatttagatggctgggggcggggaaactttgaataaccagatacatacatatagatagataggtaaagatatctcatagctccactttcatttttttttgtttataaaatattcactatgtgtaagtcttgtgctaagcactgaagatgcaatgctgaataagacagcgtggattcctttttgtgaagcataagatgtatctctcccaaatattctattgatgacagacttctatcattagaagcctcataattttgtattctttcatcacttctaaggtcaagttttacatggtaaccttcctcagtttagagacatacttgttttcttactttttagatatttgtcctagagtttgcagtatacatttacaagtaatacaagtcccctttcaaataacactataccacttgatgggtagtgcatgtaccttataataacaagatattcctaattcctccctctcaccccttgtataatggctatcatttgttttacttatacaaaactatacctaagcatatacacatgagcatacataatcaaatatgtttttgctcttattttgaacagattgtcagattaagaataagaaaaagaaattttcattttatgttcatttatttcttgatgatgctccttttttctttatgaagatcagagtttctgacctgtatcatttcccttgtctctgaaaaacttttttctaacatttcttgcaatataggtctactggcaataaatttcctctttttttttcttgcctaagaaagtctttatttctctttcgcttttgaaaaataatttcacaagacacagaattctagcttttttcaagaaaaaaagtgagtttctttctctcaacccttcattacaatggtccctcctatccataggggatacattctaagacttctagtgcatgcctgaaactgaggatagtactaagccctctaaatagtattgatatggtttggctgtgtccccacccaaatctcatcttgaattgtaactcctacaattcccatgtgtagtgggagggacccagtgggaggtaattgaatcatgggggctagtatttctggtgctgttctcgtgatagtgaataagtctcatgagatctgatggttttgtaaagaggagttcccctgcataagctctctctttttgtctactgccatccatgtaagtcatgacttgctccaccttgtcttctgccatgattgtgaggcctccccagccacgtggaactgtaagtccactaaaccctttttcccatataaattacccagtctcggttatgtctctatcaccagcatgaaaatggactaatagagttgtagctgatcagccataaatacaggcctccccttaggccctgcagcagtatggcaccagtttgaaagcctccatccagtctacataatgaaagtcagaaaaagaccattcaccacttatctgtgcttcctacaaagaaacagatacctggatgaggaccaagactgcctcccagattgaatgatagctgttaatactgtttctaacttagtaattctctgtgagctcccttgagagggcccaaatactcttactttccctctctcctgacaaagaataaagaatgagtcttgactgttatatatctgtcaaacacctgatactggaagaatttagatgactggggctggggaagcttcgaataaccagatacatacatatagatagataggtaaagatatctcatagctatactttcattttttttgtttataagatactcgttatgtataagtcttgtgctaggcactgaagatgaaatgctgaataagacagcttagattcctttttctgaagcgtaagatctatccctcccaaatgttctgttgatgacagattgctatcatcgagtgcctcataattttgtattctttcatcacttctaaggtgaagctctatgtggtaactctcagtttagcgacattaaacatgccttccttcttctgtggcttttctggtgtctaagacggttcaaccacctactaaagtttcttctgcatatgatacaagtataaggcagttcacctgtgtgggttctctggtgtttaataaggtggaagttctgaatgaatctttttccacattcatgacatttaaaggacttctctcccatatgaattatttggtatgtgtgtagatttgtgtcatgactaaagcatttcccgcaccatgagcatctatatggttttactctttgatgtgtcatgtagtgcgtattaagatctgaactccatctaaaccttgtgtcacattggtgacgcttataggtcttctgtttagtgtgaattctctggtacttaataagatcagagctaactgaagcttttcccacattcctgacatttaaaaggtttctctcctgtgtggtgtttcccatgaagacacataagttttggaagctcttgtttacaagtggcaagtttctttacttccttggaaaagctcagtgctgtttctgtaccttgtgtatatcaccatgattttccctgcctgttgttttctggacaatttcattctggtctgttttgatattttgcatcctagcatttgtatttctgatgcagaaaccgatacaggatgatcatttccagtgtcatattttagctttaaccctagagagatgacagcttcacagatactctgcattacaacatcataaagtcttctcaggaggatgcaataattgacattcttcctcagaaaaatacacaaccacttcttcaaatgtcagcaaactctgggactcaggcaggatgagctgagatgccatcttccagtctttggtgcttttctgctcagcacaggctaaaacctgttgagcatacaagactctttcatatacaggctgggtttctttgtgagtattccagcctagctgttcttgtagtacccagtatatattccaacattccttctggaacactcgctttggttagggctccgctggtttatacttgaagtctggggtcactgctgttcctcccaggagcactgccttctctcccagctcatgggctgtgaccttattctttgtttgaccaggttctctctgcaagcgtttcaccaagaccagagcctgttttgacattctgtggatgatgcttctgcacccagttctgggtatccttgtgcaaaatggtcaggaactgctctaacatcaatatttccaagatctactcttttgggtggatctctggcctcaatcactgatagcataatttctgaagtaggctgatagcctctggcgttccagttgcttcatcgtatcagaaggtctggaagtgcctgtgagtgccctcaggccgagatactctatttatgtggtgtacttcttactgggactggagttctctctcacagacccattagtctcccacatagcccccatctgggggttcaagtatgcatctgccttcagctctctcatcattgtttgctctaggaacagttttaaccctgtgtgtgacactgacacccacctggggccacctctgacaaatgagggtgcatcaggtttggtacaatatcaatgagtagatcttcctaagagcacttcagtaagctctggcttccctggaggccactttcctctttctcagcttgactaccctctgttgccatgtctccctgctgctctgggtattgaagctctgttcctgcgccacatggggaagcggtgtcaggaaagcgcactatgcctggcaagtgaagctccaagattttcggagccttggaaggggccctggaagaccagttttcccattctatccctccacctcccagagaccttacccagattcactattcctcggtcgacgtctgtctattttctctttattgcgcttgttctttgcttctgtttttgtgttccacacttttgctgccttttgtggtttaaattattttatatgattttatattctctccttagaatattaccatgcttgttttcttacctttttaggtgtttgtcctagagtttacaatatacatttataagtaatccaagtcccttttccaataacactgtaccacttgatgggtagtgcatgtaccttataataagatactcctaattcctccctctcatcccttgtataattgctatcattcattttacttatacaaaactgtatctaaacatatacacatgagcatacataatcagatacatttttgctcttgttattttgaacaaattgtcagagcaattaagaataacagaaacaaaagtctttattttaccttcatttgttccttcacaatgctctccttcatgaagattggaagttttgacctatatcatttcccttgtctctgaagaacttttttctaacatttcctgcaagataggtctactagcaacaaattttctcatttttttcttgcttaagaaagtctttatttttctttcacttttgaagaataatttcagagggtacagaattctaggtttttttctagaaaaaagagttcctttctctcaaccctttattacaatagtccctcctatctgtaggggatacattctaagacttctagcggatgcttgaaactgaggatagtaccaagccctgtatatactattgttatggtttggctgtgtcccactcaaatctcatcttgaattgtaactcccacaattctcattccaagtggaagtaattgaatcatacatggaggtctttctgttgctgctcctgtgatagtgaataaatgtcatgagatctgatggtttgataaagaggaggtctcctgcacaagctctctctgtttgcctgctcccatccatgtaagacgtgacttgcttctccttgccttccgtcatgattgtgaggcctccccagccatgtggaattgtaacttaattaaacctctttttcatcctagtcttgagtatgcctttatcagcagcatgaaaatagagtaatataactatattccttactatacatacatacatacatatgtatgaccaagtttattttataagttaggcatagtaagatattaataatattaatgaaatagaataattacaacaatatactgtaataaaagttatgtaaacatagtttctctctcagaatatcttatggtgttataccaaacttcgttttgttgtctgttctctgataagtgagaagactattaagtgactatatacatttatagcatataaacatatatacactggacaaagagatgattcacttcccaggagggatggaatgggatggtgtgagatttcttcacactacttagaatggtgcatagtttaaaacttatgaattatttatttgtagaatttttcatttaatattttcagaccactgttgacagagggcaactgaaatcgtggaaagcaaaaccatggataagggggacactgtatttcaccccagtctctttttattgcgtggtttctgaggggaagttggatatatttcttatcttttttcctttatatgtaaggtgtttttttccctctggttttcttttaagatttttttccttatctttgattttctgcagtttgaatacaatttgcccaggtgttatgtgctttttttggtacttgttctgcctggtgttctgtgagcatcgtggagctgtggtttgttgtctaacattaatttggaaaaattctcagtcattgttgcttcaaatattgtttctgtttttgttttttttttttctgttgcttctttttctgatattcccattacacagttatacctttcatggttaacccacggttcttatatattcctttttattttctttttttttcctctttgctttttagttttggagatttctattgacatattctcaaaaataaaagttccgatatttttttcctcagtcatgtccaatctattaatgagcccatcaaaagcattcttcatttctgatccacttgttttgatctgtagcatttaaaaaaaatcctttcttagaatttcatctttctgcttatgttatccatctgttcttgcaagttatttttttcgataaaagcccttagcatattaacgatagtttttaaacattcctggtctgacaattccaacattcctggcatatgggactctggttctgataccagttcagttttttcaaactggggtttttgctttataattgttttccttgtaatttcttgttgaaaggaggacatgatgtactgggtagaaagaagtgcactaaataggccttcagtgatgcagtggtagggtgtggggggaggggaagtcttttgtactcctctgattaggtatcacactttttttcttttttctctttctttcttgctttttttttttttagacagggtctcactttgtcacccaagctcatgtccagtaatggcgtgaacagggcttgctgccgctgccttaacctcccagccttaagcgatccttccgcctcagcctccaaagtagctgggtctacaggctcacaccaccacaccctagctaatgtttgtattttttgtagagatggggtttcgccatgttgcccaggttggtctcgaactcctgaggtcaagtgatcagcctgcagcctcccaaagcgctgggattacaggtgtaagtcaccgcgcccagtctaggtctcagacttttaatgagcttgtggccctgggctctgaacttcaccagtgcttcacagtttttccccaacttaggctggatatgatggctagggtggtctggagttaggtatttcccttcccccaggtaggttaggctctgataaaattccaagaggttagggtctggagggcaggccttgcaaagaacagaatatcctttctttcatatttcaaatggttcctcttccttccccactgctgaaagtacaggggaatttttctctgatagtcgctgtgagggcctggagataagactcacagaagggtgagggtcctccgtggctgggttccctggaggttttagctctcagacttgtccacaccgagcctccatcagtttatcaattgcagctcagatttatgtacctcagcattggttcctgaagaggtttctgctcatgaattcctcctttggtaagttgtgattctctgtatttgcctgtctgtctctccaatttgtggtgtagggtttgccctaagacttcacttcactgacagatctaagaagagttgttgatttttcagatcactcagctgtttgcttgctgttaggatggagtggcaacttctaaactcctgacatgttggagtggatactggaagttgaaaaagggtttgaaacctaacaaactttcaggggaggggcatagggagaacaatagacacctcagatacaactgtggactagagaaggaaagacttgtgtccttttcacggtgaagcctgggcagtgggaagccgtattcagaagtccccctgtcccccacagcacaaaagcaatagagctgaactggctctaggtagataggccattgcaggtagacgggccatggcaaccttgcagagttccagtcaccccactgtggtgcagagaataacagaatcattttatctttgtcactgagggtggtatggacatgctccctcagcagacctgatgaggccttggggttaggatgagggggataagatgagattgaaagatgaagctgatgactgtaggccaggtgcctgaggagctgagtttctcataacctaacatgaagtgtctgcttccagagaggatatgagcccgaggtagaaatagctggggtatgtcctgagaatttctaacatgttcccaggtgatgctgatgctcctaaatctgggataacactttgaaaaccactgcattgttttattccaaacttcctaacctcctattatttgttaagtataagtagatctatgcataatcaaaagatacgttacactacccaattccacaggtggtgtactctcttgtactatatggttaatcacctagatgtagcaaggaaaatgaacactggtatctcccatctgttggttactgctattttttccccttggtgttgtgcttttatgttgacacttttctttctttcttccttcattttctttgttctccttactctgatctttccttatagcctctatttgttgtaccgttttttttctatgttctgtgaaatactgtgatcggtatgtgaaaataatatcatttaattaagctttaaggcacactaccttgcatctagcctgagaacagcacaagcctgctgtaatttctatgattggcctcacttaggagattttatttgttgagaggcacctgaaaaaccttagcaaacttggttcagaaaaaaaaaatggtggctacagtaataatatataactcagagatttgagacacagatgatgtagttaccataggaaatttttttcctctttggctgttattactcgtactgtctacaagatctgtccaagaacagtgtatcatctaaaagaggggatgctggacttaaaaaaataagtgaaaaagaaaatttaaattagaagtcttaagtcagtcattgtatccatattgatattcttaactgaaaaagaacaaaacccaggaaggcttttatttatcgattccatgaagaacatatttcttttgtgtcatggtgatcagtgatttttgaatatatatatctataatatactcaaataagatttcttggtattttttggacttaaaatttttggattgtatgattctgagacttacatgcatatgttcatctcataagatggaaaagcttttgctcaaatttttttttgtccatgttgaaatgagaattaaaatcgctagagggcactgtggataagcatttgtagcaaagatacctataggagctagaacttgccagaatttagttgtacaggaagtcctcaattaccgacatgtactggtccaaaaatgtgcttataaattaactcttcggaattcaggattcagagtgtattttcctaatagaaacaataaaataagtagtagtataacaatttcccaagttgacctctaatagtctgttaaatatatatatgacacagatttgtttgttatgtgaagggaagcaacaataacaaaaacaaatattatacacctcattgagatataatgggatttaccaaacaacaaataagactatacaactcatttagatataatgggatttaagaaaattttgatgtagagagttttattttggtgtgaactggcttaattacaaaaacccactagcttggaaatattacagagttgcaatctctgtgtctcaaaaacaagaataaaacaaaatacccaggaataaactgttaatctgtgggtcacccccgttgaatggattgatagcactaccccctcctcccaactcccttcagtttttagtggagtggggttcatacggttctgcctcccctgaaccccacctggctgctttgttcttatgtccactacctctcactactgctgcttctcctcctggtgctgttcagtggcatgtttggcttctttcccttttctttaaaggcatccagatatccagccagtcccagcctctgggtgaagccattcctcctagttccaagctagcaagggtaatttagcactgtttgcttgcagacctaactttgggaattcactcagttcacctcccaggtggaaacgggaccatccctatggccacagcagagtctccctttctccctgtgtcccacctgccctaggaatggttcccctttcctctttctttcttcagctttcttccgtctaacttaattactgttttgggattatttaattttttttctctagggctttcactacgtaagtctacatttcaatcaatgagtgttttaaactagatgggaaacaatacatgacttgacagttaatttgccctgatttcttgccacacttccctttattctttagtggaaatacaaagtcacagttttctttcatcttttacgagctaatgggaatgtaggcagaggtcaatggtgaacagagtgcctgaaggtttgtggatgatgcaaagtattgggagagtaccctgagccccacaaaccacctttataatttaggttgcatcagtatcacctgggtgcctgccaaaaatacagattctgtgaggtgttaggtgggactcagaaaagtgcattttaattaagtatccttgattattctgatgagtgttattctggccacagatataaattgataaattatataatagtccctccatccttaagcctcctttcaggcaaatgtgtcatggattttagagtgttatcttttgtttatgggtttttgttttaaggtggcaaatgtgtcactatcaccaaggagatgggaaaggtatgattactttgatttttggtgaggttgtgaaaaaataatgtttagtaaagatgagcatcaatctgatctgctcatttagcaggatacatgtagtatttccacctacacttttcacaaaaggagaaagcattatttatgaagccttctgtgtgtgtgtgtgtgtgttttaggtgataaataattgaaagtaaaggttggcatcactatgccatatcaagcttttccttttctttctttcctttttttttttttttttttggtgatgagacagatggtatttttttctatagatgccaaaaaaggaaaaaccccaaacccaccaagtctcacagttgtggaaagaaatcttatatgatttctaaaagcaaggatctgctggccctcctcttaccccaaagactagggaccatgaatcacttggaaaatagatttgtgtattctgagtgcttgtcactgggttggctaacttagaggggtttttagttgaaaccagggctttctaagtatgcacttgataagcatgtaagaagtaagaacaaaatatatccagctgattaataatgatatatttcaaatatactggtgtttaaatggatattagacactatgttaccctctccaccacttcaaaatattataacattttaggctttatagtctttcatgacatcaaaggtaatgttattatttaaatagaataaggacatctgttttagaaagagaaaacaggttcttcaatgtgtgttttggctaggcaaatgatagcagaaaaaacctctaatgcatcatttttaaatagatcattgaaatgacagagttttgatttttttcaatgttctttttaacatctgacaagtctaagtacttctgtctacataagtcacatactaattagtaattaaccactgttatttaattagactctctagttggtacatcatgcattgatcactcccaatttggtatgtgctggctgctcttggtgactaggccactctgctggggttcatttcatgctgtgtgttgcagctgtgcccagacacaacctttttctgcctttgtcttgaaattagataagaaacataaaaatgtggagaattgaactaactctagttagtcaactagatttccaaaatggttacaaaaggcaaaagtgaatttttgctgattgaatgaaaaaaggactctttcgttcaaaaattcatttttttctccttttttatgcttcagattttctttcagatgatttgataatgatatgtatgctttaaggaaaggtcaaaattatattttagacctactgaatttgcaagtgttctaagcatgcaataaaaacatgtaaaatctctacactatattagatgaaacacatttgaagtaattttaattagaaatggccaaagtaatttagagacaattgttttaataaaaatggtacatttcttagattatgaaactaactttttgcactgtttattccattggttgttacataaatggagacttctgctattatgaattccttaaaccacatagtatgtcttaagcaactcctaggaccttatcaatattttatccagaaagtactcttgataattaactctactgtttttatttttctttttttctttttctttcttttttttttttttagaagaagtcttgctctgtcgccagtctggagtgcagtggcgcaatcttggctcactgcaacctccgcttcccaggttaaagcaattctcctgcctcagcctcccgagtagctggaattacaggcacacaccaccacacctagctaatgtttgtatttttagtagagatggggtttcaccgtgttggccaggatggtcttgatccgcctgcctcagcctctcaaagtgttgggattacaggcatgagccactgtgcccagccgattaactctactcttgtagctgcactcaaccctaagtggacttcacctaagtcagtggttctcagctctgggcagaggccagggaaggaggagatttatgtattcaaattgcctatagagttttttgcttgtttagttgtgtttttgtatgaaagaatgttgtctggggtggggctttatgatgaatggcagccatctagtgtgaccagaccatcattttcccaggatatgatgcacacaaaatcctgagacaaagaccatctcaggcaagtcctgtagagcaggttgcgcacttccctgaaaagactagtcacagtcaattctcactccccaggagacccattgtagtttcacagaaacgctcacttacagcagccctgacagagtggcagagggagaaacagaggcttcaggagggtactggctcattcaaatctgcaccattaataagcactggaagtaggaccaggtttcagatctttagcttcctgatctggggctctcttctctatacatttctctcctcttcctcctcatcttcctctttcttcttcttctggataaagacatttaggcaaataagtttaatgtgctcattatttcaagttttatgtaatgttatttcataaatgtaatttctgattaattttcatttattctagttggcaggttcattaatcagtgtaaatatgtgtagattataaactatgcagttggtgcctttaatattacatagatatgtggaagtccttccttttattcttaattatcaaaagatggaattctgtctctagaaagttttggaagcattctaataaaggctctatgaacgtgagtaatgaatccccccaaacttctttgatttttcctcattccacatatgacaatccccaatttgagaaaaaagctcttttaaacagaatgaaaggtctgtttgttcatattttgtaatagaatctggttgttaaaaacactcagcaaatagacattcttcctcctactacctctgtgtagcatagggaatggtttagtcagtaatggtgttttcttagaaatttctaataattgtgcatattaaaaataaattttaaattcagaacaaaccaggattaaaaaatcccaggttttttggtcaaattcaatgatcaggtctatgatatctttaataaaagaaataactctttcaatgaaaataatatggtctgtgttagcagtatccagatattgttgtcagtggatcattattccctcacagttattttatgtcttttttactatatggagccctatctgacaagggtcagcattctaaaagtactacatggggcagtggttatgcctcttactatccaccttcgatgtattctcttggtcaaagaccaactgtgaaggatttataaagtggtagcatggcatagttcaagaactcagtttgagccaagattcctgacttctcgtgtattgttactgtcatctacttttgtgtccctgggacatcatttattctgatctacgaatttaaaggacttccctaacattatcatttgtgccttttaaccctaaagttttatgtgagtatttaagcaaatatgttgaaaactttgggcatgcactaaggctatgaatgctgatttaaacctagggctagggattttttatgtaaatttcaatgattccataaacattctgtagttcttgatagggtattttatacatattttaaggagtcaacagtttgccagaaatagctagcagccagaactcagcccacaatctacacgtcatttggagaacatgctaaagacagaatagaggctacaatacatagaaatggcaaaatccaagatccagtttatacatcagttggttaagcaaataacatataccatgatttgtggtgctagctgagtttgatgataataactatagggcttgcaaaacccaggcatttatttctttctgcttgtagtgtgaaatcagggtaatgaagtagtttgttaaaaatataaagaggaggaaaactcatggatttaactattgtttttcactgtctcacagattacctgaaattcagtcagtagttgagagatttgtgtgtgtatatacgtaaataaacttattttaggatcgggggtacatgtgatgggttgttacataggtaaactcatgtcacgggggtttgttgtacagattatttcatcacccaggtattaagcccagtaccaaatagttatcttttctgctcctctttctcctcccatcctccaccctcaaatagaacctagttagtgtctgctgtttccttctttctgttcataagttcttattatttagttcccacttgtaagtgagaacgtgcgatctggctttctgtttctgcattagttttctaaggataatagcctccagcctcatccatgttcctgtgtatagtgttatagaacgggctaaagaaggccctggtgtattagcttgatttggcctctgcgttgtttacttcttcatagcaggctagggtggttagctagaaccaaactcaaattcttacacatccagttgctttaaatatagcccaaataagcatatttttagacacttagagcttgcctgttttacatagcttgtgaatctgcacccagcatctgctaaccacagataagacaaactccagcaataaagacatgaaaccctgctgccctttgatccctctaacccaaatagtttgctgctgaatgccctaacataggcatgtaagccacctctccaagttctcctcccctggagatcccttgccctattctccttctgagtagtgaccacctgccactgtctctggaagtactcttgctgggaggaacttcctctctcatgcaaccataagttgcaataaagcatgctctgtggtagtgcctcttggggtcttgccttttctgtggtcaacccccaaatccttgaacttaccacatatgtgtaatatatatctatgagtatgttatttaaaaataataagccaggtaggtttgtttctgccttggcatgaagaaaataaatctacatgaaggatgcattaaaaattgttccttcatagtatgaaattgtaatttggttcctgtttttatgtgaacattaaagacaacattatttagtgaaacactaaaggacttaaagtcagaagccttgagtttgagccttgattactcattagctgtgtgaacttagacaagccatttagcctctctgagctgtaaaataatgatgatactacctataattatttttattgaccaaactacaatacaaaggtgacagaaaggctgtaaaacaatgtaattaaaacagtgtaattaagagagtgaactctcctttgaaattctggcctcatgacttgggcgtccaaaggggaacctttttgaacttgttgttttaaccgtcaaatgaggataacaatactacctcattcatgtggttactctaagaatgaaaagatgtctcctttaaatgtttctaatgcatagacatgcatattatgtgtgtgcttcaatagtaaaatgaagtacaagtgtcatctaaagcatttacaggtgtcatgaggaatgtgagcataataaagaaggatgatgttgaggagggggtgatattcagttttaaaaaagccatcaagtctttaggcagtaattttgtattgatgtgaaaagtgtgaaatattaggaagggataacactcagcaataaaagtttccccaaatcatcaaaataattgttgtatgttcctttctcatgattcacatagatatagacttcacacatattatacttaaaccaaaaaaatactacccaagtacagagatgaatttaaaaggaaaacaaggaggtttcattttaatttaatttccagacagtggattacatcaatgaggtctggcgtctaatcaaaaactgcaaataaaggaagcagatcaattatcagactccagttcagtggcttcaacatgatgccgagtgcttttattcatgttacacagatgaacccagccctcttaacagaaaaaagcaaagactgcccttgcatgaaaacaaggtgacttagttccctaaaatccagtgggaatgatgatttccagtttcatccatgtccctacagaagacatgaactcttcattttttatggctgcatagtattccatggtgtatatgtgccacattttcttaatccagtctatcgttgttggacatttgggttggttccaagtctttgctattgtgaatagtgccgcaataaacatacgtgtgcatttgtctttattgcagcgtgatttataatcctctgggtatatacccagtaatgggatggctgggtcaaatggtatttctagttctagatccctgaggaatccccacactgacttccacaatggttgaactagtttacagtcccaccaacagtgtaaaagtgttcctatttctccacatcctctccagcacctgttgtttcctgactttttaatgatcaccattctaactggtgtgagatggtatctcattgtggttttgattcgcatttctctgatggccagtgatgatgagcattttttcatgtgtctgttggctgcataaatgtcttcttttgagaagtgtctgttcatatcctttgcccactttttgatggggttgtttgtttttttcttgtaaatttgtttgagttcattgtagattctggatattagccctttgtcagatgagtaggttgcaaaaattttacaatgagaacacatggacacaggaaggggaacatcacactccggggactgttgtggggtggggggaggggggagggatagcattaggagatatacctaatgctaaatgacgagttaatgggtacagcacaccaacatggcacatgtatacatatgtaacaaatctgcacattgtgcacatgttccctaaaacttaaagtataaaaaaaaaatccagtaggaaaacccatggatttaactattattattttccatgtcactgattaactgacatctgctcgttccacatgaagacaggaagcccttttcagaagactaacatggtaacgtgagatcagaaaagacaatgaactgtagacatttgctccttgtgagcctaagcgtaatattgctaagtgcagcactaaggagatgtgtatagtttgtcttgtgcactgcattagggtgtgacggcaaagaaaatgtagctaaaatgaagacaagtcagttgatatatctacttagattatatgctgagcagcagaaatgcctttgatggataatgaagtcataaaagtaaggtgacctcaacaatgtgtaggataaaaatatgagtgctgtatgggcagatatgaaagggagcagtcctcaccgttacagtacttatttctgtgatgagtggtacagagagcatggattgagtgcatgtactgatgagaacaagttaagaaacaagagcagggggattatttagtatctcataaacttttggggaagaaagcagggtatataactaaatgaaagaaaagaaaggaagaatggaaggaaggcaggaagggagaaaggaaagtagcaaggaaggtggggtgggaggaagagagaaggcaggaagggagggagggagggagagagagtaggaaaacagcaaatggaaacaaagtggaaggattgtggtgattgaaagtcaaatttacccaaacgtttcatattagattttcttaacataaggaaaaattattttaacgattagtcagtgtaggtataaaaatattatgcctttgaatgtatatatacacacatatatgtgtatatatgtatatctacatatatatttgtgtttgtatatatgtgtgtgcacacacatatatgtacatacatataagtacatatacatacagagagagagagagcgccttcatctattcctaagtgtaggaaggttggagtgcttgaatcaggaactagatttcatgttacaaccaaaaggtgactaagttgctccaccacatacataataggactcactgtatagtaactgagtgattgaccttaggcaagtaacttgactttgctaggctttagtctgctcctgtatagaatgcagattataatgctcaaatggttgttttgaggagtcaatgaagcaatgcctgtaaaatgttgatgtgaattaaagactccatcttgtataataataataattgtaacacaatgaaacagatgtcaagttgaacagatacggttcaggggcacctaatcaccatacgcagcgggtgtgcagctgattggattcatcctgacttttatttaagaaggaattagataaactccagatttgcttaaattaataattattcataataggcttctccttctgctaatgtggaaatagagtttaaacttctgtggaattttaggaaaataaactctataggttaatgaaagatatggaggaataggtaagtgttaaattaaccctatttaaagatagaaaaacaagaatgtagagatctattcctcttttttcacgattgtattgattggtgttgaaaggactttttataagtttaggaacatgtagtaatgaaatgctgggacaatttgtgaattcagctgttgtattttcgaaaaaaaatgttgctggcagcctgttggaacatctcattttttattctactaaatgagtattaaagagtcttctttccttaagaaaaggaacatttctagagaaaatttctgaagtttaaatatgataacagatggtatttcaagtcttctgtcaattacatatgtgatagaactccaaatttagattcattacacagctacaattcttgacgaagaatttatgaatttctggtataatcaaagaattacctatccgccccccccacccatagaggtatgtgtatatccttttggaggaaattttaggtgggccaggtcaccgttcttctcattcaaagatgactgtagttgtcagcacaaataatctttgtgctgtggaccaataatcttttctaccctctgcactggaaaccatactgactggtttgtggctatagcaggtgaccctgttatatgaattatcacatcttggtcttgtgattattctcattctttcactcaaatgagaaatttcatttcaaagacttggcttgctccttgctgtggttgttttttaaccatctgcagtggtattatcttgttggaaccatgttcatatgtccaaaataattccataggctgttctgattttatactcctgctgctctggtaccctgctgccacatttttttctgtctttccttgtaaatttagactgtgattaaaaacctggggacccacttcaagacctttgcacatgctggcccagatgcctctgttgcttttccctgggtttccacgtgcctccaaagagacgggttttcacatgtcaccttctcactgagacagtccctgaccttctcatcagtggttcccattaaaaccttcccagtcccattatttcttaattaaacactgtaggtttttttgtagcatttattatgatttataattatttattacatatttacttgtttctttatctttctgttatacttatgagagtaggactggaacacttttattttcccagatctcttaattggcaagtatgtgtttaatcattttgttaatctttaatttgaactcatttagaacttacagaaaagttgtaaatgatagtacaaaaactttcaaatattcatatttagcaattatcaccatgttttaaaatcatatttgcactattattttctgtttgtatatatccttaaatagttgtgttttctaagaacaagaacattcttgtttgtaaacacaagacaattatcaagacatttaacatggatgtggtattaataatctatattattatgtagattttgatagacatttcgataactctttcattaatgattgttctatcaactgttttaccagcccaagatgcaatatgagttgcatttagtagttagctcatttctttggtctctttaaacctcaaaccatttcttagcctattttattttattttattttattttattttatcttattattttattttatattttattttattttattttattttattttattttattttattttattttattttattttattttaattagagatggagtctctctccgctgcccaggctggagtgcagtggcacaatcttggctcattgcaacctccacctcctgggctcaagtgatacctcccaagtagctgggattacaagcattcaccaccatacccagctaatgtttgtatttttagtagagatggggtttcaccatgttggccaggctggtcttgaactcctgacctcaagttatctgcccgtgttggcctcccaaaatgctgggattacaggcatgagccatcgcatctggccttcttagcctttataacctagacattttaaaagaggatagaataggtcagtaatatagtagaatgttcctccatttgcagttatctgatgttgctacatgattggattccatgctgcatttttatgaggaatactacatgagaggtgtttccttcttactgcattacatgaagaggcacatgatgtcagatggtcacgtttaaatcatatttcttaacagtgactaaatggatggtagaggtttatattctaggactttagaactatcgtttgattgttaggataccttacaagtagtattaaataaattgtttaactatagagaggagacatgagtgtgagttcaggcctttggacccctcgtgttagtctagagttagctgttacacactcttaagttttctgtatttgaaacatatgcttattatttactgtcaaaaagctgtttgaggccgggtgcggtggctcacgcctgtaatcccagcacttagggaggccgaggtgagcggatcacgaggtcaggagatagagaccatggtgaaaccccgtctctactaaaaatacaaaaaattagctgggcatggtgatgggcacctgtagtcccagctactcgggaggctgaggcagaagaatggtgtgaatctgggaggtggagtgtgcagtgagccgagatcgcaccactgcactccagcctgggtgacagagcgagactccgtctcaaaaacaaaaagctgtttgactgagtgtagatttttttttaaaggcattaaaacccttccatcattccagtatctggaacaaaggcatggggtgaatgaatgaatgaatgagcaaatcagtgtttaagcttaacgttattttgtcagaggcatgtgaaccagagcaattccatcttgaataggagctgggtaaaataaggctgacacctactgggctgcattcccagatggttaaggcattctaagtcacacgatgagatcaaaggtcagcacaaaatacaggtcataaagactttgctaataaaacagtttgcagtaaagaagctggccaaaacccaccaaaaccaagatggccactagagtggcctcggtcgtcctcactgctacactctcaccagtgccatgacagtttacaaatgccatggcagcgtcaggaagttaccctatatggtctaaaaagaggaagcatgaatgatccgcaccttgattagcatatcatcaagaaataaccataaaaatgggcaaccagcagcccttgggactgctttgcctacggagtagtcattcttttattcctctgccttcttcataaacttgccttcacttcgcactgtggactcaccctgaattctttcttgcacaggatccaagaatggagtctggattggaactcctttcttgtaacatctttctggtgaccatggaaggtactataatgcggaaacccctgacccaaatgctaactttgggtaagtggtggggtccagtaacttctttctggagaaccctgaagggatgatactgagagacctctcacccaaaggaaatagacagcactgattggatgactttgggtatatgcatacccaggaaaagaatggaattaggttagaggcttaactcaggggagttagagtgtctcctaagagagggttaaaggcttctctcaataaaaggcaaggatgcttgactgaccttgtgttagaggcctgatttaggagggttggagttccttctaagatttagggggttagagacccctcttagtaaagtccctcttggtagagtccttctcgtttaagtccttctcggctaagaataggtttggcactatgggatgttaactgctattctctttggaataatctgcttagcactctttgcttatgactatggtaagcctaatccttaggcatgtacaggcatgtacaggattaggcatgttcaggatcatgggacatggggaactttttcctccctaaatggggaaacttgagagctattaggactgctggaaaagagtccttcactactgacaagtggctgcccgaacttttcagtgttggctgcaatggggggtctttctttggcctccctgagtgcctcgctttccccactctgccacaggcaatgctcctctctctctctctttctgcaaactggttgaaagaatggtaaaaatcattgtttattaaagttttgattaatgggaaaaaggatttgtgaggctaatcttaagctattgtgaatttggtgtgtgtgtctttctgtgttctatagtggagaggggtaccttaggatagaacacaggcttaggacacctgtaagcccacttttcaagatagcccagcaaactggtcagttaaaaactttgctgcagttccctgaaaaaactggatgaggtttccttcttgtcttgtatgtccttgggagcttgaccttgtaaccatgtggccatgctttctcttttcacaatggcggcctgcatttagggttcaattcctggtttagagatgagtcctttatcttctgtcagtatgtatatgtatatatgttgtgtgtgtgatataaaagagctttgattaattggcttaaaaataagagcttaaatcaaatattttgttagaaaagtaaaaagagtaatgctttttagttcatgtgacttaagtaatctttaggaaataaagacagttttaaagattattggtaaaataaaaatatcttcaaaaatgtaaacatttggtctaagttatgcagtttcgatattaggtttgctaaatgctttaaggtcataaactgcttctttgacttttgaaaattgttcaatttacctaccttggagcattaaattctagataaagcctggggacatgtggagttagccacgctgtctagctatgctggattcagcccttatctgcacttctgcctggtgtgtcctaggataggctccacacctagtacataattaaaatcgcttactaaccaggattttcaccaaaagtaaaagtcactaagagttaacagtgtaatgtgtatttgagactcctaaagaaacagttttacatgcaaagtgtgtaagaaaagtgaaatgtgtttttggaaatgactatggaaaggcatgggaatgtggatttttcttgcctaaattaaagggttaaaggattgttttaacctatatatgcctagtgttccattattggaacgctgagcttgtggcagttatttatatcctactgctcaaggtcaacaccaaggtctgattttccccccaaaatttgtaaccttcagcataaatgagttaagttaaataggataaagctgaaggtttaagcaagttatagaaggtttgtgagaagttaattataaaagaaattctgtgtgtgaatatattggctaaagttaaagtgccattattcagtttttctgttattgaattttgcaataaaagcacaacaggtttttcttaaagcaaaaacctgcttataatctgctctttaacaaaacttataaagggttataaaaggtttatgagaatcttaccttagggtcaaacgaattaagattaaatttgtctataaggttttattaagaattgggtttgacatcaataatgcactaatgcaacagtgacatttggcttatttggtataaaaatcatgcaggtagcattgtcaaatgtaaaatagtgtttgctttctttgggctgtatttgtataaatgtactattgatatgtgttgaaaattataggaaactcctataattctgatataacttagtgtatattaataataataattgttacataaaatcattgtgtgccacagaggtaaccaaaatttgtcaattgtgtttttgactggggctgtcctagaatgttttgccatccacagacaactgtgttgtcttgttttggtcctctttacaagatggtttatagtcaggtataggacttcgacaggtgcatttaaatgcaggtttctgataactttggaaattgtgacattagaataaaggaaacaactttcaggactctcattgatagctgaaatgttcatgaatatcaaacaggagttaaatacataaactaaactaaagaaatctgaagtaatctttttacctttttgcttaaaatgctgctgatactttgttctgtttttcagagttgagaaaacttttcttttgagctatttacagcttgtagcaattgagtaaagtatactcaagaacaaaatttggagcatatttgtttctctctacctgatttgtccataatttagaaactatttgtgagtatccttaatttatggcaatgtagttatttgcgtaagtgcaataagaatctgattccttttataacaggacacaataggaaaaactggttattttaccaaggctttggctggaatggcatgctttcctttaaggaatcaaatttgacttgtagagccaataaaagccctttggggaaatgtctcataccttgtctccacagttcctgtacagggtttctgacttgtggtaagtaaagaatgccactttctaacaagtccaggagcccaaagttatcctgggacctcataaggagaggaatttactcaactcataggtatttgatggtacaaacccatggctgtgctcagctttaaaaaagtcttaattgagattgcttctatggaacagagttccatcaaagccaatttaaaaagagcttatgtgaaaaataattattcttgctacacttcatacaaataaaatggccaagtgtaataaagcaaatcaatcttaccgtgatttgtctttagtaaagatggaaaattggagatagaaatattatgttttaagaactgtggtacacattattaaattctagtctcatcagttgattttaagtttgtttcttcaatttaggctaatgttacttattcctgtgaaccatccagtaatctctgacagcagctcaaaagaaacaagagagatgggtaatgtaaaaatctggatcagtattctaatcgtggccacatattggaatcatgtagcaaccccatatcagcttggttccaacagttgtccaattcatggaaagccttctaatttagtttatttgagataattttacttatttcactttactgttgtggaatattttgctgttgtattcttggtgtaggaatgaaggacaagcttattaaatgtttttgtaaacacttactaatctttcatacagcaccttttgtcaaaactcagagttatgaatgaccctcaccatactgatgctttctgactgagctcctctctaccttgaatacaagagaccctaatagtgaggtaggaatatcattgcccctattcagcctgaagaagttacagaagatggatcttcatccctctgcaacccgtaggattaagggttctcttataaaagggtggggaggaatgtcagaggtgtgtgaactggaacaactccatcttgaataagggcaggttaaaatgaggctgggacctaccgggctgcattctcaaatggttatggcattctaagtcacaggatgagatagaaggttggcacaaaatacaggccataaagaccttgctgataaaatgagttgcagtaaagaaaccagccaaaacccaccaaaaccaagatggtgacgagagtgaccctctggttgtcctcactgctacacacttaccagtgccaagacagtttacagatgccttggcaacatcaggaaattaccctgtatggtctgaaaaggggaaacatgaataatccaccccttgattagaatatcatcaagaaataaccataaaaatgagcaactagcagccctctgggctgctctgtctatcgagtagccattcttttattcctttactctcttaataaactttctttcactttatggactcactctgaattctttcttgcatgagatccaagaaccctctgtgggagcctggatcaggtgggacccctttcctataacgattttataataatgtgccagttttgaaaaccgatcctttatttccataatatgtccttgatagagtcataatatgtcctagctggaaagccaacaagctcagctaacagatgaaataagaggtccaggattatggagtgatttgccaaaggtcacacacatgatgtgatttggatctaaacatttcctcaatgatggtcatcaggcttttggataatcatcttaatcccttcagtagaaaaaatcttctaagtgtagaagcacattttgacatcatcttcaaagttttttctcttcaaggaggactgagtagaatctaataaaaatgcttttaatataatgtgccttgattggagatggatagtggactagacagtattctgccactggacgttactcatcctgccttcagcttaaaggtgctggtgatcttttcagagcagaatcaaagaccattaatgaagtttgatgttttcttcagttcagtggaggtggagttgtagtgactgtttcttgtgattgttgtctacctagtcaatggcaaagatcatgtatatcattcttgtggtatccatttactcttgatactgttaattttgtagagcattttatacatttctaagtccctcaacaaaagcaggatgagaaaaacatggagatggaaaacaatttctttcttaggcaacaggttaaaattcctttaattacactgtgatagattttacatctgaaaaaaccctcctgctacatacatagagaaatgctaggttagctacaacaaacatccttttatattagtagccaagaaagtaaaggaaattcacagaggctaaactatgaaaaaagagagatgtaaacagggcagtgaggggctctatcctcgggttcttatggcctcgtagggaaatcagtaacatttatctttgcgtggtatagcattggtattagatataaataattgatattaacagtataaataatagttgttaaattagtccaaatagattaaaatatatgtgtgatgtttaatgcaattaagtccgtggtgattactcctaaagtcatgttagaattctgcaaatgcagaatttacaatttttggtagctatttttagattgcagtcttgaattcagagtgggctcacaagctgtccactcaataaatcaaactcaaatgaaattaaaatttgagaaaatgaaaattcaaaatgaatgattcttttacattttgaaaaccctgtattctgtaggaaggtaatgctattatgaagtaccttttaacattgtgacagttttatgagtcagcttgaatggccataggatgcccagattaattatcagttctgggtgtgtctgtaaggatgtttttagatgagattagcacttgaatcagtggactcagtaaagtagattgccctctccagtgtgagcaggcaccagtcaatcttttgaggtcctgaatagaacaaaatggagagaaaggaggaatttgcccctgttgcttctcgccttaagctggaacatctcatctcatctcatcttctctggtcctcaaactggaatttccactatcagctcccatggttgtcaggctttcagacctggactgaattacagtgctggctttctgagtctcgcgcttgcagatggcagattgtgggacttctcaggcttcataattgtgtgagccaattccactataataaatctccgtgtgtgtatcttctactggctctgtttctattgagttctctgattagtacagtaaggatgcaaatgaaacaaccttgtagacattttgagaaatctggatggtctcgtttttctcacctgtgaaacaaaggaattgagtagatgactgcttatgtattctgtgattatatctttattcattcatttatttaatatttattgagtgttactgtatgcgcaatgctggacatttgaagatgaataaaatacatttcctttgctcaaaaaacgtatgttctagtgagagaaacaatagtaagcaagtaattaacccaatacgttatttaactggatgtatatgtagaattgactgactgaataaacttgaagcaggagaccagccaggagatgactacattagcctagggtaacactgaacgttgaatctttctattcattgctgtttaccttaatctaggttgttaacttgagtgtactcttttcttaaagtctataatctttattaatgtattgaatctggcttggattttagatgacttttacctgctgacagtgctgaagtgttgaggtcttgcaattagctaaataggttatgcttgataacaaattgatgtgaggttacaccagggagagaatgggaccatgaattttctgtcatttgattcaagatgaaaatgatgggaatcacacctgaagagaaaggaaggcaactgcaggactgctgagggcccctgagttttcttagtatcttttatcaaatgaaagatatggcaggtgttttatgacatgatagaaggacatatctcattctttcccactaagtgttttctagctctttgttctctgatatttagctctgtgcttttctacacagttttggggcactaataatataaagtagaaaagtagaaagtttctagatcacagagatcattacagatctcagtggttgtcatctcacattgcattaaaaataaatctcttccactgaagttgctatatacattatcctttttaacaatgatatatgcattttgaaatatgtaaagtaaatatagaaagaagtatataaaatatttgtaagtttaaagaataatagtgaaaggaacagttttctacctaccactcagcttaagcaactaatgtcctgaagccttctatggacatctctctgatcttctcccactcccctactgcctccttccagtggaaacttgtataattaattatgtgtttgtaattatttgccttttttatcaggtataaatgcattcaattaatatgttatttttcatttgtggaacttgatatcatactcatacactgccaagacttgcttttttcactcaactttatttttctgagatatagcaatgttgctgtttatcactaaggtatttgcttttattaccgtattctgttgaaggaaaataacataaaaaatctttttttgttcttagtggaaagtcttgttgtttgtagttttcttgccatttcaaatattgttgctaagaacattcttgtaacatgtccaaatttacagataacaaatatacctaggagtcaaattctaaggttatatgttatgtgtatcttcaactttgttacataatgccaaatgattatccaggttggttgtaccaatttatactcttatcagctgcaggtctgttcttattatgtaacagactataatttttacccatttatgtaatatgttatctcttcatggttttaattttaatttccctgattacaaatgaggttgaaatatcttttcatatttattgatctttcatattgatggcagcagcggcccacctggagtgaccgctgcaaacacactggctacagtgggggaggtgtggccagggctgcagctccatggagctggtgggagctggaaacaggtggaagccccgctcccttccaagtgggcaggttaggagccttgcacttcccaggtgaagctgcagccacccaagccgtggctgcagactcagaaatccctgtgctcttgggggctggaagcaggcaggagccgtgctgtcctggaaaacagctatagccatccagccacagctgcaggcgaggcatctttgtgttcttgacggcctgggaagccccccttccctgcagcttggaagtgcctgctcctgctgcctggcctctccccactcctgatgctcactcccatttcaagcaaacttgaggctgagcctgggtgctgtcacaacccagccatttgggataatgctaacatgctagactcctgccgcctcggcccctccagacgctgggcactgacaacctcctgtcattgcccaggctccagataggctcctaggcagaaaggggtgggtcccctgtgaagccccatcttcaaaccagggagggcctgaagcctgggggcctggctgacggacaagaatgggaacatatgatgctttttctgggcccacccatggccacccatgaaccaattagtacgcacttcctcttctttgaagcctgtgaaaactctgaactcagccagactcaagtagatgactgagatgactggatgacctgcctgtggagaggagtgacccactccagggtctcttctctgctgagatttgggcagacgtcaggactaccagctgcagagaggagctacccactacagggtctcctctctgctgagagaggagcactccagggtctcctctgctgagagttgggcagatattgggagtaccagctgcagagaggagctaccccctgggggtctcctctccactgagagctcaatacttgtcgggatgccctgcctgcagatgggagctacccactgagggtctcctcttagctgttctgtcactcactaaagcccttctttatcttgctcaccttccacttgtctgcatacctcatttttcctggacacaggacaagaactcaggacctgccaaatggtgggtggggctaaaagagcaataacacaaacagggctgaagcatgccccttgcttgccttgttgcaggtgacaagaaggagagaagagagaaggagagaaaagctgtggccccttggggagcctatacctaggagctcaccaagccagggctgtgacaccctctctggggctctgcagttcctggcatcttcaagcttctgggtgccattgtgttccccagtgccagccgtggaagctgcttgtggtacacctggtccagtcacagcctcacagggagccagcacccttctcagaacccagagctaagcaccccaccacagccagtgtgcatggctgtgcgcagtgactgcaccccatactcaattgctcacacacccctcaccactcgtgcctggcttgcccttgacaggcatgagagtcagaccagtagtgtgagctgagcacagtctgccagtctgagtgggtggaatgagcccagcaggctcgagtaaaaacttgggcaaaggtgcccctggccacagaggtttccagctggcgaatcaacacctgacggatcctgtgacaatattcctcctgtgtagaaaacatatttatatctggtggccattttcttttctactgaatcctttttttcttattaacactttaggagttgtttaaatgctttgaatattaatctttttttcagtatgtgttgtgaatgttttctgcaaattgtggccatttcaaacacatgtaaaagtagatagaatagtggtacccactgctcagctacaacagtatccatttcatcaattcatggttactcttatttcatcaaacaggtactcacaattcaccacctccctgccaagcaaatgccagacatcatataattttactgtggcttgtttttcatttcttcagtgtttcttttgataaacaaaagtttgtaattttaatgcagttgaattcctaagtttctttcctctatggattgtgtgtttcttatttaagaaattcttctgcaaaagattgtggagatatttcctaagtttttgtctaactgttttaaagctttacctagacactagttataatagcctttccccattctttcacagatttcttatgctatctctggcatatcaattttacaaatctgtgagatctgtttctgggctctgtactcctgctaataccatattttattaatcactatacccttatagtaaattaatactatatattattgtatctatagtattcttatatattattgtatatataactatattaataattattagggcaggagttcccaactttgctcttcagaaactttgacaattcttgggcttttgttctttcatgtaaattttggaattagatgatgaagttctaccaaaaacttttgagattttgactggcaatccatgtatagataaatttgtgataaagttacagattttatgaaatgcaaaagtataacacattcacagattaaaattccccaaatttgaaatattttggggttttaatctgtgaatgcgttatacttttcaatttatttagctttattcctctttttatttaggtttttaattggctttttccttctcaatgaaatctttaccatccagactatttaaaaagaaacgccaccctcttctagaatatttgtattttactaccatagttcttaaccttatattacatgttgcttctccttgatataaatgataacaaagagttttatctgcctgattatttcctggaatagaccctggtatatagtaggtgctcaataaattaattttaaataatttttttccataaaggtcttttaaatcttgtgatagatttgttctttggtttggtgatgtgccagtaaatgtttaacaataggttacctggggagtgggagaagcagaacaacttgtagatttgctgatttccatgctgtaaattctcctaccatggccaatatcaagttattgacatgacatcacggaatgggggagttgagaagagatgtggagtagtgtgccattatatagtattcccactaaacagaaacaatagatgccagtaacctcaacaatgtaaataattgcaaaatgtaataataattattagtaattataagtttatataatttaattttaaattatgatcatatttaacaactggctcacaaaattcttaaaaatttaacagcgacttcttgcgagctgtacaaactggatccagaattccactgtttagtttctttatgtttttgtgcgactgttataaatatatttccttatataagctttctaacaatttcttcttgatttataggaatgcagctaacttttatatttgttcttacatctggcaaacaggctaaaatttcttcataatttgaataatttatatgtacatctttccaggtttctttgtggactgttctatcatctgaaaaatgacagttttgtttcttcacttccaatccttatacactttatatcttattcctgtattattgcattgacatgaacttccagtataatgtttaatgttagtggtaatgaaaagcatccttgtattgcttctgattttaaatgagtgctttaagattttatgtttctttttgatattgtccttgttggacaaaataagttttcttttatttatagttagataaaaatttgtttttattattcatgagtgggtgtcagatttcatagcatgattattctctattcattgagatggtcatatactatataacgaagatgttcaacataccaagaatagtttgtggcttgcttaataacatagtgtcaaaatgcaaaaagcaatgattgacagaagtaaatggcaatgaaaaaataagcacatggaaaaaagaaatacatgtgaacaacatgactagctacttgatctactgcaaaagtacagaacactccagtgaatgcaaaaatacatagtattctttttttaaattatactgtaagttttagggtacatgtgcacaacatgcaggtttgttacatatgtatacatgtgccatgttggtgtgctgcacccattaactcgtcatttagcattaggtatatctcctaatgctatccctcccccctccccccaccccacaacaggccccagtgtgtgatgttccccttcctttgtccatgtgttctcagtattcttgagctacattaattatttacaaaaattaaccatttagcagatcagctataaagcaattttcatcaaatttcaaagaatctgtatcatgcatgcaatgttctctgaccacaattaagctgcttgcactacctctcagtaatgttttcatatatgtttttcctttccttccaacttttattttaggcttaggaggtacatatgcaggtttgttacatggataaaccgcatctggggtttggtatacacattatttcattacccagattgtcagcatagtacccaatagacttccaatcctcagcctcctgtgccagcatcattctgataccaaaacctgacagagacacagtgaaaaaagaaaacttcagaccaatatccctgatgaacatagatacaaaattcctcaaaaaatattagcaaatcgagtccaggagcacagcaaaaagccaatccaccatgatcaagtagggtttattcctgggatgtaaggttggttaatacaaatcaataaatgtgatctgtcccataaacagaactaaaaacaaaaaaccacacgatcatctcagtagtcacagaaaaggctttcaaaagctggaagcattttccttgagaaccagagcaagacagggatactcactctcattactccaattcagcagttctggtagtcctagccagagcagtcaggcaagagagagaaataaaaaagtcatccacattgaaagggattaagtcaaacttctctcttacaggtgatatgattctatacctagaaaaccccataatctctgcccaaaggctcatagatctgatgtacaacttcagcaaagtttcaagatacaagatcagtgttttaatattcatatttcatttcataaattcccttttcagctatgtgtaatctgccttttatcctattcatttttttcatgtttgataattacagttttcagtgtctgaagttgtattatgtttttggtttttttttttaatctgctgggatttacttatttatttaaaaaaacttaaaatcttaatttttttttcaaatattattaagcatagttattgtgatggttaacactgagtgtcaacttgactggattgaaggatacaaagtattgatcctgggtgtgtctgtgtgggtgttgccaaaagagattaacatttgagtcagtgggctggggaaggcagacccacccttaatctggtgggcaccatctaatcagcatccagtgaatataaaagaggcagaaaaatgtgaaaaggagagactggcctagcctcccagcttacctctttctcccatgctggatgcttcctgccctccaacatcagactccaggttcttcagttttgggactcggactggctctccttgctcttcaacttgtagacagcctattgtgggaccttgtgattgtgtaagttaatccttaataaactacacacacacacacacacacacacacacacacacacacacacacacacttattagttctgcccctctagggaatcctgagtaatattgattttggtaccaggagtagttgtagaggaacagaatattaaggatggagttctttcattggttttgggtttctggagttggcttcttaatatgattagaccccaaaatgctaaggactctacttctaatggtatggagaacactgattagtcctcagcgtgaattgtttagagagttatgcaaaataaatgcatttgacactcttctttcaccacttgtgagaggcaaggagtttagtgactccttgaccgtatgtggagaaccaaggagcgtaatgaagctggtggttgctcctaagtttagtggacaaagtgatgaaagaaaatgatgaactcagggattttgtttcctggcttcagaagcagatactaagcctcaaatctgctaagattgcccccagtgagttttatcttctgtagagaaagagctgaaattgtggaaaaacagatacaagttcttatcatgtgagtggctgacctgcaacgaaagatggatgcacagcctcaccaggtgtctactgttaaagtgaggtcattgattggaaaagaacgggaccctgaaacttggaatggggacatgtgggaggaccctgatgaagctgggggcactgagtttgtaaacgctgatgaaactttttttgccataaggaacagctgccccatcctccatagtggcaacatcccctccccgacccatgctgccatcagcctttccacttttgaggagataaaccttgcactgcctgagacaacagtgatggcctccctgagcctgtttccaggcaaaataatgttgattctcctcagaagtcacccccaacacccctatttgcttctggacctataactagactaaagtcccagtgggcccctggaagtgaggttgagagtgtgacccatgaggaggagcactacacttgaaaataactgtttgagttctctagtttatataaacagaaatctggagaacaggcatgggaatggatattaagggtttggaataatggtggaaggaacatagagttggatcgggctgaatttattgatttgggcccgctaagtagggactctgcatttagtgttgcagctcagggagttaaaaaaggttctaatagtttactttgttagctgaaaagatggcctgctgtgagtgagctggaaatgcctgccctcccttgttttaatgtagaggaaggaatccaaaggcttagggagattgggatggtggagtggattaatcactttaaacgtactcatcccagctgggaaggtccagaagatatactgttgaccaatgccttgtgaaacagatttgtgagagcagcacctgtgtctttgaagagccctgtaattgctcttcttgaggtgtcagtggcagatagggatgctgtttggagcctttggcaggcccccacaggtgaatcacaccagtgtcatctaggattttggagcaaggccctgccattcttctgcagataactgctctccttttgagagacagctcttggcctgtttctgggctttggtggaaactgaacgtttgaccatggatcatcaagtcaccatgcaacctgaatgaactgggtgctttctgacccatcctgccataatgtggagaatgcgcaacagcattccaccatcaaatggaagtggtatatacgtgatagggctcaagtaggtcctgaaggcacaagtaagttacatgaggaagtggctcaaatgcccatggtctccactcctgccaccctgccttctctccctcagcctgcacagatggcttcatggggagttctctatgatcagttgacagaggaagagaagactaggggctgactcatagatggctttgcatgatacacaggcaccaactgaaagtggacagctgcagcactacagcccctttctaggacgtccctgaaggtcaacagtgaagggaaatcttcccagtgggcagaactttgagcagtgcacctggttgtgcactttgcatgaaaggagaaatggccagatgtgcagttatatactgattcatgggctgtagccaatggtttagaacttggaagaagcatggtcagggactgggaagaagcatgactggaaaattggtgacaaagaaatttggggaagagatatgtggatggaactctctgagtggttagaaactgtgaagatatttgcatcccatgtgagtactcaccaacaggtgacctcagcagaggaggattttaataatgaagtggctaggatgacccattctgtggacaccactcaacctctttccccagtcacccctgtcattgcccaatgggtccatgaacaaagtggccatgatggcagggatggaggttacacatgggctcagcaacaacgacttccactcaccaaggctgacctggttacagccactgctgagtgcccaatttgccagcagtagagaccaacactgagcccttgatatggcaccattcttcggggtgatcagccagctagttacctggtagtaggttgactatattggacctctttcatcatggaaaggtttgtcctcgctagaatagacatttactccggatatgggtttacctatcctgcatgcaatgctccaagactaccatccgtggactcacggaatgccttatccaccatcatggtattccacacagcattgcctctgaccaaggtactcactttacggctaaagaagtgcagcagtggccgggcacagtgattcacgcttctaatctcaggactttgggaggcttgaggcggttggatcacgaggtcaggagttcaagaccagcctggccaacatggtgaaaccctgtctctactaaaaatagaaaaattagccaagcgtggtggcgggcatctgtaatcccagccactagggaggctgaggcaggagaatcccttgaacctgagaggcggaaattgcagtgagccgagatcgtgcctctgcactccagcctgggcgaccgtgcgagactcaaaaagtgcagcagtgaactcatgctaatagaattcactggtcttaccatgttccccatcatcctaaagcagctggattgatagaacagtggaatggcttttgattgatagaatggtggaatggcctttgaggtcagaattacaacatgaactaggtgacgataatttgcagggttggggcaaagttctccagaaggccaagtatgttctgaatcagcgttcaatatatggtactatttctcgcatatccctgaataacaggtccaggaatcaaggggtggaagtggaagtggcaccactcactgtcaccccagtgatccactcgcaaaatttttgctccctgttcaagttacattctgctgggctagaggtcttagttccagagggaggaacactgccaccaggagacacaacaacaattccattaaactgcaagttaagattgccacctggacactttgggctcctcctgcctttaagtcaacagactaacaagggagtttcagtgttggctggggtgattgacctggactatcaagatgaaatcagtctaccactccatattggaggttaggaagagcatgcatggaatataggtgatccattagggcatctcttagtattaccatgccctgtgattaaggtcaatgggaaactaaaacagcccaaatcaggcaggactacaaatgacccagacacttcaggaatggaggtttgggtcacttcaccagggaaaaaaaccacgacctgccaaggtgcttgctgaaggcaaagggaatacagaatgggtagtagaagaaggtagtcatcaataccagctatgaccatgtgaccagctacggaaatgaggactgtaactgtcatgagtttatttcctcctttttttgttaaaaacgtgtttgtgcatgtatagacttgcactaagaaaatatcttcattttatttccttttcctttatcatatgacataagatttattgacttcatattagcatttaagtatcactacctttatgtaatagtatttttgggttggggattgatgtgtttccagttgtatgaaggataattgtattatgttaggcataattatgacctcattattgtctttatttgaagattatgtatgatcttaagagatgtgtatggatccaagttgacacgggggtgaacttgtgatggttaatactgagtatcaacttgattggattgagggatacaaagtattaatcctggatgtgtctgtatgggtgttgccgaaatagattaatattttagtgtatatatgtgtgtgtgtgtatatatatatagttctattagttctgtccttctagattgccccgactaatatagttatattagatatctgctaaatgcagtgtcagcagtctttgattctgttattttttgctctctgcattcaggttgcttatttcctcttgtgtttgattgtatttgcatttgagctcataatccatgggattttatctgtaggaattctttgaacttcacatttaaagtgctttactgcagagagaatttgagtttgctttgtctaaaactgtaggctgtggcaaccttggattactagatattaatattttggcttggatttttttgaccacacagatcctgtgaatttagcccccaaatcacctaccttcatccatattcaagacaaagagattgtttttctcttagtttgttctgtagggtgtattttattttctagttcactatttcatagaaggtattgctttttaaaaaattcttgctttgtaaggagtcaataattttaccagctaaattgaatagtccatagactttgcatctaatcctttatatgactgtagaccataaaacccaaaatggtaggcccttagagaaaaatccccaattggtcaagatgtatcatttgttttatatattactggatatagttggctgatattttgtttaggatttttgcatttatgttcataagtgaaactgagttgaaattttccttttgcaccaatttattgttagaatgtaataccaaggttatactgacctaaaataagttgagaaaagttccctctttatctgttcactggaagagtgtacaaagttggctttgttttcctgttaaatatttggtagtattttccagtgaagctacctgggcctgaaatattttgggaaaaatttttaaatcacagatttactttataaaattattaaaactattgaaattattgaaattttttgtttattgtgtcaattttgttgtattttagaaatttatccattttctttacattttcaaattccttatcacacgttacagtacactcttatagttagagattttgtagtgatgtccctctttcatttctaacattattacttttctttttcccttttattcttcattcatcttgccaagggattatcgattttacaatcattttcaagatccaaattttagcttcattgatcctttctaagttttgtttgttttctatttctttgatttctgttcttatctttgccatctctcttttttcactttatttgcatttgttttactgttatttttgtaaatttttgagatggatttagctcattaattttcaagtttttcttccattccattatattaaaggttaaacattttcctatatactttaataacagctttagctgaatctggtaaatttttctgtgtactatcatatgcaaatatttttttggctactatggatcaaaatggtttgcagtgcacaaaataaagggcagaactgaggctacaactaaataaatagtatatgtttcagagtatgttcaactcctagtaagttagcatatccattgcgtgagagtatttttagcgtgatagagtaataccgttggccaagacagcgtgggtgtatttgtcacactaggtgtcattgactgtgaatatatgtgagtattcagaacaagagaaatacaaacacgtactggacagagtatttctttaagataaaagaaagcttttggaaatatagtattataacaaatcagtacttcaagggagtggcatttaatgctgtaatcatttttgtcattatataactataattctcactacttttttatatttatatagcaggtattaggaaatatgtctgaaatgttggataattctatcctagtttaaaaggtggtcaagaaatgcctgggttacagcaattccattactgggtatatacccaaaggaatataaatcattctactgcaaagacacatgcacacgtatgtttactgcagcactatttacattagcaaagtcacagaaccaacccaaatgcccatcaatgatagactggataaagcaaatatggtacatatacaccatggaatactacgcagccataaaaaggtattgagatcatgtcttttgcagggacatggatgaagctggaagccatcatcctcagcaaactaacacaggaacagaaaaccaaacaccacatgttctcactcataagtgggagctgaacgatgagaacacatggacacagggaggggaacatcacacacccagggcctgttgggtggtggggggcgaggggaaggaacttagaggatgggtcaataggtactgcagaccaccatggcacaggtatacctatgtaacaaacctgcacattctgcatgtgtatcccagaacttcaagtaaaataaaaaacattaaaaaaaaaaaaaagaaatgcctgggttagtccctatctatgcatttatttccttgcatgtgggacattatgtgagagcaccaaaagacaagtttatgctatatttatgtgttaagataatgatttttcattaattacaaaatcttttatctaaaattttaatagtctataaactatttttatccagaagacaaatgggttcaatcattttaaaaagtgacatcaagcataataatttgtgcccataaaataaagggctgggttagtaatagtttttcaattggagagaatggcccgaggaattaactttagattctaccactttgcaaataacagctttcccagagcaaataatgattgatacttagtgagtaataaagttttattttatttgacaaattttacagaaaagctagctgcagttagtgtttgattctgattagcctgggggatcaagggacagataaggcaaaacaatcaataattcacaattctatagcagaatgaagggaaatgaggtggggcctctggaagggtaggagctcaacacgtgagcaaagctattgggtagtggggaatccagactacagtctttgtttgctagattggatgttcagaatagcagagcttctttgtttttgagacggagtctcattctgtcacccaggctggagtgcagtggcacaatcttggctcactgcaacctctgcctcctgggcttaagtgatcctcctgccccagcctcccaagtagctgggattacaagcgtgtaccaccacgcctggctaatttttgcatttttagaagtgacggggtttcaccatgctggccaggctggtctcgaacgcctgacctcacgtgatccgcctgcctcagcctcccaaagtgctgggattacagacatgagacactgtacccggctagaatagcagagattcttaagcaggtcagaactttaagggtgatgagcaacttctaggcactgagaagttgatatggagatgaatctctttcctcatcagctctctcgactctgcctcagtctctttctctgccttgcctttaaaaataaaatctaacattgatgaaacaaacatatgttgtggcattgtgcttgttaggtacatgatcttaaggaactttcaatctggtagaagaacccttaggagatctatcgctaatatagttctaaagagtgatttcttaaaccatttttgtctgtcaacttttgtttcacaaagaatgtcttatattcccttaagttaggaatttacatcagtaaagactgaagatttaatcttactgacagccccaaggacatgcaagggcaatatcgcccatgtcctaggaagtttaggagtaagactgatggcaggtattaaggatattcagattgcagctccttctaaatgaaaatttattatttcattattcctaagacttcatttattacgatccttgggatttgagataattgaagacaacaataataatctctttatgtgttacatagtatggagtcattcattttgaaacatttccaagtgtgttgccaactgcatataaaattcagagtgggaagctcaggaatggtgaaggaaatgtgtatagacatacacatggatgcccttgaagtcctgagaggaccttgtggcctcaaaatatgataaatcctgtagcatgtttgacatgttgtaaaccctcctccaactcatagtagccatggtaatttgatgtgagagggaggatactaataataataatgacagtaataataatagacgatatccacatctgttctactgaacaacagtagcaaaaactatactatgtatatatgcaagaaatgtcagacttcctttcatttctcaagaataaatgaataataaaatatacttgaagcccaaaagtatataattaaaaattattgtgaaactaggttctgacaagactaatgttgtaagggaaattgtacattatatattctttcactaaatatttcctgtcctgtcaaatggtaaatcaggcaaccatttaaaggcatctatttaaattagccatgatcaaattatatgacagtggaaatcacaccatcttgataaagaaattgagatgcataaaatggtaacgagactgtgtgaataggggcagtgctaagagagaggtgggaatttgtcttctcaatggccatgtctcacatgcaccctattcattattgaaagttaccccactcattattcaaagtacaagctaatgaacttaagtatataataacaacttcaaaaggaatcatatgggcttaaccatcattatgcaatttgtcaatacgattttaaaaacctgtatgcagtgggcaagtcaacatgatgcattaaataagggcactatctctgggtcagtaaggtctgggttcatataccagctctactcctcagtcatgtgcaatattggtaagctatttcatttctttaagttttagttttcttatcaaatacaaagatgataatagtacctatagttgatagggttatcatgtagattaaatatgtgtggcacataataaaacaatacatattagcaatgctgacaaatttgaggaagatctttatctcattgaataactaggtttcttcaaagtattctatttttagcttcagtactattgggcttgttcgccctttcccaccttctttgaccaaaaagaggccatatctcatgacttttctggcatcttttaggtataaatacatttatttatctggttacttttagtgcccccagagcagtctcaatccagtccagggcaataatccagcctcccaatgcactggctcctgcagaaaagaaagaacaaggagggtaaggaacaggagaagtcataattgagtgtggcagtcacagacagcccctcagggacactccaggcagttgtgggtgtttttgtgggttctttggagaccttctgtagtgttgctgggaatctctctcctgagttccgtgatgtgggtgaataaacctctttggctggtcacttatgtttctaccctcatttcccagacactgctggtgtctctaccctgtctcaaggaccctcgggcagcatttaaggcaacaactgctggccctgtcaagtgtggcccacgtctgacccaggggaaatagtcccatgccctttgccccacacattgtgtaattgctttcttcccccagtgcagggaccactcttggcaatgttgtcagagcaggttgccagacagtctcttccgctttagatttctcaggtgtaggctcactttcattctaggggacacatatgagtctctctgatatccctttccttgggcatgaggtgcagaaaattactccctgcccccaaggaataccacgaactgttataacttcacacctctcctcccagtctttccaaccttagaggtggtgtccaggtcagggtgcaaaagttcttgatcacctcctttaaggtcttttttggtggtccctgacaccaactgggtgtcctacaattcagttcacttctgacactactgtgagtttgtgcagacaccacaggttaagaagctcagtctcatacacttgccttcccttcagatgcgagctggacatcctaggtccccatgctacctgctcttctgctcaatttgactataaatatggaagttcccatcaggttcaaaaatttgttagaattgattcaagacttaggaaagcgctgtagttactatagttacaatgatattttattataaaggttacaaatgaccagccagatgaagagatactcagcgcagcaaggtctggaggggtcctgggtacagagcttctgtgccctctccaactggtctttctagcatatcaatatgttcaccaaccagtaagctctccaagccttattgctgagagtttttatctaggtttcattttatggatataattggttaaatcattggccatgtgattgatctcaatctctagtccccttcctctgcccagaaattgggaaggtgaaagttccaaccccctaattacataatttgtttttctggcagccagcctccccaccccacatccatgaaccactttgctggcataaattcaggtatggtccaaaggggtttgtatgaataataaaagacactcttatcattaaggaaattccaagggtttatgaaacactgtgccaagaactcgggacaaaggccaaatgtacttttaaaaattataccacaaacatggaatttgggagtggttggtacctatccaagggccttagtcaaaagtgagaggaagaatattattttaacatcttattatagaatgaaaatgcaacagaactattgcaacatgaatgttagttcagatggggcaaatacaacttttaaatttgggtgtgattagttttaaatgttcttggaagttttttgcaccaggttaggtaattgtaagtgaaaagaagtgacgcagatcaaagaaattgttgaaaaattgcatccctgataactagtgacatatttttaatgtgagttatatacaccctggaggtactgccgttagtgaaccaatttagttggagatcccctgggtatcaaagtcataagagcaatggcgtatattgagaaggatattttcctattttggaaggtttgtacttacaatctatgtgcttataaatctttatcgaggattggaaaggaataacttatctagtaatttctaaattttcagaaatgtttgagggaactaaaatgctttgaatttgaagaacaccttggggtcgtattgagacttcttgaaaggctgctcttttttataatcctgaaatagattatattgcaaatccccctgaatatatgaacaatcggttttgaaattcaactgaactgtgtcacagtgttagttatgatcattgtgaaagctgcacggagaggttatcttaaaacccacatggcacatttcaaaacagatgtctcataaataaaatttgaaaactttggattttttgcaaactgtgttttaaatatcagaagtacattgttctcatttggagcacaactttcctttaggtttttgccttatttgttaggttgtatgtgacaatgatactttccttatggataccaataggattatttttttttcaattttttttttcttcctcatcttcattttcttttttttttaaattatactttaagttctagggtacatgtgcacaacatgcaggtttgttacatatgtatacatgttccatgttggtatgttgcacccattaactcatcatttacattaggtatgtctcctaatgctatccctccccaccttccccaccccacgacaggccccggtgtatagactggtcttattctaaaagaatgtccatgtccccaaatactggaatagtatcagactagccacggccataaactcacctcagtgttaatcctactcagaattttttagatttattacatgtttattactttcttcctttataataggtaggcaatggatgatcacaattaaactgttaacctagaaaacattttagataagaaaagtataaaagttctgtgatgcaaactctattttatttaaaaaaactctgtaaaacctgtataattagcaggaagctcctttttctgttaaagctaagaagagataggagaatgcagattagataaaattgtatcaaataaaaattttgtacatctgtactgattatttatgtttaggacatttttcatgaaaataaaaacatgctatggcaagaaaaaaacatgtagctgttggaaacagttacccaggaaatgttcttttaaaatatatatctcttacaatacacttaaaatcactttgattgtaatgaaaataatacaaattcactgtagcatattaaacatatggataggcaaaaatcaaccttaggaaaaataatcagtgaataaaagcatggactgtggagccagaatacttgagttcaagtcctgatatgtccatttactagctgtgtggcatcaggtaggtgtgccgctctttttgtgtctccattttcctcatttgtaaagtggtaataatatcattttcttatagggttaaaatcaagattaaattagttaatatttgtaaagtgcttagaacagtatcttaaacatattgaatactatacagatgtattgtgaataagatatacacagtctctttaagtaaaaattttaccctatacgtcttgcacctacttttttaactttgtatattataattattttccacatctttaacattttattattaaaagcttaaagcattttattgtatatttctaccaacaattatataaactgttacactttcagcttgttttcagctttttattcttttaaacactcagcataattgttatatctaagtttgtagcagttataattttagaataaattacaagaagtggaattacaagtatatagatgcatacgtattttttaattaaaattttacatctatatttaacagttttctcttcttttcctttttttctttttaatttagagatacgttcttgctctgtcacccagcctggagttcagtggcataatcatagcttactgcagccttgaactcctgggttcttcctgagtagcttagaccataggcacacaccactgcactccattgtatacacatttgaaagcattttttaaatatattaacaaattgctttttgtaatgtgccactgatgttcttcccagcatcagaggatgagggacattgacacacttttccaaacctcttttctcaaactacttgtttatattatgttgggaaaggtgctcccaataaaaactttctcatttgtcaaattaacattttaacttttattttaatctcttttctagagagtgttttaaagttttaattatatgtacttgaacagagttttgaaaggagttttgtaaaattaatagtaattatgggtgttagaatatagctttgaaaaaaatgtgtcaactttggaaggtagcaagaacttgactctctcttttgtattttaacataaattatacatttgtgggaaagtgggtgacttgggaggaaaaaccagtaataggctgcccattacacctgataacaattactactatgaaccttctgtgctaggcactgtgatagtgtgtgtatctctctctctctctgtctctctgtctttctctgtgtataacatatattttatgtattttcaaatcttcgtattgatatattaaccttatgggacaggctatattattacccagttttacagatgaagaaactgaggcacagagaggccttttattcagaacagatgtgagcaggcacccacctatatgtagggaaaagaaatgattacctgagctctgatcacagcaagtctcatgcctttgagttgtcactgactctctcagagaaagccagagatctccaccttatttgtgcttaatgaccttcggaaagaaactgccttaaatgatggctgtcttccatttgtgtaactttaaaagttatattttactttgaggtgttgaatctgagaggtggctatgttttgtgaacttcagctccctttagaaaaggaagcagtgtatctaaattgcccagttgctaagcgggtcttatgaataagtcatttattcaggaaaaatgtcttgatcacctactatgtgtcagtcatggtcccgtgaatttctggggttacatgattaagatagcagccctgcccttaaggaacttgtagtgggagacaaataatatacaaacacgtaaaataatgacagactgggtataaatgctatgaggagatagcagcatgatatgatagagtaactgttctgtgaatacccaaaaaccgcaagcacataccatttctgtctctgaaagggagtgaaaggtttgtctctctgagttagcatatagtggcagagcattttacagaggtcctgagagaaaatttgccatagaaagtctgtgctatgatttttttgaaaaaaaaatataggaaatatgtggccagctaattgataagaaaacaatatttctcaaaaaaaaaaaagaatatgtcatttgttatttaaattgttgagggacaacccaaagaacaccattcaaagtttctgtctagattctggctctgttctgccacattgataagttgtgtggctctgggggaaccatatacttctgttgcttgatttatttatctagaaatagaaaaaatatgtatgtcaggatataacttaataacaaaccctgtgtaaagctgatttcttctgtatgaaatggtgtttatgtgtaaagcactggtgattatatccagttacctaatacccgtacaggcttcaattcacaaagtcaggatttcaccagttttcccaattttatttaaccaagagtattctctgtaaaagtgaattattgctgaagcatttttaaattccagctatgttaataagaagccatttgagagcagctgtgcttcattgtttatttttattcaatatttaatttggaaaaaataatagagagatgtagaaaatagatttttttttttctgggacaatcatcatacatgttattgacatcagagagtgggcaatttaaccttctcaaaaataatatattcgctaagaatctcagcagcctcaggtcaaaaatgaaagcttacgtatatcacaagggatagtcaaatcagtatgaaaaagtctgaaacctgtattttctggctgaacatgatcttctgtaatcacaatagaaagctatttcaccaggtgttacccaggaagggattggtaggtgatattacctggatcaatttttctatgctgtgaataccaatgtaatcattttctcaggtttttgtatttttcttcaatatccatttaaaaatgaaccaaatactgcttcttgttctactgtagttcttccatggcactgtttcaagcagttaacaaatttcatatgctgaaggagtaaaagttaccttggtgacttaagaaaatatccatacagacatactcattcttaaaagggtttcttctgtgcgaaggaagtggtttctacaacataacatgtaattactacagtaaattgtattgtgaatatgaagaagatgaaatctgagccctatagactcatggattttgctattacgttttgtcttcagtttctttttttgttcactctgttgtcaaagtactttgtacattcttctctgtgaactttgcagatcagagaaatcaactgaaagaaggaaatgatatgttttagtttattcaaaggtatctatagcagtggtccgcaacctttttggtgccagggaccggttttatggaagacaatttttccatggatcgggggatgggtggaggtgggcatatggtttagggaagaaattttcaccttagatcatcaggcattagttagattctcataggagcatgcaacctagattgctcacatgcacagttcacaatggggttcatgctcctatgagaatgtaatgccactgctgatctgacaggaagtggagctcaggtggtaatgctcgttggcatgcagctcacctcctgctttgtggcctggttcctaacaggcagcagtatcggtctgcagctcagggattggggacccctgatgtatggtttagaaataaattaggataatgtatagatttataaaaagtggcttagaggtacccgctttcttgtcactttattaaaatccctttaagattaaaaagaaaatgtgtaaataaatgtgaaaaattatatatcacttttttccccagaatctccattgttacaaggagagaagcttagtttttgagagaattctgccaacatttgctgtagcagatgtattttagttgtttaagaatgtgtgataatctcactctttcattttggggtggtctttactttaaaaataagtgtaaatggattatggcatccattttgtaagtcatttacaaaagtttgcaccattctacctcttgtgacattgaagaaataaggcataattttcattttgtcagcaaatctctctgacaggcaagggcttacatagtgtatacagcaacattctctaatggattgcaggtcccatatgagaatgtgcaatgtgctcattaaaattacagcagcagaaaaagcagaataaattgccaccaagtatttaactatgacatttgtatgtatttctttttgacatgcctatgggcatgtcactgtaaattgtccatgaggattgttgtgacagctttatggactaaagttagggacccagcctctcacttggctaaaggatgacagcctaaataagaagagtatagtgaaatagcttatgaatagctgtatgattctgctataacgaagtttaggtacaaactatcccaagtaccttgggaatttggaacaaaaaatgagaaagcaagtatcatcgaatgatttccaaatatgagaaatatgaaggctctatccctggaagaatttaacatgcaacagtagtatctacctctcaggactattgggaagattagtgaaagctgctagcccagtgactaggatacgtgggaagcttcatagatgtttgattttttcttcttgtcttctggcattgtctttcttttcttttaccaaaccatctaaggaaataaatgggaaaagagcaggtgttatagcaacaataatcattgcaaattttctggggaaagtttggggcaactgtagaaggattcaggaacaggtggaatttgtctagtctttgaaggaacttagaatttaagttacagttgcgggaaactgggagagtattcttggcaagagggccctcaagaacagaggctcagcagcagagtttaacctagtgtttctggggaacagtgcaggaaacagctaaggttggaggctgattgtggagggcttcaacatgagagctcaggagcctgtggtcttcatcttctaagctttgggcgaagttgttgagtaattttacttgctagaacaatgacaacatttatagagaaaagtatgtctggagaggagcaggtttcagacacaagatttatttttagacatatagaaattttaagagatgagaaagtcacaaaagcatgggaggaaggttagagctgtatatgttgaagccacaaaattggtgagttttctgagagagagacaacgaggaggaggaacaggaggaagtatgaactcttaactaactttgacatatgcttttattttgtaaatgggagagacaaaacaagcaagaaatagagttaaaggaatggtcactgagagaaaaggagacgttaacagtgaagatagtcatgtttggtgggggagagttacttttctttattgcctctcagatttaggcactgtttggtggctttatgtgttttaactcattttatttttataacaacccaattaagtagacagtattttcaccaaattatggaacagaaaagtgggcttttgtcattaaatagggccatgcaaattttaagtggcaattgagttgaaaatatttattgcaggggattagggagttggtgattagaaaacagcagaggacatatattttctggagaaattttgtggtgtgaaaaaatgttacagtggtagatctctggtatctggggtcagaggagattttcagactgtgatatgaagaagattttatcttctttgcaactcacgagaatttctttgtaggatgggaagaacatttctgagaagacagtaagagggagctgttggagcttagctgagctatgttttatatggaagccaaaaattttgctctccaagaaaaataagtgagaaagagaaaagactggtctcagcactctgcagtgggaggattgtgaggtgagatatggtgactagggatcaaggagagagactggaaaggagatgtgtttaatggggatttttctgagtgaaactctatgcttcatggtacgtgacacctcctgttatccccacacatttccgtaacactacaaaatccaggatgtacttggtatgattacattttttttcatgattgcctgtaagggagatgagatttatatcaatgttagtgaagtactaaaacagtcattccatatggaggaggacccatattcatggggatttaatttgtcattgttgttttatattggtttaagattaggatagttgaggtaataaatttatggggtgggagaagaaaacaatagggagtgagagactaaaggttcaaaagtgagattagatggactcaaaaataggtttataggccatgaataagaggtggttatcttttcctcagaggcagaggaaaaaagagaaggttggggaaaatggaagggcatttttaaagtgaattggtggttaagcctatgataattttgggagagacactcaagatgaggaattatgcctagatcaacttcattatatcaatctctctatcaagcacggagcagtatcattttgagggatgaggaagcagcattaaacctaagatttaaagaaggcaaatgttttggaccatctgactgaacaatgaataaaatgattgcctagaccaagaaagggtttgaatgctatcagattcattttataaatttttccaggaatattgccacttgcattagaagtaaataaagttgaaggatatatttaggtaggaagaactagctatgcttcaaattatatcagaagggttgttccccactttctttgtaagaggcggttaggtatgcaccagttttcttaaaagagacagtccgcctaactaaatttatatgtctcagggtatctaattaaagtatctatatagatgtgcataccgtctatgaaatagctcagtattttgcctccaagactgtaaccttggtggaatagtccaaatatgattaattttcccattaactggtttagaatgttgctgatgatgggctaaatcagatatgtttcatggcatttctctaccctttgttccttgtgagaaggacttttttgattaaagttcccactgaggagatacacctgggagccatggtcttaaccaaatgatcctaattttccctagaccacagtggattggaatacgggagtctcctgacaaaagagctaagcagtagttagtgacttatgaaccattgcctggcaagaaaaggtgacgtaggccaatacaattctccctttagggaatctaatttgataagtgctaagacaagaaactgcaagtgatcactgaaatggaaaggatgtcctgaagtctaattgtggccataatggtgggttagttatgagtccaggtccagtttctaaaatgactttaagatgtaaacctaaaaatgtaatgttaaaagtttgtttttgaagagcattaactctcggcctcatgggtgaaatgatgtcatgcacctgctgtacggagacacacaatgtcttctcagttgaacagtctgaacatttagaaacaacaccctccctcctcctgcagaatgtgactgctcagagacgtagagacaccaagactgaaaatcctatctcccaagaatcttttatcatcttctttcctaaaacatgaagactgtatatgcgtatttcttcaatgtagaattatttctgttttgaagctagaagatgttttcaaagagtataaaggaatgcagtggagccattaaatccctcattgacagtttgtattctctgcataaccttgaatatcttattagcaatgtcagtctgctttttgaaatgcgatctcactgctcaaagtaacctccaacacacttgccagttgaaaaaagaaagttcctatgtggttaaatagaatccaaatttgtcaatcctaggtttgtttcttttttttttattattatactttaagttctagggtacatgtgcacaacgtacaggtttgttacatatgtatacatgtgccatgttggtgtgctgcacccattaactcgtcatttacattaggtatatctcctaatgctatccctcccgcctccccccaccccacaacagcccccggtgtgtgatgtcccccttcctgtgtccaagtgttctaattgttcaattcccacctatgagtgagaacatgcgacgtttggtattttgtccttccctctgtacattgttcttatttcatttcatactaagaagatgttataaagccaattaaaattatatgcagttctctgatgatataaaggaatgcatggctctgagggagagaagtggctaaaggtggttgccaggggcaaccagcgaaggagctgtaaattaataggcttgttcctttcagatatggcattaatcagaagccaggagggaaatttaaaataatttcttagagcaaaaacctcttccagtattagggagattctaaacatgtttttatgctaggtgaatttatgggcctcctggggggtctccttgaagggattactgagaaccaattctggagagagacctacatctggcaggatcaaaaaagacaaccacagagaaagagatgattccctaaaaagagagatgatgacagacttcaggaatcaaacctaaattaagcaagtcagggaggagatgctttctccttaaaagccctaagaacggtgtgaatcagttgacattatttctattttgttttttaaaaagtttaaaagtttccgcttaaatattgctgtttaagttcatttaaacttcagctatttgcaatatgtatatatgtattttgtttttaattggaaaagggtttggaagctcatactaatttattacttcaataaagtttagggattgcaatttagaccaaaatcgaatctttgattctgccactaactggtgctaaagttattcagattgaaaggatattttatcaggtggctctttgaaggagtgtgtgtgtgtgctttgtccatctgttagctttgttagtcaagacttctatgaaatgttttgcagtgtcattagtataatgactcgtgattaattttttaaaaatctgttttttttaaagaaaaaagctttctctcctgaatggtatgattaccaatgtgatatgataaatttttgtttctatccttggttttgaacactaggaattgtatgcataatttagcgttcaataacatagccctataatggagagatgtaggtcaaaggttatataaagttgtatatgtataggatgaataagtctaaagctatgatgtacagcagactataattaataatattgtattgtgtttgtgataattgctaggagtagattttaggtgctcttaccacatacaaaaaagggggggtaactatgtgtgatgataggttttatttgcttgactatagtaaccatttcactgcatatcaaaatattatgtggtatgccttgcatacataaaataaaaatacaatagcccttttagtttaattttagtaatacaatctgataaaataaagataaaattaatatgtaagaataatagtaaactggctgggcatggtggctcacgcctgtaatcccagcactttgggaggctgaggcgggcagatcacttgaggcattcaagaccagctggccaagatggtgaaaccctgtttctactaaaaatacaaaaatttgccgggagttgtgatgggcacctgtaatcccagctgaggaggagaattgggaggctgaggcagaagaattgcttgaacccaagaggcggaggttgcagtgagccgagatcacaccactgcactccagcctgggctacagagcgagactctgtctcaaataaaaagaaaaaaaaaaggaataatggtaaactgtaaactccctgaaatggaggctttggtcataccttactgcctagtacattacatatccttagtacctagtacagtttctgggacatatttagagctcattacatatttcttaaaaacaatcagtagttcatagggaattgtgagtatgattataggattatattttttatttggcaaaatcaaaactccaccaaatcacaaattttatttggtaaaaatccatgtaaagcagttgtgttgagggctttctaaaaagtgctgaacttaaattgttctgatagacaagaaagggagaatgagttcatatggtgagcagcagagatgagatgaagaatcccactcgtgtacagataaaaatacctagctaacattcagcaaagtggggtagagggctacattaaagttacccttataatgtggttcctctctctacgttaatgatgcataaggagaatatcatttgcagatgaagtaaataggtttgatggtgttaagagaaaaaccttagtttaaatttagcagagtttaattgagcaaagaatgatttgtgaatcaggcagactcctgaaccagagtagtctcagagactagtgcagcagtggtgcaagaaaatttatggacagaaaaaggaaagtggcatacagaagatagaaatgaggtacagaaacagtgccttatttgatacaatttgaacagttgggcccttgattacttggtgattggcaccagagtaggttacagtctgtttacacatccagtcagttacagtttaatgtgtacagagaaacctttgggctgaacttaaaataggtaaggaggcaactttaggccaaacttaatttaacaagggataactataggtgagatgatgggagtggctttggctgtagaagcaaaagacagtatactaagcattctctgaaactgtttgtagagttgttgaatttcctgttgactttgtgagccatagtaaacaagctaaatgttttgggttacctgtgtcacctgttgaattctgaagctattgcttgattggaggaaccccttccttgggagatatgcagattcagttctagactgccaaaataaagcaaatatttcaataaagcgagtcacatgaatttcttggtttcccaatgcgtataaaagctatatgtacactatactgtagtctagttagtgtgcagtagtctagtaagtgtgcagtaggattatgtctaaaagatgtgcataactcagttaaaaaaacttaattgctaaaaaatgctaatgatcatttgagctgtcagcgaattgtaatctttgctggtggagagtcttgccttgatgataatggctgctgactgatcatgaaggtggtttctgaaggttgagggagctatggcaatttcttgaaataaaaatgaagtttgctgcatcaattgacgcttcttttcatgaaagacttctctgtagcatgtgatgctgtttggtagtcttatacccacagtagaacttctttcaaaactggagtcagttctctcaaattctgctgcttctttgtcaactaaatttacgtaaaattctaaatcctttgttgtaattttaataatgttctcagcatcttcaccaggagtaggttccatctcaagaaaatactttctttgctcatttataagaagcaactcatcatctgttagttttatcatgagacctgcagcaatttagtcacctcttcaggctctacttctaattctagttctcttgctgtttctataacatctgcagttgcttttttaactgaaatcttgagcccctcaaagccatccacaagggttggagtcaacttcttccaaactcctgttaatgttgatatttttacctcctcccatgaatcacaaatgttcttaatgtcatctagaatggtgaatcctttccagactattttcaatttactttgcccagatacatcagaggaatcactatctatggctgctatagccttatgaaatgtctgtcgtaaataataagacttgacagttgaagttactccttgatccatgggttgcagaatggatgctatgttgataggcatgaaaatctccttgtacatctccctcagagctcttgggtgaccaagattgtcattgtcaatgacatttcataatattatggcggtaatattttgaaaggaatatttttttctgaacagtatgtctcaacggtgggcttaaaatattcagcaaaccatgctgtaaacaaatgtgctgtcatccaggctttgttgtttcatttatagagcacaggcagagttaggtatagcataattcttaagggctcaaggatttttgaaatggtaaatgagcattggtttcaacccaaagtcaccaactaccttagcccctaacaagagagtcaacctgtcctttgaagccaggcatttatttctcttcttgagctatgaaagtcttagacggcatcttcttccaatagaaggccattttatttccattgaaaatctgttgtttactgtagccattttcatcagtgatctgagctggatcttctggatagcttactgcagcttctccattagcacttgcttcttcacctggcacttttatgttgtagaggtgacttctttccttaaactgcatgatccaacctctgctaacttcagacatttcttctgcagcttcgtcacttttttcagccttcacagaattgaagagagttagggccttgctctcaattaggctttgatttaggggagtgttgtgcctggtttgatgttctatccagaccactaaaactttctccaaatcagcaagaggctattttgctatcttatcattagtgtgttcactgtagtaacacttttaatttccttcaagaacattttctttgcattcacaacttggctaactggtgctaagggcctagcttttggcctatcctggcttttgacatgccttcctcactaagcttaatcatttctagcttttgatttaaagtaagagatgtgaaactcttcccttcacttgaacatttggaggccattgtattagttattagtattatagtattattagttggcctaatttcactattgttgtgtctcagggaattggaagacctgaggagagagagaaaaggggaacagctggttggtagggcagtcagaagacacaacattcatcaattaagttcactttcttaaataggtgtggtttgtggtgctccaaaataattgcaagagtaatatcaaagatcactgatcacagattactataacagatataataataatgataaagtttaaaatattgtgacagttaccaaaatgtgatacagagacacaaagtgagcccatgctgttgggaaaacagtgctgacagattgcttgattcagggttgccacaaaccttcaatttgtgaaaaacacagtatctgtgtagcacaatgaagtaaagcacaataaaatgagacatgcctgtatttacttagtataggtacttctgtaaattgccatctctagcaatgatggcagccagttgtcatagttaattattttttcctgggtcttaccaaggagtttgagcccactcaaagagcttagagtaaatacaaaggagaatcaccattaaaatctttattctttatggtttttagttatgtttatttaggtgatgactgactatgcatattgcttgttttgcaaggtacttcaaatctctcttcgtagttgccctgacataaataataaaatgttttttaaaatgttacatttttatggttctgaaaaaaataaaccctcaagtcttaaatcaactttttatgtaaaacctacactttgcaggatatatatgggatttatattaattaaaaaggttatagactagtaaaacagtgctgagggctggggaggtagtctgatagagggtgaaataaagacctcactgagaggtgacatttcagcaaagtcctggcagtagagagggagagggtggtaaatatttaagggaggagtgttccaaattgaagaatcagtaaaaatgaaaagactcaaggcaggagtgtgcctggtgtgttgattcaagaccaagaagcttattttggctggaatggaccacgtctgggaagatagcaggagatgaggtcagaaagttcataagggggcctgactgagtagggctttagggtcttggaaaggctgacagtaccctgtgtgaggtgggaaaccactgtaatgttttaaagcagaggaggaacatgatctgatttaggctttaaaatgattattctggcttctatccctatttcaggaatatatttgtctgtaagcaacaaaatatctgactaatagtaatttaaacaaacagagaattgcttttcttattgttttctttgatgcaggtttctgaaattgattcagcctttccatgatgaaatcagggattcaggctcttttgttgttgttgttgttgttttctgtttgagacaggggacagagtttgactctgttgctcaggctggcgtgcagtggcacgggcttggctcactgcaacctctgcctcccaggctcaagtgatcctcccaccttaccttcctgagtagctgggactacaggcacatgccaccatgcttggctaattatttgtattttttgtagagatagggtcttgccatgttgttcaggctggttttaaactcctggactcaagtgatccacctaccttggcctcccaaaatgctgggattacaggcgtgagccaccgcacctggtccccagactccttttatcttttttctccaccatcctccacatgttggctgtccacattgtactttttgtttcatggttataggatggctgctgcagctccagacatcacatccttgttgaaggcagaaaggagggaaagacagcacttagccacatctacttggaaagctttacctctgtgttacaggctatctggatctgtaaggaaagatgaaacagttaaaatattttcattcttagctcctatagaaatggcagttaagaaatgaagaagttgggggtggatattgggtcagtcaacctgcagtgtctgacagtcatgattcatgatacctgttgtggtttatcattttaccaggctcttcatgtacattttctcattagggtcctgcagtgatcctctgggggagagcaaggaagagatggcaagcttcattttagagatgagaaagccaaggcccagagggaaagtgactgcctcacaggtcttttgatgacagggcagagactaacacagatgtcactaactctcatttattatatcctgggacctaactttagcattatatgaataccttgtatgaggcattaccaattgcattcagcctcctccagtaaatgagagaagccacctggtctctgcaagggtttagagactatgattactttgtggcttttctctagttgtcccagagctgagcttccgcaggcaatgaagaaagccaaggagtaaggaaaatccttactctctggagggaagaggcagattcatccttctggcctgtgacacagtggaaaagttcctgagaattcaggggtagagtatatttcttatagaaaaacattttaaatgcaccagaagagctctgtctgtaaagaaagtatatttcattagttttataaattgcataattattttatcaagataacaatggccctttgttttttaactaaccctgtagtttcttcataagatttgcttaaagctgggtttccaaatagctctgggagcagaacagccgcgctcgtgccagacaggtgtttttcctcctgcctgagtggatgcagctgggagacactgctcttcagatccatcttatgtccaggtgtgcgttcacccttcccttgcacatgactgatgctgttttatccaacagaccttgggattgaaataatgaatgacctaaggctccaaaatggctatgaaagaatgtagaaagcccctaggtttaggcataaataataaaattaaagggaatgggaattttaacctatgaagctgcaaatgtaaactacatttaatctttataacaacgtgtgaaagatgtgactattttattacaatgtctattttacagataaagaaactgaaatttagagctataattaaactacttacaatcagtattcaaccaaaaacagatttggatctagttgtgttctgcttatgtagctgctaacagctttctgtagtgtcctgggcaccctagcaaaactcgagggaaaaatgaggagcggtgatgaaattctggggcatcttaggaccttaatttcacagataggtaatatcacatgtatcctataaatggcatgtgttgtggcctggttcaagtctggtgattggttctcaaattcctgtgtgcttaaaattcatctaaggagtgttatgaaatgcaggtttctaggctccgatccggaggttctggttaagcaggggtggtgacaagcctgggaatctgtagtttagtaagcatccaggcttctttgatgtagattttctgcaaatgacatttcaagaaatattgctttaaattgaaatttaatagccagaatggcactaggcattcaggaggcttccagcttcacatccaggagttggtagattgatgcacttctcactaataaagataaacaagttatctccaatggagactttttcccatttattccagtttggcattgagaactttgaggagatattgaaaaaccacagtagctcttttcttggtaataatagagaaacaacaaaaaaaaaaattaagaggcaacatacagcatgctttatttactctttccctttactttggatctggaatttttttatttgttttacctagccagacacaccagaagagattctcagaggatgctaaaaatattgctcttgtcactacaggcttcacattcccgttcctctctctctgcctgaatcctcagtagaaaagatggcttttgtcttttgtctctttctgacaagaattaggtccctgggttctgagttacttttgtgataagttcttgcctgtctggccagacacactaagtccacactgaggtcaagcgtttaggtctcaggaagtcataggaccctatatggggctcaggttaggcagggcttttgtttcaaatagggagctcagtctggtaatgaaaagaagaaaataaaacaaacaacaaacctcctgaatacagcttgaatataacaaataacctgaatataagtttgtttctccattccacaaatgtttattgagtggctgctgtttgttagatatgtgtcaaggaccaatcaggtaaataatttatgattaaaagaagcgatttagaaaaccacattgtcggccaggcactgtggctcacgcctgtaatcccagcactttgggaggccgaggtgggcggatcatgaagtcaagagatcgagaccatcctggccaacatggtgaaaccccatctctacttaaaatacaaaaattagctgggcatggtggtgtgtgcctgtagtcccacttactcagaaggctgaggcaggagaatcgtttgaacccagaaggcagaggttgcagtgagctgaggtcgtactactgcactccagcctggcgacagagcgagactgtcccctgcccaaaaaaaaaaacaacaaaaaaacaacccacattgtcttttgttttctgttgaaaacctttagcatttgcttccctattctatattacaagcttttaaaacattaataagtagatcatttttgaacacttattgtgcctaatgcccagataactctattttcaggccatgtaaagaagaatatcagagcaaggatttaagaggcaaccaactgtgggtcacactttgcttctgctttccttcctattggctgggtgaactcgggcaagttactttgcccccacccccaataccccatcaagcattttttttttaaacggtaataccttcaagtatgtttctaaagattaagtaactaaagaatgtaaagcatttggcatacatttagtgtttaatgaatttcaattcatactattattgaggttttccaactgctctcaaggagactttagtacagctgggaacacagatatgtccttatttaaaagtgtattgaaagtcaacgtggcaagtttcagatcagtcgaagctggagactggaggtcgttggagtgctgttggaggaagtactgttggaggttggagcaaggagagtagttgttggaaggaacttcttagaagagccagtctcgaagatatggtgtagacaaagcctgaagctgcactcttactacatttgcaagttgatgtccagtgttcggtattctatttgtggctacacaaattgagaaatgtgaaaaatgtaagtggcagaaaaaaaggacagaaaattatttctgtaaggataagttaaagttattgtgattattttaatctgggaatgtggttcttaatgattttagtacatgagccattttggaaaggaaaaagaaaaagatacaagacaacaaaactagtgatagtgattgtgttctttatttttgttggcctcacatgcctaacagaggggttaacacaagaagtttttaatcaacctttgttaatgaatcaatgtaccttccctgttttctgtttgattttacaaagccacaaataaaagtaacttttgaaaaaaaaccaacttacctggaatggagaaactggtagcctttgaagttataccagttgcattatagtcaaggtaatcatacaatttttcatccaaaacgggacacttctgagaatcaaaggggacttttattaataattagactaagacattaagtatcaacttgaattgtcctgggtacatgggaacatttgggcatcctgattatagtttttatttattaaatcccttctcattagtcttttattagttaataccagaaacaaattaatagcgcctatggaaattaaatttacgaagtctcagtcttgcaaatgctataagaaaagttaagggattaaaataaaatgaataaataaaagttaatatttattgaatgcttatttgctaagcaattatatctctcaattatagatataaagctcagagagatacataacttccgtaaggttctgttgctagtaagtaatagagatgaatgaggctttaattctagatttgtctgacttgggactttatcatgatacaaatgtatatatatcatatacatttggcagttctggtctaaagcaaaaagatgtttaatagctgtgtttaagtaaaaactgcaattcttacaaaaaattattgatgcctcagaaacagagaatttcagaggaggaggcaaattcaaccttttcatgagaggtgagatcttgtttcctagaatccttaagaacatgctagcatctcttgcttcgtggtaatttagacaaaattgagaaaggatgtaaaccccactctttatacactaatgcattagtgtaacccaatgtacatgaatgcattattgtttcttgtcattttctccttcatgtttgaggcttattcagttttctcagaagttgagttttttcaacatatgaagaagccctgtgctttctccatagtggtaagtgctgatttttttagactggcttagtcataactttgtctacatgtaagagactagaccagggttattttgtgattcccaccttaaacctgagctatgctctcctcttaggttttggccaagactgggtacatctgaaggatggtggggatgttgtattaggaacagagcacatggtggcttcaaatctaggagctggaatcagctctctgtgttcaaatcctgattcaggcatgcagtagctgtgtggccttgggtaagttacttcatttctttgtgcagagttggcttcatgagcatgtgatctgcatagttgcacagcaccctggtcaggagggccctgcacttggtttaatgttctgtagttgctatcttgaaatgtgtaatattttttgaacaaggagatccatattttcctttttcacttggtctcaaaaattaagtagctgattctgtttcttagccttagattttttacttgtaaaacagggatagtaatattttcttcatctttgtgtacagaggatcctcctaggaaaggatatgccagtggtaaggtcaagtcaggcagtgagtttaatctaagctaatttatttaaaaaggaaggttgaacttggctattatatggtgtccacctctcatgttgttttttagcttatcttgctgtagacttgtgccttggggtataggggggaaattatagtactcttttacatgagaatatctaggagacattaggagcaaaagcagccttgttttgaaactgtggccaggtagtatcatatgaagatggtggggagggtctcttttcttcagtaaaactgggctttggtaccacaattttgggatagcatcagtgccataacttggtagactagcattgtctgagtcctagcagtgctgacaacagtggggccaaagttccctattaggtttttgaggacttcggagagccaatcagctgatgcaatcactgccgttaccaccacctaaatgaactgactttttcataagaggaaaatggcagatgccaggtagtacctcaggcattgcattaaaaacatacgtgagaaattgccttcattctctaagaaataattggaatggattttgtaaagcactggaagtactttaaaaattagtgaggaaatgacatcagagaaatttgggttattgataacattaagaactatattgtattgtgagtgtctgtggcctgtgacacaaaagttacttgatatatgagcctctttttcttctattaattaatgacaggaagaattggatttcaatgacatatatagcaacataacattcaagcaaatcatacttgaacaccaaaggcaaggaagaaacaatctttaatgaaaaggttactaattcatctcttctttataaaaactaataatggatcattattgtggtgttagaaaggttttcatatcttgctcacacctcccagctcatgaagttaaaagctatttagcatgtaagtgagatattctgttcatgattctacatttataccatagatttaaatatggatagcaaatcagcacatatctccaattaaccagtgctgatatatatttgagtaatcagtgtccacagcaatatggtaatttctgattatgcatggataaacatagttgtccccttagtcgttgaactttactataataaatatagccctttgagaatggtagtagataatgaactaatgggggatttattgtagcaggctgtaaaatagcccgatggaagatatgaaaaaatcaaaacaccaaccatttccaggagcagtagtagacaggccttaaactattgatttgacagtttgggccattagaatgaaggcccaactaagaagcagatttcccagtctgcagagcctgccagggagaagaaatatgccatttaacaagtaccttgcccaagtgtttttgcttctaccagctggcaactacagaatgtggtacagtctcatactcaccaggagacattacaacaagttcctggggagttaacaaatagaaaatacccacgcaggcttagcaggaacaaagctttaatattcttaacctgctgaaggcagtgaaaagctctcattagaacagttgctcaaatgagtcacatttctatcgccttccaagcctgtgtttctttactagatgctactttgaagctggcattgccacaggtacaacttgctgcaaacaggtcaagaactctgctctaaagttgtgcagaatttgaaaatctttattttcatttaatattagattcatttcagtttatagcctgtgtgagaatatttgccagaaggaactcttttttttgttactttggtctgatctaaatttattacttagaaacgttgagctgaatttattacttagaaacataaacaatggcttgaactactacattttccagccctttaacgtggccaaacatcatgtaacatgtcagccctgagcttggttaatttattgcacctttctgttgattggaagggcatgaatcctagaagattttgctttcattttgaaataccatctgctaaattgctaaattatattctaatcacttttttttatatgaagggattcctttctaagaacaacttagaaatgttaagataatttcacctgcaattgtgaccttgaaaaagatgcaaaatgttactgcttcattcttttggcatagtccttcaaaccaaacaggattccaacagcataattttattattccttttgctgacagttcaggttcttcattcatactttatattttcttatttatagaaaatattttcctctcaaagacataactttagaaattccaataccaaaatatgttgttgtacttatattttacaaactcaaaagaaggaggaaaaataccagtattttttttgacatttcctacaagcaagtaactcaaaagaaatgcaaaaaaccaaagagacagtattcagaaaggcaaattacaggaattaagtaatcataacttctgtgttgataaaaactcagaaaaagtaaatgacgtaattatccaaaatgtttaattttgagaaatagaacactatttatgtaaaagacatcttcatatttttgcacttttgttcccctcaactagtattttgaagggtcacaccttcagagcagagagatatgccaacgacagaaatatttaagattccacagaattttagttgatttgttgttggagttaacaataaaaccatatcaagtaatttgaactggatcagttggttgtggatagatgtcaagcaacatacatgacacagctctttaacgttctaggaaagtggctgtccccagctggatacagcatttcgacagcatgtgtgcaaacatagctggttcatccttggtgagtcatttacagccacgagtatacactgcaggtgacacaagaaccagtgcacgattggatgaaccacagaggaggcactttggtgctcaactttcagtatattctgtttttacatgtttacatttcaatttttttttcctgaggatactcagtttaatatcttctatttgagatgccttacaattgtgtaaaattcttaggtattattattattttgtttttgttttgtttttatttatttatttttattatactttaagttctgggatacatgtgaagaatgtgcaggtttgttatataggtatacacatgccatggtggtttgctgcagccatcaacccatcacctacattaggtatttcttctaatgctatccctcccctagcacccccccaccccccaacaggccccagtatgtgatgttaccctccctgtgtccatgtattctcattgttcaactcccacttataagtgagaacatgtggagtttggttttctgttcttgtgttagtttgttgagaatgatggtttccagcttcatctatgtccctgcaaaggacatgaactcatcctttttttatggctgcatagtatcccatggtgtatatgtgccacattttccttatccagcctatcattgatggacatttgggttggtttcaagtctttgctattgtgaatagtgctgcaataaacatatatgtgcatggtctttatagtagaatgatttataatcctttgggtatatacccggtaatgggattgctgggtcaaatggtatttctagttctagatccttgaggaattgccacactgtcttccacaatggttgaactaatttacactcccaccaacagtataaaagcattcctatttctccacatcctctccagcatctgttgttttctgactttttaatgatcgccattctaactggcatgagatggtatctcattgtggttttgattttcatttctctaatgaccagtgatgatgagctttttttcatatgtttgttgactgcataaatgtcttcttttgagaagtgtctgttcatatcatttgcccactttttgatggaattgtttgtttttttcttgtaaatttaagttacatttcaatatgtaaagatatctcaagatattttagataaggcagatatgattatctcaacataagattttatgagactaaggggaagcaaaccaaaaaattgtttatctccagagaggtactattttaaagaaattaaaaatgagggccaggtgcagtggctcatgcctgatatccagcactttgggaggccaaggcaggtggatcacccgaggtcaggagttcaagaccagcctggccaacgtggtgaaacctcatctctactaaaaataaaaaaaaattagctaggcgtggtggcaggtgcctgtaatccaagccactcaagaggctgaggtgagaggatcacttgaacccggggggcacaggttgtagtgcaccgagatgatggcattgcattccagcctgggcgacagagtaactccatctcaaaaaaaaaaaaaaaaaaaagagtgcatatgggagtctttctctacgtatactgaggtttgatagttctgtccagagtaccattgtagaacctttaaaaccatatgagaaacacaaaattcttttctcatgttttattagtctgttctcacactgctaataaagacatacccaagactgggtaatttatagaggaaagagatttaattgactcacagttcagcatggctgaggaggcctcaggaaacttacaatcatggtggaaggggaagcaaacacgtccctcttcacatggcgacagcaaggagaagtgccaagcaagtgggggaaaagaaccttataaaatcatcagatatcatgagaactcactatcatgagaacagcatgagggtaactgcccccataattaaattacctcccaccaggtccctcccatgacacgtggagattaggggaactaaaattcaagatgagatttgggtggggaaacagccaaaccatatcacatgttatgcataaagatgatgtttttaagaaaggaacttttcttaaagaggatagttttatgttctaaatcagggtcagcaaactgtggctcacaggtcacatcttgcctcctacctgttttggcatggtctgtgaactaaggatgattttcacgtttttaaatggttgaaaaaaatcaaaagaagaagaatattttatgacccaatgaagatgatataaaatgtaaatttcagtttccttaagtaaagttttattggaacacagtcatgttcgttcatttatgtattgtctgatgtattgtctgttacatatggctacttttgtgcttccatggcagaatagagttgtaacagagactatctcacctacaaagcctaaaatattcactatctatccctttgcagaaaaagtttgccaacttctgttctaaattacttatcttctgattttgatacaagattgcataatgaaaagtaagtgtttttgtagttaaatgggaatttatgttataattacttttgtactaatattatgaacaaataattataacagatttaattaaactatagtattattttccattggcatttgcatgacatgaaataggtccccagtaagtattttttgaagaaatagataaataaattcacacatgaagcagaaaaatattggtactaaaagaataatccattttagccactttttcttctgatttaagttctgtttttgaaaacttgtttaatttagtaatatttgtcatgtctctgaagtaatcagttgccataaatttgaaaatgatacagttgtggaatcacaaactatatttgtgtctgatttaattcagctaaatgtgatcctaattagatgcatggtgttccagctttttgtgttcctcagttcattttttgtggtttctttgtgcaggcagtattaaacatatatgcaaatctctacaattattcacactgagagacagaagcgtctgtgttctgtgatcatccgtttatacatttaaaaaccttatttgtagagaatcaataattagatggccttggaatataaatttgacatttctgctgtacagtgatttccttctggtagagtcttaagttctgagtttgaagcttccatgattattgattataattatttttaaagttaatgacttctttggggatttatttgagactgaagtaagtccaacatgcaaaacttctaagttagtaaacaaataaatctccaatctcatcaagcaagttatttactggaagccttgtaaattagaagcatggtgccccacaattccattaataaaatctcatcagcataatttaatgtcacatatacagtattaggttttagagccagaaccacaattactatgagagagagtttaactgtataaatcttaatgggataaactttcaaaacagtttagaacagacaggtataacagaaaaactcccctaggtaaataatattaaaatattatttaatttatatttatgaaattatcagccaaataattgtgatttataagatcgtttcaacaaaaaggacagcaactattgctcatctgtaaaatagaataattctattagaatgacattgacaccatattaatttttatttacacagtttgatataaaatcaaaattgtacccatgttatttataagcatgaaatctatgggcgtgtagaaattttcagtatgagttagaaagtaacaattaaaaattttatggatttcttagtccaaattcaacattttttctctacgaatgtatgaaacttaattgatactactgagtattttaactgacttctaattgtgtttgaaggatgtattatctatgggttctatagctactgttttctataggtttctgttctaagtcagtgtatctatagggatataggcatagatatagatattactaaatatttttatcataaacaaaacagtaaatatccttactttttcttcttatggtttttaaaacacatttaaatgattgatcgataaaatagaattgagagaaatatgttacataaaagtactttctagaaagtaagggagaaaaattggaaataattacaactatcaaataataattatgtaacagttttacatataagcctttaaagacattaaaatataccaatttataaatataattcatgcaacatgaaagtatgttatgcaacacaacaatataatgaactctaccactcaaatcaggaatcagaacaatactagtagccttacactgaatcccttcacaaatagtgattattttgcattttggccttatttctcccatgcctttattttaaaatagttttatgtcatatgtatatatgtatatgtgtgggtgtatgtgtgtgtatgtgtatatatagccaaaagtaggttgcctgatgttgcttatctttgaacttctttttgtaatttttttcatctttgatgttgtgactatactttattaattttctcatagtaaaacattccattgtgtgagtataccacaagttatttatccatttttctatcggtggatatttggaccatttccagttttcttcccaattttatatgtgctgctatgaatattagtgtaaacatcttcctttaaacatatgcaaaagtttttctaggcatataatgaagagcagagttgcaagaccatggtttatccaaatgttcaacttggatattgaacatttatgttcagtaacataaataacatactaaattatcatataatgacaaactgttttcaaaaatgtttgtgccagtttacactattcctggcaatattacccttgatccatatcctcacttaaatttgtattgggtattgttagttttttttttttttttttttttttttagacatggtttcactctgttgcccaggctggactggagtgcagtagtgggatcttggctcactgcaacctccacttcctgggctcaaggtatcactcctgtctcagtctcttgagtagctgggagtacaggcatgcaccaccacgccgggctaattttttgtattttttgtagatacgagttttcgccatgttactcaggttgctcttgaactcctgggctcaagcgattcacctgccttgtcctcctaaagccctgggattacaggtataaactactgcacctggccagatttcataattcatgctaatctcttgggtgtaaaatgatctcattgtggtcttaattttcatttgcttgattactaatgagagtgatcatcttttaatatttttattactattactttttttgtgtgtgaaatattgtttgcttgttacatgttttgttcagtttttcctcccagttaggttgtttgtcttttttcctatttatttgtattaaattaattttcctaaattaaattcagtttcctaaaaatacaacaaaaaacacaagcaaaatattttgagcacaactgtttcaaaatgttatgtgaattctctaaagcagtacgttttatttattgaaatggtctccaacaagaaaatgtctaactggttaaatattggtttaaaggtagatgacagactaaatcatatatatagataggtagaaatatgtttgtgttttttcagcccaaactaagagtgatcctttatcctaaagcctttagattctaacatatttattattggaacaaggggaatactaaatttgggttgacatttttatgttatttaaacatcatttatattatacttgtactttgaaaagtcttccaatatccatggaacaaaaaagttcagaatgataactacctaagccattactaccatatctgtagatttttttaagcctttgtcagtagtctatcattatgccattatcaatataacatactatcgataaaaaggtacttaaatatcattatactaattattttaattatttaaaatacaactttaaaatccaattgtgtcctaaagtgatatttcacagtaagaggcaaatgtattatatgaagcatgagctttccctgttgtgtctttcattctttccctcatctgtatcagaaaaggtcacaatctggggataattattcacttcaccttttctacctggtgaggtggcttgaattcccaagatctgtccttttcagggcttcatactgggatctcaggcccccatgctaagcctaatttacttatcgacttcatatatttatagtggcataacaatgaccatatggattctctgctaaatatactcttacgttgttgcttcctatataaaaaagcactcaatcctactggtaccatcagaccagtgctccccaggtgatgtgaaagtttatctgaaatccagtttctgaagaataagtaaactttatatgagaggacttccctgaaacgcttgcttctctgtaccatctaatataagcagaatttctgaaaactacattcagctagggttgctgtgaagattcaataacagcacctgatatataggaagttttcattaaatgttaccagtgaggaaaatgatgtgattttgtattgttagaaatcttgacacatttggcatcatccatgttttgctattaattcgtaagactacctcattaaacctttattttgaatgtacaaacatttctcatttgtagtctttggaggcctacttttacacgtgttttgtttccataattacctaaagctaatttgacaggtactttgtctcattttttttttctactacagtgtctagaaatgtgctttacatagtgctcaataaatgtttgattaaattaaaacaatgttaccagggcatctgcatattataaccacagattaagaaatgtagatacagaacatgtattcatttgaacttcaaagtacgaatccaaataataaagctggtatcaaggtggctagtggttctggggctctggtataatcactctgtctggtttgctatcactaaattaccaatagggagcttgatctgagaacacatgcaaaagcagatcaccttcagctcccctctacaggggttcaagagtccattttcagcaatgcagaaaatacattgagaaacatatgtttaggggaaagcaaaatggtgttttctcacctgcgaaaggtagttgctaataatgcattttaactcttgtatgccatctcactaaatctgtactactttgaaattatagaacatgttttcttcctggaagacagaaattatcttctttatccccatgcctgatcattactgaacataacaattacaaaatgtataaaaacactgtctctttgggctccttctttagctatttttttttctagagaagaataagaataaataaagcagagcttctttcaaaattacaatttcttctggaatcacggtttcagaaaaaagagaagaggatgaagagtatgagaaaggagagagagagggaaggatacagagaatagcacagggttttaaataaatttaagtattctcctttaccaaggtttcttgctataagtcatctaaggtcaatttactcccaacatcagttttaacaaagaaaagtgaacaagaaagctaacaacaatggaaaatgatgctagactttgccagagcttttatttcaacaggatattgagtattaaaatgctttggcttggagtatcttggatgttgcttccaagtcttttttttttttttttttgagatggagtcttgctttgttgccaggctggagtgtagtggcatgatctcagctcactgcaacctgcgcctcccaggttccagcgattcccccgcctcagcttcctgagtaagtgtgactacaggtgcgtgccaccactcccagctaatttttttttgtattttagtagagatggggtttcaccatgttggccaggatggtctcgatctcctgacctcgtgatccgcccctctcagccgcccaaagtgctgggattacaggcgtgagctactgtgtgcggccacaactcttgattcctgcctccattgtactttggtcctgttttccattccagatctaggtttgttctgcatgctggccttcaactttgtttctattcaaatccagacctgctttgctttctcagtttctggctcaagtcccaagcaaaattctatctggatagatcagagattcaaatggtcaagggccatttgcaagcagctctttcgctatcaaacaaagtatgaaagcctagtttttagaaacagtttttacttttagccatgaaatgcatgagcatagtacatgaggtccaacaatacttatggcttatattacaacaaccagggtgacttcccttggtcttgtttccatcggacagcaaatgtgatgtcattttaattaaattcattgtcattatttacattattatgactttataattataaattatataatatataattaataattataaattatataatatataattaataattataaattatgtattatataattaataattataaattatataattataaattataatttgtagaaccaagccaaagagtatgatgccttttttcttatgcctcttatacacactgtcatagatctattcctatcctagttgtttttacttttgatctgtgccacaaaattagtacactttagttccaaattatgtacaattatattattaatttcacaaaataaaatagctcagtcagaattttaatcaatattcgtattgccctaaaaatactcttttattcactaattacttcaaggtattttgagtcggaagtgtgttggatttttcttgtgtgtgccttagaacaatgtgctaaacatacaaaaagtattcagtaagcaccttagttgatataactgaatttgcagtgtttttttcttaccattctttctatgtgtgtatgtatgtatgtatgtatgtatgtatgtatgtatgtatattgagacagagtctcactcttgttaatcatgttggagtgcagtggcatgatcatggcttactgtagcctcaatctctgcaggctctggtgatggccccacctcagcctgccgagagcagctgggactataggtgtgtgcccccacgcccgaccaatttccctattttatgtagggttggggtgttgctatgttgcccagactggtctcaaactcctgggctcaagtgatccaccctcctcggctttccaaagtgctgggattacaggcatggaccaccacacctggccttattatttttaaattgataagttcacaaatgtatagcattcaaaaatgtttttctctgcctctctaaacttgacatgtatttaccaaaggaacatataatctgtgcattatttgtttataaagtacaaaaggagctctaaactgatataaaatagtggttctcaaactttttgatatcagaagtcttttacattcttaaaatttattgagcaccccaaacatttactttagaaaattctggaaaatacaaatgtacacaagcacagcattctgtcagctgatagcgtgatgatatcatatgtcccttagcctctggaacacttcactgtagctttagatagttaagagtgaaaaagtcaaataacagcttagttctgttataaaaacagttttgttgtggcagaactcaaagggtcttggtgtctccagggcttcccagcaacactttaggaatttctgtataaatatgaagtggtaataataaatattttcagaacagcttaaagtttacaatgtagtttcaccagtgttttctctttgatttcccccataacactgtgagattaattagtatagtcatgacagtattatataagtttacaggtaagaaaaaattatattcagggaaattaagtgattgtctcactcaactaataaaattaactcagatcttctaattttagagcttgtgatttttccattatattgtatttcctcttaaaaaatttccataaaacaaggttagttgagttaaatctagttctatcacagcctctggcgcatgaggctgatttgaattagaactgatgtctccatttagattatgagtgatcttgtgaaatctaatgtggtcctgggtgacacctgaaagtttaatttcattcaaggttaatctgaagatgtcgggagacttccttagatggatcttaggtagttctgggaatacacctatcatgaacctataattctgctgcagaatttacctggactcttaggcacaaatggttaacaactgagctataccactcagggtcactggatacttgaacagacttgccaaatctttcctgggctgaactgttgcctccagcactagactaaaatggccaacagccaggagcaaaagtatcaaacactatatgcctgggagctggccctagtgtatttatttctttggaggactgcactttctatactgtttttaagttttaacctttgggcaaatcaaaatgacagcacctgtacaccctgtacatcaaaagggacctggtcaaatgtcattctttttctctgttgctgctcagggctttgatacttcaagtattaagcatgaagacaatatggatcacaggtataaaggacacaaatatgtgctgggtaagaagctataaataacaatgttaaatgttctttgaaatgaatgaaaaggaaggatgaatttatagaagtggtataaaaaactccttgacaatctttgctctgccgcaaactgaactagttagaagaaatataataaatgctttattgaaatacaaaaatggtaatatcttctaaactgtatctttgatgttttacttagctgctaaaataaagcaaaataaataaagccaccaccctgacaaccacaaagctcccctctgttgactaggaggagaaagtctctgtttcttcacttgacatttaggtgctttttgtcagtcttgtgccatactcaaaaccaccttttccacttggtctcctcttcccaaacaatggcccctaccaccttaagccaggttggcttctgtattgtcccaccccacagattttcacctctgcacttttgctcatgtgactctctcagcgtaagagagtcacatgagaatacacttatcatgaatctataattctcctgtaacacctttcctcactgatttctacccattcttcaagccattctttcccagtctagtgaatagcaatttcttcttcctctaaccttttacagtaggggatagcaaactttttcttaaagacagtaagtattttagccttggtgggccataggtttcagttgcaatattgagtcttcttgttgtaaataaaaacagccatagacaattcttaaacaaataggtgtggctgtgttccaacaaattatctacaaataatttgtaataattattaacaaaggagctatattttgccaacccatcttctagagcatctattgtgattagcaatacttaccacataatgtcttcttttcttattgtcttatgtgtttatcccatacttgatcaactagactataaatttcatgaagacaaccatagcattttttctattccacacatcaattctgatacattaaacatggtatatattcagacatagagatatttgtgattgatttaaccacctttaaacaatgtttttaatttaaattttattttagattcagggggtacatgtgcaggattgttacgtgtgtgatgctgaggtttgggcttctacttatcttgtcactcaagtagtaaacatagcctctgataggtggtttttcaacccttgctcccttcccacttttggattctccagggtttattgttcctgtctttgagtgcagggccccttttatttttatcttactttttatttatttatttatttatttatttatttatttatttatttatttatttattttgagactgagtctcactctgtcacccaggttggagtgcagtggcacaatctcggctcactgcaacctctgcctcccgggctcaggcagttctactgcctcggcctcccgagtagctgggattacaggcatgtgccaccatacccagctaatttttgtatttttagtagagatgcagtttcaccatgttgctcaggctggtctcaaacccctgacgtcctaaggtgatccactcgcctcagcctcccaaagtgctgggactacaggcatgagccaacaccctcagcccagaacaccttttaaagacaagaaaaacacttaattcctctttacttccattcttgtgcctttttgtttgtgtactaattcttaatcctgtatttatgtgtttttttttgttttttttttttttttgctgagtgcaggcatcacctcttgctgatagagcgtattacctctgatagagtgtattacctctctatgttaaggtatacaaagatacatattaaaacatatcaagataaatactttaagttatatcctcagaaaaatattttgtgacttacatattagtccgttttcatgctgctgataacgaaaagagatttaattggatttacagttccacatggctggggaggcctcagaacctcatggtgggaggtgaaaggcacttcttacatggtggcggcaagagaaaaagagaatgatgcaaaagtggaaacccctgataaacccatcagacctcaggagacttatttgctatcatgagaataacacaggaaagaccagcccccatgattcaattacctcccctgggtccctcccacaacacgtgggaattctgggagctacaattcaagttgagatttgggtgaggatacagccaaaccatatcaactttcttgttggcagaatgattaggatgaggcctcatgcttagcctgccaacatagcactcatttcttaggagaacaaagtaccataggttgggctcctgatagaaagcctgttgagttttgccatttaataaaatagagtgcacagtgtaatttgtacaatgtcaaacttcaaagaacaatttataacaataatgtttctatttacagcgtgccactaaggaagggacaataaaatgtaaagtttgacagtgtctactgattgatattaaggtcagaaggggggaatatttctattctcagcattttattgtcagttggcacaacagagggcagaatacaatcaactttgcattcttttcaaaattcaaggctttggaaaggacagtattctagatgttatatttacccaagggaaactggagtgtaaaaacagaaacaatttaaaactgcatgtttctagttgtttcttttttctgttagcctcgagaaaaattctgataaatgtagtccagttataggtttttattcatgctgtattgtaaccatatatttggatatgttagctgttcatttcaaatactacacccacattttctggtgacatagatggggtcagtagattaatgataagccatatgatttgtagaactgatgaggggggaaaaaagtatagccatcccatgtgacacaagaagatactcagctcagatgcctcatcttggaatatgaattagcatggttcactggtaacaaagaatggttatgctgatcatagtgaagaatccgatatgtatcagctgcatctctttataataaaataacacagagctaagtatagaaataagtcattctcttgccactgtgtgggattaaatgctcaactttgtgtacgcatttattaccttctagattcttcacatgttgctaaaatcatagaatttctgaaagcatatttccagtcacatcctctgacagggtgttcctttcaaaaagcaaagcagtgtttggctgagctcagtacagtgggccaggtactgatgggtaccatcagagcttgacatttagaactaggggctttcctaagtgcagtgcagtgagatcatcttgcctaggaggtaggagatgaaatgctttaatgctagcttgtgtagaagacattacttttattaccatctagggaccatccagaggcatattgaaataacaacacctctcgcccacacataggagtgactttgccaatggaatagctgttgttgaagctaactcatgggaataaaaatactgaactccttcaaaagcagccacacactatagaaaaccagacgtctacccagagaactcaagtggcatggaaaagcatcagcagtctccatgtagatcctaagaggctaagaactattcattctttcaccagtagtttttgagctccaactctctgccagggggtgaaccatacaaggcagacataactcctgtgaacacagagcatatattatgaccacataatcttgtgaatacagttttcttaaattcaataaaggaggaagagtacaaagtgttctgcacttctgcagtacaggaaattgacttgacctagtttggagtggggtttggagcagaaaaattcccttgaagcagtgacatttaagttgcaaacataaggatagaaattagactgaaatgggggtgggaggaaggagcaagtgtttcagagatagggaataagactgtgaaagtttgagatgagcatggtaatactccgaatccgtaagaacgctaattgggcttggagttatattaggctaaatcctattttttttcagtgtctggtcaagggagattttttttctgaagaaagaataacatgccagaattactaacattattcaaattaaattatatattcacagctccccagagtataaagctaaagactttgtctctctaactttgttatttctaattgatactgttttcatcaatcccagtttgataattattaatataattgtatgattttttaagtttctgaaatgtttttaacctgttttgcgtatataatttcattcagttctcacaattaatatgaacaagaatcacagtgtccaggatccctctctgggggatggaggacattggcacaaacctcacagttttgtattagaccaattctaatgtttacaatgaaaatcaggtgatggatgttaacaaaaaaccatgtttgatttctcaatccaaccatgggaagtttctttttcttatttctaggaagttataaaccaatcatcccaatgaaatcatctttttttcattgaatagcattacatagatcttttaagaaatatttactcattactttttcttagatgctactaagagacagaatcatctaagggacagaggtggaatgtgagaaaattgatctttcttggaggaaggcagatagactggatgaccactaaagatttctttagctgtgtgtttcagtggcttaagaattcttctgtttaaagaaatatgaactggtttgcatatcattgtgcatgatttagtattgctgtggtttatacagggatgatttaatattgttaatttactcacagagtatattaatcaactaatagtatttaaagggctagagtatgaaaaatcaagcagaatgaaaagcaaaacatggaagaatctactttagctgtgtcccttatgatgtattacgacccttgtttgatacatgactataataaagcattgccattcaattagagtaagttaactttaaaattaatattgtgcctatgcttgattcaatttaaagggctgaagaaagggaagagaattttgaaccattcactatgcattagctccaatgacagaatatagatcatagtaagtcatgggcttctgcccagttctgatctctgtgtggtgcatgtcaatgtcaaacttaaaaaatgtgcactttggttagagcggcatgcatttggtaattggacagaagtgagtggaatgaattggaggttaaagtctagccccttggaaatgttttgacactttacccaggagcttgcatttattaatagtaatggttcctaaatttttattttggctggctttctgattatattgaaagacccagaaggagtaatgaaagaaatgcattagtgaaaagtattaaaaaattacctttgacatctctagcacacggagcaattctagatggttgataaaagagcataaatcaatcgacacaaatatccccttaaaccttgtctttcatgtccagtatttaattcttcccatttctagtatgaagataggaattccattatcactaagaaaatccactctgggcatccaagtcgatatttctaaaaattcactcactattaattaatgaatagtgcaaattagggaaataacttgcatatgtgttagtgtgtgtgtgggggaatactcaactaaaaaggggagagagaaattaaaatgtaagttcttactgtgtgccaaggactttgttagacactttttctaatttataaacaactagtaaatattatttgtctgaaagtatttggcattgtttcatacgtatgtaccgtcatatttttacactggtaatgtgatcctaccagactaattagttaaaatattaccatgttggtcaacattttttgtcaggggtgggatcagggcaaaaaaatcgtctgagcattaaaaagatgcatgataccactacaacttgttcttgctgcttctgtagtgaaaagcactgtaagggaaaggacacttgtctgtgctgtacatgcacatgacccatgtacaatgcatattacacaagcatgtactagcagtttagtgaaagtctgatcctgaagcgttaacacttgttaacatttttatttgctttattaagtttaatattcttaattctttttggctttttgtatgtggaatcctcaaaacagaccattttttggcaaaaactttgagaaaaataagtaaattcattcaacgagtaggattgggaagccattttgtatgaatcttatgttgagagtggatttgaatagaaatctaaatttctgcaaatagaaatttgatgggaccactgggaagtaagtagcaaagtggggaaagaaatggaagatatgtgtttagttgaatagaggctggatagtgagtgtgtattagtacagaagtgagaagaaaaaatgaaagtaggcctttagattcaagagaaagttgcagagaaaaagcctggaagatgaataggagagagagaagaaaaagctcggttcaaagttgtcacttattttcaggttaggtattcattttcatgactcaaagatacaatagcttccaaatcttcaccagtggccaagttggaattataccagttagaaatactgaatgggcaaaaactggaagcattccctttgaaaactggcacaagacagggatgccctccctcaccactcctattcaacatagtgttggaagttctggccagggcaattaggcaggagaaggaaataaagggtattcaattaggaaaagaggaagtcaaattgtccctgtttgtagacgacatgattgtatatctagaaaaccccattgtctcagcccaaaatctccttaagctgataagcaacttcagcaaagtctcaggatacaaaatcaatgtacaaaaatcacaagcattcttatataccaataacagacaaacagccaaatcacgagtgaactcccattcacaattgcttcaaagagaataaaatacctaggaatccaacttacaagggacatgaaggacttcttcaaggagaactacaaaccattactcaatgaaataaaagaggatataaacaaatggaagaacattccatgcttgtggataggaagaatcaatatcgtgtaaatggccatactgcccaaggtaatttatagattcaatgccatccccatcaagctaccaatgactttcttcacagaattggaaaaaactactttaaagttcatatggaaccaaaaaagagcccacatcgccaagtcaatcctaagccaaaagaacaaagctggaggcatcacgctacctgacttcaaactatactacagggctacagtaaccaaaacagcatggtactggtaccaaaacagagatatagatcaatggaacagaacagagccctcagaaataatgccgcatatctacaactatctgatctttgacaaacctgagaaaaacaagcaatggggaaaggattccctatttaataaatggtgctgggaaaactgactagccatatgtagaaagctgaaactggatcccttccttacaccttatacaaaaattaattcaagatggattaaagacttacatgttagacctaaaaccataaaaaccctagaagaaaagctaggcaataccattcaggacataggcatgggcaaggacttcatgtctaaaacaccaaaagcaatggcaacaaaagacaaaattgacaaatgggatctaattcaactcaagagcttctgcacagcaaaagaaactaccatcagagtgaacaggcaacctacagaatgggagaaaattttcacaacctactcatctgacaaagggctaatatccagaatctacaatgaactcaaacaaatttacaagaaaaaaacaaacaacctcatcaaaaagtgggcgaagcatatgaacagacacttctcaaaggaagacatttatgcagccaaaaaacacatgaaaaaatgctcatcatcactggccatcagagaaatgcaaatcaaaaccataatgagacaccatctcacaccagttagaatggcgatgattaaaaagtcaggaaacaacaggtgctggagaggatgtggagaaataggaacacttttacactgttggtgggactgtaaactagttcaaccattgtggaagtcagtgtggtgattcctcagggatctagaactagaaataccatttgacccagccatcccgttactgggtatatacccaaaggactataaatcatgctgcaataaagagacatgcacacgtatgtttattgcggcactattcacaatagcaaagacttggaaccaacccaaatgtccaacaacgatagactggattaagaaaatgtggcacatatacaccatggaatactatgcagccataaaaaatgatgagttcatgttctttgtagggacatggatgaacttggaagtcatcattcttagcaaactattgcaaggacaaaaaaccaaacaccgcatgttctcactcataggtgggaattgaacaacgagaacacatggacataggaaggggaacatcacactctgtggactgttgtggggtggggggatgggggagggatagcattaggagatatacctaaatgacgagttaatgggtgcaatacaccaacatggcacatgtatacatatgtaacaaacctgcacattgtgcacatgtaccctaaaacttaaagtataataataataaaataaaataaaataaaaatacagtaatctggaataggtcaaaatgagtgttgctggtgcttggagacagttcagataggtatctataatgaattttgaaataggaatataggatgactcctctaagagtccaatttaataagttagagcagagatggataaggtcagcttttgtataaaatggccccagggtcagtagggtctatagtaactggattgaacattaacatatttgaaaatagaatatgcattggtcagcattgcaaacatagaaaaaggtgagttgaattcattcagccaaacaaatatatattgaatgctttctgggtgccagacagaggctatagtgatgaacaagacaggcaatgtccctgacccctcagaggtcttacagtcatagaggtcagtgatggcatgatgtggctgagcattgtccgggagagaggctgccagtgatactgttctccactttccagaacatctctcctttgaagacagagacagcaggcatttttgcctattattacagacttaagtcatctcacaaatgcccttttttttctgagaccatgctaactctctaagtttctgatcataatttggattcttagatgtgtctgcctatgagaatgaataccagagtcaagcaaatatgagggctttggtcctggtgatgtttacatttctcttttaaaatatggccattagtattctgtgtgttacatcagtctactaagggtatatccctaagggctaaaccccttcttagacttctgccaaagtcagatttttgagtctgaaggctgggagccagatcctatactatcataactttcttgagaaatagccagctgggctcattggtgacactcaaaatctgtgttaactgttcttgttttgccttaacatttctaaaaggaataggtcttagtctctccaaataatattgaacatatatctgagagatactgctttcagtcaagtgatggaataggtacatttatcttttcttgtttccttatagtggttcccttgtgtcatttcttgatctcatggcagacgtctcttgcctcaggtatggctggcaaagggccagcccatgatcttatgggatgtctttcaactgttcaggggatggagcagtctcatgatgtgttaatttgcttttgacatctggttcttatccatctgcttagaagtctgctgttattatttgattactggcaaagccaacctcaggctatctttattttttttttaaagtcaacctgaagttatttccacttttctaaagagatcttaagtatcaacagctaattattctttaacaaaatagcaacctctgtgctttgcaacctcagccttttcttggtatcagcatttttgttttttaatttttttaaaaaataattattccatacaaaatacttaaatagatttctggcaggtgaccattgccctttgcagatctctgtgatgttttgattttcatgccctaaatggtatgccacagtggacttggttgaagaaattaatagtaacactatacttttaacacttttccataagatggtaaaaatacttgggtatatgtggaagtttaattatttacattttttaaaaatagtgatatagtagggtgtctaaaactttaaaactttttgttttgtttttcaaacttttggtttagcagtacaaccttgttttcagataaaatataaagaacctgatataataaagtgataaaactagagatagtctagatgaagcctgaatgcattggcgaattgggtggagtcctggcttagaactgcataaaacatgacttcaaagtctagagtttagaatttcaatatcaaatgttaccaatgaggaggagcatgagaaagaaacagaataagaagcagaatattattttgccatatgtatatggaggagcactttgagaagtccaccaaaacaagtgggatattagtaaaaaggctaaaatgagcctagaagctatagcagattggtagctgagcaagccatgtagtggtgaggacattaagaatgatgacctgatattgctttaatgggaatgctagttacagattgcagaggaacagtaatatcagactaaaaaaaagcctttgggggtgtttcaaattgtattaaaattagaatgattcttttagggcaaagaaaacaggcatatcaggactccaaaaataatgacaaagtttaattcagttcatttatcctctataatgggatagacatggtgctaggtatgtttatattatgtagtgtactgaaaataatgctgaagctaaaaactgaaaacacgggttattttatgccccataaacgtgccagatgggaatcactagcattctgttatctactaatatgtgggataaggttgcaaagtgacattatatatataaaagaattgagatttattcttttcatttggaatactggtcatttttttatgggcagtactagcagagagtttggaatatatatagatatctatgcatgcggagaccaataaattctattaaacatcctaattgtctcttagatttactgcacacgttaatgcctaatgcttcagatcatgggaatatttaatgccaggttcattctatttttagctaaagcttactcattgccaagtgatggtgtgttttcacccataaaatataatgcttgatgatactttgctcatattgtgcttattctcttttgtctgtaacatcccccaaagcaaaactcctctctgcctcttaaattttcctcaagttattgctttatcttgtttctcatcatcaccataaaatttctagaaataatagtttctatcactcagtatttacttctcaatgcactgcaggttttcttctgcatctccagtgcttaataaaagtactcacttcagagccgttactggtgacctgctaaacaccagctctggagtgtctttgcagcctctgtgctactgcttgtccaaccgtcagtttggtgcttgtcttggtccattgcagtattttgctgtaataaaatatgacacactgggtggattataaacaatagaaatttatttctcacagttctggaggtgtgaagttcaagattaaggtacctgcagattcggtgcctgttgaggaccatcttctggttcctagaaggtgtcttcttgctgcatccttacatagtaaaaggaaaaggcagctctctggggactcttttagaagagcactaatcccattcaggagaactctgaatcagattccaaaggccccacctcctaataccaccaaattagagattaggtttcaacttatgaatatgttgaacatatgttgaacatacgcttaatacatatgttcaacataatcctatgttgaaacctaatcaacatcttaggttggtgatggtgccttcgagtgacacaaacattgagaccatggcagtgctatttgccttaagtatcactctcccgatctgctttctccttctttgactatttcctttcagtctctttcatggactgtccttcctctgtccattaacgttccctgaatgtgggtccaaatcttcagtctttatagtttttgccttagtttgggactcatcacttctcacctggtttacttccggagactcccaatatcctcatagcttgttgggcataagtctctcccacctgttccacatcatactacatactgtgggaagagcagctgtccattaaaacaagcctggtctttcactagattacttaaaacatccattgcgcaatggatcaaatgagaaaattcttgcatggcatgcaaaccccctcagagaccggctgtcattttctgtttctgtcttatgtccttccactctcctccgtacaccagctggaatggctgcctctgcacttgtgttcctgagcatgtggctgtcctcctttctctgtctagcaatatctaaggtgtttaatccctgcatgcctttttctttttgatacagcaagggtaactgtaatgtctgtattaagggaagattgtgatggtcaaaggaaatagggcgtatgtaactgctttattttctacaagcatcataaactgatctatacacatttatgtagttcttgtttttagatcactttgaggtgggcttgggggaatttgtggaggatactcaggaaaccgataaagataattaaaagtttaaaaattagaataatgaagaacaggaaaaggaacaattattcagccaagagaagaaaagcctgaagggagatataagaaagaaaaattatttcctagaggacagacttagaccatcctccattaatattgagaagaaagcacagcaaagcatataggatttatgcttgctgtaaggaacatttcccacattaagggaatcggctatctagaatagtttattcattaaactccccaaatctgttcatctgtagatctaaaaagatatattttcttctgtctaacccatgtaggtatgaagaggcctgaatgtggagaagtgagttaggtgatttcttgcagttcttttttttcccctcagtaagtcattctttcattctctgtctctctcttcctctatccatctctctaaatgcctctctctggctttctttctcttcatctctgtaatactatttctccctctcctttttcttccatttgttctcttacctttctctcaccattcctgaatactttttcatttgagctcctatcctccgagccctaaaatgcagtacaaacaaaaggtttcagaaatagtccaaacaccactattctacctatttttttggtcttaagttcctcatattttttggttggcgtaaatattttggataagaggatgatatggtttggctgtgtccccacccaaatctcatcttaaactgtagtttccataatccccacttgttgtgggagggacccagtgggaggtaattgaatcatgggagtggttacctccatgctgttcttgtgatagtgaatgacttctcacgagatctgatggttttataaggagattttccctcctttgctctgcacttttccttgccactgccatgtgaagaaggacatgtttgcttccccttccgccatgattgtaagtttcctgaggcctccccagccatgctgaactgggagtcaattaaacctctttcctttataaattacccagtcctggaatgtctttattagcagtgtgagaatagactaatacaaaggaaaatttttatttctgtagagttaaggagagaggcatttttatgatcacttactttacattactttataaggtcttctttcttctgcacttttctcagcataactccatatctttttttttttttgagaggaatttttcctgtaacttatggacaacatatttttgccagttaactataaagttccttcattacatggtattgtaatgaagtctgagggaagaggacattaatcagtaccattactctggggagcaagaagcaccacagaatgccctgctgaactttgaggtatatatttgtaggttcaatttctaacccttgcatttagtaggttgtacttgtttcttatattatctttctacctatgtgtgtacttcctgcctttcttttgatgatgttggtggcaatctgtctctcattaactttgcttcctatttctcctctattactttttttcagttcttctcattcctttttaatgtttagccttttgggggcagatttcatcatttactgagattggctcctcaaggatgcagtcctgaaactttgcatgctgatggatcccagcacttgctactggaatccacacaactatgaggtgacaaatgttaaacttgtattatttgtgggaaagtcacatggctgagtcgataccatcatttttctttttcttttctcttgagaagctacaatatctcatctttgactttttatctagtcttcactagatttccccctcaagcacttttaaaacatatagataattgaattttgttcctgttttttttctcactaactttcatgtcatagttgaagagaactatgtaatgttcattatcgcagtttcattgtgaatcaacaaacccctgaattaaaactttacagtataaactctaataagaagagtgaaattggcacttctggaaagcaagagagaggagcagtggtcattataagcaagatatggagttaacagtttgtaaatgatcactcattactactatttcaacagatgctgttaaatggaagctatcctggaaaacttatttggaattgaatgtaaatattgttgctataaagtagaatgattaattagtatattaactataacaggaatataaggtcatttaaattatagctttgggtttcctccctcccttcatctctccattcttgttttttctctctccactcctccttccctttatttttttaacaaatattttgagcatacacaatctcatcaatcaaaattatatcaagcttaaatgtttcagtcaactggtaattagggttttttttcctgtcataaatatttattgagcacctaccatttgctcgcttggtgagttagtaaattaccttatttatgtaaacttatttaagtcccacaaaggtcctgtgactggtattattatctccaattttccttaacttattttctttctccaacacttttcctttatgtggctctgagtttctgacctatatactttttcttctctctgaagaacaacttttaacatttcttgcaaggcaggtctactggcaacaaattccctccatttttgttcatctgtgaatgtctttattctcattcacttttgaagaataactttgcagggtacagaattctagactggtgttattttttctctcaatgcttttaacatttcactccactatcttcttgctgtatggcttctgaggagaagttagatgtaattcttatctttacacctctgtaggtaaggtatttttttcccctgggttctttcaagatttttaaaaaatatattttctatagtttgaatatgatatgcctagatgtagacttttgacattgatcctgcttggtgttttctgagcttcctggatctgtggtttggtgtctgacattaatttgggaaaattctccatcattattgcttcatatatttcttctgttcctttctctctttctctttctgttagtcccactaagcttacattacaccttttatagttgttccatagtttttggatgttctgtttgattttttttcagtcttttttccctttgattttcaatatggtaagtttctattgacatagcctcaagcacagagagtctttcctcaagtgttcctagtttactaaggagctcatcacaggcagtcttcatttctgttacactggttttgatctctagaatttttaaattatttctatctctctgcttacattacacatttattcttgcatgttgtctactttctctattagaatctttagaatattaatcaaagttcttaaagaaaatttctggcttgataattccagcgttcctgccatatttgactctgattctgatgcttgtccatttcttcaaagtgtgtttttttttgctttttagtatacctggtaatcatgcattggataagagaaactgcagtaaatcggcctttactaatgtggtagtaaggtgtgggaagaggggaaatgttctatagccctatggttaggtctcagtgttttagccttggactgtgaacttgaaaagtgctttttagtctccttcaccaacctcctggcccctgggtgggacaggatgggtggaggggtctagagttgggtatttcccttccccaggtcagataggctctgatcaaatcccaataaggttaggcatcataaaacagtttctcttgagggcaggtctcgtgaagagcagagcgctctgtcatattccaaaaggagtgttttcccctgctgaaagtataagggtgttttaaagcaattttcactctgagaacctggtagagttccaggaagtaaaacttctaaatttcggtacctttctatgacttgctccctgtggagattttaactctcagatgtgtccataccgagcctctagcaatttatcaattacagttcaggtttttctgtcctggcactggttccctcagaggtttctacttaagggtttcttctaagttgcaattttctgtattcacctgtctgtctttccagttttgggggcagcagcttgcacttctctgacaaatccaagaagagttgttgatttcttggcttgttcaccttttttaacttgctgttaggatggtgtaatgacttcccagctccagtctgaaagaggagcctggtgaactgaaaaccttgtctattatttatatttaaatatatgaaagcaggcagttttcaacaaggctgagtaacttgcttgaggtcaaacacaaacataagggatggaatctaaaatttaaaaaaattgaactccaattaaaaaatgtattttagctgttacagttggtcttttgctctgagtgacaattatatatggttattactttgaataacaattatatatctgggtgcttattggtacaaagagtattaagtttcagttaaacaggagaaataaatttttgagatctattgcacagcatagtaactgtatttaacaataatatattgtatacatataacatcactttgtactccataaatatatacaaatataatttgtcaatttttaataaaaaattaaacaaaattatgtatctgggaaaatacatctgaatcacagaaaaattcttctatagattacataatctaaataattgataccacagagttacagatattgagtatttcacatgtggaataaaagatgaattccaattacagtgaatagtacattgaatatttctttcttatttttgagcttagtttctttcatggaaatgtatacatatatttcctatgtaaaacagagtttataaagtacttttttattttttaatctcttttctgttttattgctattatactactaacattgcattcataagaggtcatccttcagatagcagtgaggatgaatgattatttggctgtccgtcaataaagttgatgatggtataattttaaaaacgaacaatactcaatttattgagtacttagtagaggtcaggcacaaagtttaagtgctttacaataaattatctcacttagttctcaaaataaccttatatataaactatcatcaatttctactgtaaaactaagaaaattgaagttaaaaattaactttctcttatttcccagggttagtaagatatggggcaaggatttgaacctagcctccttggctccagggctcacagtgttaaaaataactccatgtatatttgtccaattaacacattctcttttaagaaacatttatttgtgaccagcatcaaaagagaggaaaaattagtctcaggtttacattatctacttttttagaagagaaataaaaattcacttagaacctagactcttcgtgctttattgcacagtggtttaagagcattgtcacatttaattgaagactcattcactgtgtcactgtattttaatgtgagttgacatggagataggaaacatataattttaatgttaaaaattaacatatagtaatgaagggtaaacagcacagactgaatttttaatttttcgactatttctaatgaagaatatataaaatatttcaatggtatttaatcagcctccaattatgaatttacataatatttactccacaagaaacattattttacttctttcatgatcattttaaaatgtacagttttcaaatcaacttttcagaaagcaactttgttttctttgtggacagatggcaaaaattatatccacaaaactttttgttttcatattctggaaaagtagtatgcagtcattgtggaacagggcttttaaaagttgctcatgtcctgcactgaaccaattgaataacacagcaaaagagccaccagtatctgacctggcttctacagaccaaataaaccctttgtatgtttgtttattttcatctgtaactttgtttgcttatttttcattctgatactttttagtaaaatgagtaagatcttctcaacagtttagactatacttccacagatctgttgacatttgatgagcacatctgctaaagtgaatttaaaagggatagtttacttcatctctttctttacctgttccactaatcacttgtaccaaatttatttatttatttatttattttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggatatgaactcatcattttttatggctgcatagtattccatggtgtatatatgccacattttcttaatccagtctatcattgttggacatttgggttggttccaagtctttgctattgtgaatagtgccgcaataaacatacatgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacgtcctctccagcacctgttgtttcctgactttttaatgattgccattctaactggtgtgagatgatatctcatagtggttttgatttgcatttctctgatggccagtgatgatgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttgtcttttgttgccattgcttttggtgttttggacatgaagtccttgcccacgcctatgtcctgaatggtaatgcctaggttttcttctagggtttttatggttttaggtttaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgcggcattatttctgagggctctgttctgttccattgatctatatctctgttttggtaccagtaccatgctgttttggttactgtagccttgtagtatagtttgaagtcaagtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctcttggaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcatctgcaaacagggacaatttgacttcctcttttcctaattgaataccctttatttccttctcctgcctgattgccctggccagaacttccaacactatgttgaataggagcagtgagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaggtgtttgtagtattctctgatggtagtttgtatttctgtgggatcggtggtgatatcccctttttcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggttttgagtgagattcttaatcctgagttctagtttgattgcactgtggtctgagagatagtttgttataatttctgttcttttacatttgctgaggagagctttacttccaactatgtggtcaattttggaataggtgtggtgtggtgctgagaaaaatgtatattctgttgatttggggtggagagttctgtagatgtctattaggtccgcttggtgcagagctgagttcaattcctgggtatccttgttgactttctgtcttgttgatctgtctaacgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccagttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccccatcactttcaggtacaccaatcagacgtagatttggtcttttcacatagtcccatatttcttggaggctttgctcatttctttttattcttttttctctaaacttcccttctcgcttcatttcattcatttcatcttccattgctgataccctttcttccagttgatcgcatcggctcctgaggcttctgcattcttcacatagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggtgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaataccctgccgtgtgaggtgtcagtgtgcccctgctggggggtgcctcccagttaggctgctcgggggtcaggggtcagggacccacttgaggaggcagtctgcccgttctcaggtctccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttcgagcttcccagctgctttgtttacctaagcaagcctgggcaatggcgggcgcccctcccccagcctcgttgccgccttgcagtttgatctcagactgctgtgctagcaatcagcgagattccgtgggcgtaggaccctctgagccaggtgtgggatatagtctcgtggtgcgccgtttcttaagccggtctgaaaagcgcaatattcgggtgggagtgacccgattttccaggtgtgtccgtcacccctttctttgactcggaaagggaactccctgaccccttgcgcttcccaggtgaggcaatgcctcgccctgcttcggctcgcgcacggtgcgcacacacactggcctgcgcccactgtctggcactccctagtgagatgaacccggtacctcagatggaaatgcagtaatcacccgtcttctgcgtcgctcacgctgggagctgtagaccggagctgttcctattcggccatcttggctcctcctccgtaccaaatttaaataagtttaaatttttattttaaagaaaaatgacaactttttactcctttatatccatcttgtgcctgttcataatggcaaccaaaaatgagtgaatggctatggaaataaaacgattttataactagatatacagtaaaattaaggtgctcacctctgcatttaggactgtattttagcttagtattggacaaatggtaaaactcaggagtactgaacccagatctcaagagaacctttttctgtatagctctgggatggctgaggaaatgcctaaatcaagccttccatctgcttggccaaagaaagatttccacatccatttctagtttgttcagtagcctctgaaaaagtaatttattctctctgtgctttgttttctccatctagtcagtgaggccaatcatacttaccaccaacctccatcaagacaaacttctgagagaaaagaatctctctgagcatcagggatgctcaaaagtcaccacataagtattagtagaagtataaggggtgagggtgggagaacacattattcttctgtgcgtttagctaatagaacaaacattactgtttcctataaaaatgctactacttccacatttcctgtatgtggactctattctagacattctagtttggtgtttttaaagaaaatcagatacaggctatgaataaaatatctctttaatcttaaatccaatttactgtagaatatctttaaaaacttaattatgaatgaattttcagaaaaagaccgtaaatcatatataattttttatctttaagagctgtatacatgaactatttcaggattggcaaatatgtagcatatgcgtcatctgttcctccttctgcatacatggcagacattgccaatcctttaaaatcctctactctattgaataaagacagagctgcagaattctctgcactgtgtttcaggaagctatgaccaacccatcagagttgaggatgagttaaaaccctcataggtgggaattgaacaatgagaacacttggacacaggaaggggaacatcacacactggggcctgttgtcgggtggggagaagggggagggatagcattaggagatatacctgatgtaaatgtcgacttaatgggtgcagcacacaaacatggcacatgtatacatatgtaccaaacctgcacgttatacacatgtaccctagaacttaaagtacaatttaaaaaacccgctatgccattcctgatcaactctgactttcttatttacagataaagaatctaagactcaaatagtatgggattttttttttttactgaagtcatataacttgttatttttgctgttatttgaatgaaaagccagatgtgcatgttcccaccgtagttttattctgtgacatcaggctgtttctacaattttcaagcctgtctgcattcattatagtcattataattttcatattctttctgattgatcaactcattcatttactctttgattaagtagcatttatggaacagctactatgtgtactatgcctgggctggtgtctctgcactcaagaaacttagagttaaatagagaaatcaggtctttacaaagctagccctcatacatgataaagtgccttctggatcagtttcatctactagaaacacgatcgtgtctttctcattgcttaagcctatgttgcctagttattggtgtatctttctgtccctttccagccaagcttcacattaaaataaatggctacagttatggtctttatctcctttctttatatgacccaactgactgcacgttagtatttttctcttctcaatcactgaaaatattcttgctgaagtcaataatcatctacatgttaaatttaacagatatatttcaattcttaattttctctctttaagcatttcatgctgtcaatcatttcatttcttgaatttcttattatattctgttttcttgtattctttgttatatcgctttacaatactcttcgaatgtgttctcatttctctgaagctgccttctctttaaacagtgtgggttctttttcttcttccaattcctttgaggttggtttccctgggattatgacctcaatttccttttcctctttctgtggaatttcacctactattaaaactacaaactgcaaactgcacttctagcctgaatatttttgtatctttctctcaatctcagattatggcctcaatttccttttcttctctctgtggaatttcacctacttttaaaactacaaactgcaaactgcacttctagcctgaatattcttgtatctttctcttgatcccggtgcagactagtatttcaactacttactgggcatgtccttgtgttccacaggcatgtaaaactcaacttttccaaaattgaatgtatctcctctcttcaaaccttcctcacttcctgtatttgctaatttggtgcatggcagcaccactgggtcaccagttgctgaagcagagatactgaatttcttttaaccccatcttttttcttaccatcctcatcctacaaattctattggttctcatcccttaaaagactttaactgtgtccccacctcctcatgactgctgctagttccttagttaggctcttgtctttccttgactctctgcagtagcctcctaactgatctaattttatctcatcgtaaccttatgaatctccatgttgttgtcagctgaatgttaataaaacacaaactgtatcatctggcatccaagcttagaatcattgaaaactccctttagattctggagtaaactctctcccttgtacttggctcttgaggatcagttcccgcctacatttccactttttgttgctcatcactctaactccctagttttccatcaactaatcccttagttttgacttcagtttcagcatattttaagtgccttgagttcatcatcatctctcttgcctccttacttttgcatatattgtttcttctacctgaaatgtttccacctctcttttcttagctatactgactcatcttttaaatgtcaattctgatgccgtttgcacatggaagctttatctaatccatagcatactgtttttttttctttaattgtagcattttcttcaaggtgttgcagttgtcctctttgatctttagctattgcaatgcctttcactatttgcaggatgtgttgatcgaatcagttgcatcatgattggtcttgtccccagagtcttcccattctgtcctggggctctggacatgcccttggcacagttcctctgcttgggtttgtcactgcattggctcatggtgagcaatatgcaatagcttgatcctgaagtcatcaggggttttgagaatgaaactaggccatatcttgtttttgaccagtgaaggggaaagaaagaaagtaattctagaacaacctaccacttactttagagcttcacttttatatcatctatatttgacctggaaaccatctgtgtttttgtctttgtggtcagccattattgtttgttttgccatgatatatgtcggaatgatattatttgactctcctttaagtacctcctgcttctttgagtaaggagatcctaccagtaaaactcctttctgtatctttgtgttaccaatttattgagatatatggactatcaattgttttgtttgtaaataattttatttttgtaaattgtgatctagctacctaattatctattaatatcatctatctaaatcttctgcctcattttatcctgatacacaccttgacttctttattaaaaaaaaaacacgtacagagaatatattggaaggaaattggggcagttgttctgagtgatggaatatcaggtgacattttccttccaatctttaatgctttttatagattaatgaaatttttaaactttcatggttaaaaagctttttaaatgaagaaagacaaataaataaaaggacaatattttcatgggaaataattttatgttgagatcaacccctttctcattgagtaatgatccagatttgatttgaagagaatgacatgtatttaaccaaaagaattctattaggtacctacgttaactgtggtttagaagaggtagaaatccatttcagctttagaaagcaggggaaggatggaaagaagaggaagtgatattggagctttattttaaaagagaagcaagggtcaactgctgaaaatgataaaggaaggtattccaaacatagggaacagcaattgtataataacctcagagatatagcaaagcaagggcagctcagaatggctggatattactatgtttattagatgacgagaagtagagagattgtatgtcatgttattggcttatccctaaaactttagtagaaattggtgaaagtaaggatttttgtgtgtgtgtttttgatgagctcttcaagtattacatgatatcttattttattaaaatcaatacacattgcaatttttctttagcctctacttttcaggcagggtattttttcacttctttaaacttaatgcagtttattttttataacaccatttaattaatgaaatcctgttaccctttgtcacgagtaggtttatttgcatctctggtttaaaacacatttcttgcattttactttccagttctcaggtgtcatttgggaatatgatgcagccattagctaacagactttcccccaattcctaaataacctaaagtaatatgaaactgtattttagctcatctgtactcataattcaagttttactgttaattttttttcagaaggctgactccagagtgaacaaaagtagcttgtgtggaattatttttacttatgctccactttgaatgcaatgtgtgccaagcacatcaccttatgatgacagcttgttgcagccagaaggtctctaatttaaataaattctggttgtgttaatcaccaaagatataattatgtcatcatatgctgtgtgctttttaaataaatgattctgaaacagactgttctttgatagtttcatcattttttcatgagcttgcagaggatgtttatgtagtgaaaagctgaccacctcagcacaatctagatacctcttgatggcaggaagctcatggttctggttcttctgaatgagattattaatctagtgaacactcaactgaatgaataaatgatgccatttgttgaaagtcaggagagtgtaaacgttttgttttcatgagccccagctttgatcattcctatctatccaaaggtacttgcttgtgtcatttaagtgcttaggattcttacagtgctcatgattcttattgcagttgtcctttgtagtgacttctgagaccctttgtggcttagtgtggtgactcacaccccagatcgtcttcctgactacctgactacctggggctgtgtgtaggagctttagccatgtcagtgactccccagtctgaccgtgtgttagcatcaccaggaggttaagaaaaatactgatgcatttgcttttcatcagcttaattaagtcagaacctcttaggaagtgggctaggcaatagtacctctttaaagtgccctaaggtgaatctaatgtgtaaccagggttgagaatgagtagaacatggatcaggactgagaggtctgtgggacatgctcaccatgggcagtggtgaaggatgctcaggagtctaggaagtagtatcttggagaagtggcaaagaaaaatccagataggcttttaaaagaagtcacttaaaatcagtagaatgggaactttaggccttgaagagagagagaactcaaaggagaggttagagatggggcctggaggtagcacctgggcaattgtctggtgcccatgaaggtgtgtgcccagagaaggtaaaatcatattgtgaagaggaaatgacagaagaaaggggatgatttagctaagttgacaaaaaaaatacttcaaattagtaggaattatcattttcccgatggctgtcttctattcttaattttgggtgctgctgatttgcatgtgtattgttaggccaactaaggccactgaaaattatcaaagcaatgttaattaaaaaggtgctgtctacctattttttcctgcattatatactcatagcttgactataataatagtataaggttcaccaggtacagacttgggtatttatctagaggcctcctgtaggcttattcttctgcccattttaagctcttctagcatgcccttgctcacagctccaggagctgggtaaaaagctagccatgtatgtaaccagagggcctgcttttcagttcaggagttgctactagcttcccctgtgcctgcctgtagacattgtctgattttataccctgatgtccacatttctagtaaatttcctccctagatttggtgatttgactttttctgttggctgagcagctctagcttggcctcatttatctgctgacccttagatgcaggatcacagttcagactctgattgcttaggacctcgtcctggtttctgggtgttggaatacagacatttaatagcaaccatagttaagaggtcctactgtgtgttccccatccccttcatctgtggaggccacctgttcacaagtaatgagtcatttcaattaaagattttatgaagatgtctttattagtccattttcatgctgctgataaagacatacccaagactgggcaatttacaaaagaaagaggtttattggacttacagttccatgtggctggagaggccccacaatcatggtggaaggtgagaggcacgtgttacatggtggcaggcaagagaagagagcttgtgcagggaaactcctgtttttaaaaccatcagatcttgtgagacttattcactatcatgataacatcatgggaaagacctgcctccatgattccattttctcccactgggtccctcccacaacacatgggaattatgggagtacaagatgagatttttgggggaggagtcacagagccaaaccgtatcaatgtctaaaagtatcttttggagtatgagtaaacctaaaatctgtaataaatatggttaaccattgaacaacatgggtttgaactgtatcaatcctcttatgcaaactttatcccacctgtgccacccctgatactgcaatgccaacccctcctcttattcctcctcctcagccaagtcagcgtaaagatgacggggatgaagacctttagaattatccatttccacttaatgaatagtaaatatattttccttatgattttcttaataacattttcttttctctagcttaacatattgtacaaatgtagtatgtaatacatataacaggttaattacatattaattatttatgttatcggtttggcttccaggcaacagtagcctattagtaggtaagttttaggggagtcaaaattatatacagattatttttctctttccaatttttattttaggttcaggggatacatgtgcaggtttgttgtatgggtaagttgtgtgttgtggcagtttggtgtacaggttattttatcacccaggtaataagcatagtacccgatagtaatttttttatcttcatgctcctcctacccttacctcaagtatgccctggtgcctcttgttctcttctttgtgtccattgtactcaatatttagctcccacttgtaagtgagagcattcagtatttggttttctgttcctgtgttaattcacttacggtaatagcctccagctccatccatgttgcagcaaaggacatgatttcattcttttcttttctttttttttttttttgagacagagtctcactctgttgcccaggctgagtgcagtggcgcaatctccactcactgcaacctctgcctcccaggttcaaacaattctcctacctcagcctcccgagtagctgggattacaggtgcccaccaccatgcctagctaattttttgtatttttagtagagacggggtttcactgtgttagccaggatggtctcaatctcctgacctcgtgatctgcctgcctcggcctcccaaagtgttgggattacagtcatgagccaccatgcccagcctctttttcttttttgtggctgtgtagtatttcatggttctatatgtagcacatattctttttttattgcaacttttaagttcggggtacaggtgcaggatgtgaaggtttattacataggcaaacatgtgccatggtggtttgctgcacagatcatcccatcactcagatattaggcccagcatccattagctattcttcttgatgctttttcttctcccacctcccaccctctgagaggccccagtgcatattgttccctgccatgtgtccatgcattctcatcattcagctcccacttaataagtgagaacacgcagtatttgattttctcttcctgcattagtttgctgaggataatggcctccagctccatccatgtccctgcaaaggacatgatctcattcctttttatggtggcatagtattctatggtgtatatgtaccatactttctttatccagcctatagttgatgggcatttaggttgattccctgtctgcttttgtgaataatgctgcagtgaacatatgtgcaatgtatccttaaaatagaacaattggtatcccttttggtatgtacccagtaatgagattgctggtcaaatgctatttctgcctctaggtctttgaggaattgccacattgtcttccacaatggttgaactaatttatattcccaccaacagtataaaagtgttcctttttctccacaacctcaccagcctctgttgttttttgactttttagtaatagccattctaactggcatgagatagtatctcattgtggttttgatttgcatttctctaataatcgttgttgagctttttttcatgtttgttggctgtacgtatttcttcttttgagaagtgtctgtcctttgcctactttttaatggggttttttttttctcgtaaatttgtttaagttacatattgtttgctgaatattagatgtttgtcagacagatagattgcaaaaattttctcccattctgtaggttgtctgtttactctgatgatcatttcctttgcggtgcagaagctctttattagtttaattagatcccatttgtcaatttttgctttcattgcaattgctttttgcattttcgtcatgaaatctttgcccatgcctatgtcctgaatggtattgcctagatttccttccagggtttttatagctttgggttttacatttaagtctttaatccatcttgagttgatttttgtatatggtgtaaggaaggggtccagtttcaattttctgcatatggctagccagttctcccaacatcatttactaaatagggaatcctttctccattgcttgttttcgtcaggtttgtcaaagatcagatggttgtaggtgtgtggtcttatttctgggttttctattctgttacattggtatatgtgtccgtttttgtactggtaccatgctgttttggttactgtagccctgtattatagtttgaagtcaggtagcgtaatgcctccagctttgttctttttgcttaggattgtcttggctagtcatgatcttttttggttttatatgaactttaaaattgtttttttctaattctgtgaataatgtcaatggtaatttaatgggaatagaatttaatctataaattgttttgggcagtatggccattttaacaatatagattctttctatccatgagcatggaattttttttccatttgttttagtcatctctgatttctttgagcagtggtttgtggttctctgtgaagatgttcttcacttcccttgttagctgtattcctaagtattttattctttttgtgacaattgtgaatgggagttcatttgtgattcagctttccactaccatgttggtggtgtacaagagtgctagcaatttttcacattgattttgtatcctgagacttttctgaagttgcttatcagcttaaaaagattttgggctgagatgatggggttttctagatataggatcatgtcatctgcaagcaaagacaatttgacttcctctctttctatttgaatacgctttatttatttctcttgcttgactgccctggccagaacattcaatactatgttgaataggagtgatgagagagggcaaccttgtcttgtgccagttttcaaggggaatgcttccagtttttgcccattcagtatgatattggctgtgggtttgtcataaatggctcttattattttgaggtatgttccttcaatacctagtttattgagagtttttaacgtgaagaaatgttgaattttattaaaggccttttctgcatctattgagataatcatgtggttgttgtctttagttgtgtttatgtgatgaatcacatttattgatttgcatatgttgaaccagccttgcatcccagggatgaagcctgcttgatcatggtggataagttttttatgtgctgctagattcggtttgtcaatattttgttgaggatttttgcatcaatgttcaccaaggatattggcctgaggttttctttctttgttgtatctctgccaggttttgatatcttgaggccagaatgatgctggcctcatgatgagttagggaggagcccctccttttcaaatttttgggaacagttttagtaggaatggtaccagctcttttttgtacctctggtagaattcagctgtgaatctgtctgtcctgggcttttttgtttggtagtctatttattactgcctaaatttcagaagtcattattggtctattatgggattaattttttttttgagacggagtcttgctctttcgcccaggctggagtgcagtggcgtgatcttggctcactgcaacctctgcctgccgggttcacgccattctcctgcctcagcctccggagtacctgggactacaggcgtccgccaccaagcccggctaattcttttttgtatttttagtagagacggggtttcaccgtgttagccaggatggtctcgatctcctgaccttgtgatctgcccgcctcggcctcccaaagtgctgagattacaggcgtgagccactgcgcccggcctgggattcaatttcctcctggttcagtcttgggaagatgtgtagtccaggaatttatccatttttttcctagattttctagtttatgtgttagaagtatttatttatagtattctctgatggttgtttttatttttatggggtcagtggtgacattcccccttatcatttctgattgtatttatttgaatcttctctcttttcttttttattagtctagctagtggtctatctgttttattaagttttcagaaaaccagctcctggattcatttattttttgaagttctttttctgtctctgtctccttcagttcagctctgatcttggttatttcttgtcttctggttgctttgcggttgtttgctcttggttctctaattcttttagttgtgatgttagattgttaacttgagatctttctagtttttttcatgtgggcatttagtgctataaatttgtctcttaacagtgctttagctgtatcacagagattctcctaattgtagctttgttctcattagcttcaaagaacttcttgatttgtagcttaatttcattatttacccaaaaaccagttaggagaaggttgttcagtttccatgtagtatatggtttgagtgaatttcttaatcttgacttctaatttgattgcactgtagtctgagagactgttatgacttcaggttttttttttctttgcatttgctgaggaatgttttagttctaattatgtatcacatatttatccaatccaccattaatgggcatttaggttgatttcatgtctttgctattgtgaatagtgctgtgattaacatatgaatgcatgtacacagatttttgaaactgttagatttttgcagtttctctaacccctccattgttcaaaggtcaactgtatgtgcttttatatcagataactgagtataaatgtatacaatgcttggtttagtttgatatcaacttccaattcttcttcactcatttaactctataaggtggaatttctctccctcctttttagatttaacaaatattctctagacatctacagcattaggcaatatgtcagattctacctgtgttcttctacctgtattcatataatgccttgaaactatcaggatttcagaaatggtttctgaccttcaaagttccagcagttggtgatttcatatgatattaacattgtacagtgtttctcataggctgatgactgtttagtacacagtgcgctagttgcagtatttggctctgttcaaggaatagtctatttttaatgggaaaaaataggtcatttggtaaaaacacccaacataaacatgacctctattctcaagaggattttaaaatgaataccttgtggtttcagaggaacactttttaggttggacatgcatgtaatttacctgttatctgcagctgttaacatgcaagcagaaagttgatgcttgacagcataaataattctagtgcaggaacttcaaaaaggagccagaagaaaaagagagccatgtagttctgtgttgcaacaaaattcatggattaaggcacaggtatgaactcatggaaactgagttaaaatttcagaaatattgcgaaatcccacagtttaaatgataaaatattcaagtatgagtaagtctgttgacttctcaatgataatattgatgagaagcaccatttctacttgatgaggtagctagggaaagtggaggcaattttacaggatttctgtgttgaattctaaaattaggatcatagagattttaaaatattgtgtcatatgttgataggcattgtatttttggatgtaaaaacaactgtatctttaaatgtaaattattaatatgatttctatgatagttttatgtatcaatttggctaggctgtagtacccagttgtttaatcaaatacaaatctaggcgttgttttgaaggtattttgtagatatagttgacatctccaataaaatgactaagtaaggctggtcacggtggcgcgtgcctgttacaccagaactttgggaggccgaggggagcaaatcacctgaggtcaagagtttgagaccagcctgaccaacatggagaaaccccatctctattaaaaatacaaaattagctgggtttgttggtgcatgcctataatcccagctactcgggaggctgaggcaggagaattgcttaaacatgggaggctgaggttgtgatgagctgagatcgtgccattgcactccagcctgggcaacaagagcaaaactctgtctcaaaaaaaaaaagactaagtaaaatagtttcttcttgataatgtgggtgggccttagccaatccgttgaaaggctgcagaagcaaaaattgatgtttcccagagaaagaagaaattcttcctgaatttttcagtatcagcttcttcctaagaaattccagcctggttgccagatccacagttgcataagccagttccctgaaataaatctctatttatgtgtatgccaatgtctgtctgtctgtctatctatctgtctatttcatcatctgctggttctgtttctctggagaactctgactgataccatttcctaaatggaaagccttttaaagatatgaaataaataatattaggtagatgttgggatacaggtttatgcttctaatgttcccatttcagttctcatttcaagccttgttaaggctgtgcaaagcctgctgggacatatcctctgcctctccagcctgcctgcctgctgcactgggcattccagcagcagccctgagctgccctctccgctcctctcatgccctgctgcttccagccttctcttcctttgtctgtctgttttcttctacttcaaacacttttgccctcctctgcccttctctgtaaagccttctcttctctctgcccccttctcttcacaccagaagaattaggcttctctcatccccacttcctctctcatgcacaacattttacacagagggctctgttgaattgtttgcaagtcttttttcatttgctaaatggtaatgagtatgtcttattcatcttggtattcccagcacctagcacagttcctggcatccaggaggtgttcaatcaatattgttgaaagaatgaataaatagctgaccctctccttcagggataagcagctgcctttaagttccattgcagatggctgggaggcatcctaagtggcttttctttcagggctgggtatgctcctaagcttcttgttcctgagttgcttgaagagaaattcccaggcaaacagacctttaattaccaccaaaggcctatgctttcagtatttgtgagggattttatgtatgcccagcagatttaagctgattgtgtagaaatatctggcatcatatattggtggcatgaatgctttgcaaaatgagtataaatttgggctgatatattttaaccttttaattaatgtcttgaagtcttacctgcattcattagcaaggaatccaatatcccttttgaagttatacccgcccagtcaactttaaacttgatgctttgcccagtcctatgtagggtcactagggtctgtgtttttcaaataccagctatagaaaaagctgtgccattctgattattcttctacttcatgtgtgtcttactgttagtgtgctacatggtgtcattgttgaagcttgctcctgcatagttccacagacttctgtctactcagcatgagtgttgtccctggcccagaccctgcatgggccacagcgctgtttctaaccccagaatggtgagttcagaagagcttccattagtcatactgggggctgaaaacagctctcctacacataccctttagtgagcagcccaagtcagcagtgtggccatccactttccccacagtttttgtttggagacgtctcatcattcttctgtagcgctgggcctgtcaggtctttcacaagaagcctgtgtgcttcccatcttggggagcagatctcctcttttcctccctggtgatcagctctgcatgtcagtgtcttgcagagctttactagagtcacagaagtttattacactctttcccattccccttcctcagtaactttcttatcttaacccagagaactaccgggaaattaccaaagtgattcctcatggaacccagggaacatttgcttcgaggtgacttcctgcctccctgtcttgaaataaatgaagcaaatataaatttttatgggtctttcaaatggcactagatttaagctctaccttgtcatgcattatgtatgtaaaaatggtagccctttcattcagctataccatcactttccccttaagaggtaccaagaagcttagtcagttagaatgcagaaagatatttaaactgtagcaacttatggaagaaactgaaacaatctagtttccaaatgtgaattgttcacatactttaaaatataggctaaattacattataggcactcattacaatactcttcactacatcattaattttcagcttcatcgtttattatttttttaccttgcccttgttctggccaggatatttcactaattgcacagcctcgatcatatttcaggaatcttcgttcttctacttccttttgtggcaccatccgatccaacataaaaataattttctcccaaagctatgttgatcttttactatcccagtgtttctcccataaaaagaaaatagttaccattcgttgaaactttgttatactaattggttctttatatttttggtaatttttaaaatgtggaaataatctacctgcataaatgtgaaggccgattgcacacaggtatatcttaattattgtggagtaaattgttataaaatattattaagtggacactcatgttgctcatgttatcatcactgatgtcaatcaaaggagtattgtcaggatcccagaagctgccctctggctgtcctagtgataaacctctcccttccctccaaagtaataactatctcatgttttaggccctttgctttcttactttgctaaatagttttaccacttatacaacttctctaacaccatagcttagttttggctatttctgagttttatatatttgtaattatataatgtttttggtgagggggttttgacttcttttctgtgacagtttctgagaactatccaggcttcaattagtactagttttcattgttgaacagtctccattgtaggactgtactataatatgctcatccattcttctgggcctggatttttcttgtgggaaagtttctaaatatagatagaattttgtgagtagttacaaatctactttttattcctatgtacattttggtaatttgtaaatgtttttttttctagaaacttactgatttcacctaaattttcatttttagtttgcatatcatttaaaaaaagagctgattatttgtttaatctctgaagagtctatagcaatgcccctatttcatttctgacattgatttctgacattgtgctttttctgtatatttttatcagtcttgccagggactgattaattttacatcttttcataggactagctgtgttggtctattgtataattccttttttctttactgcttatttaattgaagtctttgaaaaacttatatatttctctctttgtggttaattttgctgtttcttctctaattccttgacaaggatttttaatcattcagttttagcatttcttattttccaatatatttattcaaaattaaaagtttaagcatggtgttagctctttctcacagtgctttcattattatcctgttcaaaatatttactctgcctcattgaggtttctattttgactcctgttatttggaagtgtctctcttagtttccaatgatctgggagttctcaaattatatgttactgatgtatagtttagttatattatggacaaagaatatcctatgtataatttagtcattttaatttttttgagacttgtttatggccctgctgatgatcaatatttctaagtgttctctgttgcattaaaagaatgtgcattctgtagttgtggggtgagtttttctctatatatccattaggcagagtttgctcatcctcttatttaaatcctttatatccttactagtttttgtctgcttgttccattgattattgagtaaaatatgttatttcacattttctatgggaatttatttttccttaatgttttgccaatttattttaatttatatattttgatagcacactgtatcttcctgataagttgaccctgttatcattagtaagaatccgtcttaatttataataatactattcacctttaaaattgatattaatatagctataccaaattttatgttgttgttatttgcatgttatcttttcccactattttcaacctttatgtagccttagttttaggtatttttatagcagcatataattgaatttttactttgcaggtctgaaaaatatctttattctgttctcactttttctgttttctgcattgtctgttttgttccttgtttttatttcattttgagctttttattttccttgttagagattttcttcaaatatatgataatacctgaagtctatccatacaggctgagcgataaaaagatgactgggaagtctctgtgcatggataggcttattgatggataagaattagggagacggaggcagtgtaggaatttggccatttcactgggagaccctcaattgttaataagccttttttaagcgggaggggctgctcaggtttttttttttttttttagatgaaacttctgtctttaacctagacaaataacattgtggatgatgggactcatatgtgtatgtacgcacacacacacaccctttgtattttaaagctccttctcattaaggtacctcattccaggcttgaacttcttcatgtagcaaatatcccatctaagttaggtggggtgaaagtcatttccaggtttcattgcatcagggaagatacctggtggcctaacaactcattgtgaaagatttctactgatcctccattggaggatcatttttctctttcattcctcttctcccttgccttcagaaatcctgagcttctcatccctgagcattattgggatccagaggtagagtttagcttccttcttattacgtgctccagaaaaagtcaatacaacaaagaaagctgaaactatgaccatccccgttcctcaacctgctttctaaaattgcattaaaaatttctcatgttctgtcatttcttctcctactctgcagttttttttaaattcctacattgtcattgtagtaaattttggaagagggaaacataatttctcactccaccaagtttatgtgtaatcttacttctagggtgctgtttacatgtggcaccaaaaggcctaaaaaataacatctaagagacagttgaagcaggggtatctagttcaaagacactgggcagatgttgaaaaagaaaggattattgtgaataaagcacagtgtattttactcgtggtcccaactacttacacctgaatcagatggtaagagcaagtacaagaacaagtaaaagtgaaaagtgagttttccataatatctttgggaatttgagactgcagggcatcagtgtccctgttgctattggcttatggtagcacaggcatggtacaatgatgtgggtgtattcgttgactgattacagacattataagggaggcatctgttgtaataacagaatttgcaaagatgtctgcattgtctttggcacagacatgagtaccttggtcttggtgcacatgttgacaacatgagtggcagtagcaggctctttggtgggcatcagttgaggagagggtatctctggaaccacttttgacattggaatcaactagccttcatgacagtgagtggaacaagaggaaaatagcactgtaatagctaacagtactggttccaacagcgcaaaggaaactctcagaaaacttactgagttatttggaggaactcgatgggtctgaaatgttcacaagatgggtggaattgtggcttttcttctctcctctcttttcctttttctttttgcttttttgaccgtggtctgatagctggtgtggtgcagcttttgaaacacacatttcaaaagcagagcgtgaaattcttggtggttaagtcaagagaaactatataattagtaaaattatgaaacaaatttatggggcaatgagaactaattcacttctaatttgaagggcatttgatgatgatgaggctttgtgaggctaaagagatgtcccttgggctttagagctcttcgtggaaggtccaagttcaggtatggccaagcacaaatggggaaagtgcttcataatcctttctctgatatgccacttctatattattggcaaactcaattccagggcccctctcccaaactcctgtgttgctctctccagctctattctatactactaaatgatgtctgcttaatattatcttcttgttacctttttctgacactttgtaagagacctataaaatacctttggtcttcagaaatgcagcctccactctctccaggttacacattatctgcctttattttatcttttcaacactttatatttcaaaatcaggctccctttatattagctagttaagtgatgtcaaatctagcttttcatctattcagtccacagatattccctcacttattgtgactcagttgacacactcaccgtttgtcccacatctctcaaaacggagacacattggtcttttggggtttttgtttttgtgtttttgagacaggttatcactctgttgcccaggcttgagtgcagtggtgcaatcaaggcttgctcgctgtagcgttgacctcctgggctcaagcaatcctcctagctcagtctctaagtagcttgatctacaggtatgtgccaccaagcctggctaattttttggttttgtagagatgtggtgcactatgtttcccaggcttaacagattggtcttaactggaccatatatcacattttttaactggagagagaggggagtgctattctaaatttcaggacacctgtgaaatttatatgcggaaacagtacattagatttaaacaaaagttaaattccccatttcctagagcagtgccacaaagtgtgggcacatctgtttatcttcgttctaattaggaataatttgagaaccaacctcagtctaccaactacactgatggctttttttgtatagccaatttagtgtcatttatttctaaaaggctagaagaatggttgcacagttaaaattgaacaaaatactcagaaccacaattttagactctaccctctttcctgggtgaatatttacaatgcttttcattgcaacgaatataatctcggtgacgttagctcaagaacaaagataaggtagggaacagtgattcttaggaagcaacatggatgtcccatggaatccaaagtgctggtatgcatgtcccaggaaggcattggaattagactgacacaccacccatgttttttcctgtcttctctcctttgcatatgtcagccagctttcatcctctgcctgccctctcactctctgccactctcactctctttccttctcttgctttgtctgcagattacaggggataaaactgtggtctccaacaatcactgggttattttctcatataacctccaggaaagatatttccttctttctctctttttgtattggttctaaattaccagaaaaggaaacaatagcagagttgggcatcattgtatatgtctccataagcttaccccaatggcaggaataaattactagaaaacaggcactgagtgataatccaagatgggaccactagctctggggtgctattttctttcccttgagaatttatgagtttacaagtatcagggtcatggtctagcatgcagtgagacatcagtaattatttgtttaatgaataaatgaatataaattaagataggtgcttatccaatataaatttacatgctgcaataaggttcctgggtaaaaagacagttcccttctcccttccccatatcactggagcctaaaattgtttcaacaggaatatggagtaaatcattgggaaatagtgttgagtagctacagggaagagaaaaagaggtggttgaattcatatccagaggaagatggacgaaaagaagaaagggaagaagaaggaggaggagagagaagagaaagaaaagaaattgtcacaattgctttgaatttgaaaattttgtaggaaatacaagaacagtctcatttttcaggtttcttcattttattatatacagtggacaaattatagttcctggcaactgttaattattgtatttatgtcccattgtttttattccattattttgatcatttgcaaccatgaacacttgcctccactgacacatacccattaaaattgaacttggtttttgttctactttgaacagcatcaaaatctttgcaaaacttgtaagttattttatgcccttctaattagtttagatagaagaatcattatatagggtaaattaatgaatgccattctggcttagcttacaattcccttttacaataataaaaacttatggcaatgcattgtatatattttacttgaatagttctaaacacttaattttatttaacattaaaatgtgactaaattaattatgaaattactttcaggtaatttgtgactctctggattcctttggggatttattggggttctcttagcaacaagctcaggattttaaagcttggttatctgtatcatttttctaataactttagtgaagataaatgaagtctctttgttgtatttgtttacttcattagaggtagaagacagaactattcagagcatcaaattagattgcatattcctggagtgtttgggaagttgataaaagaaaagaattaaactatgaaagaaacttgggatataaccacacaaaatctgggactttagaattagttttgaggctatattgttttttaaccttatagacctttatattttgactttaaaagacacacaacaaatgtagttttacagtatccatttgaagggcagtggaatatattttgtttcctttttttcatatggataaaataaatgtgttttactgtgtagctctggtattgtttgtgccagcaaattggtgcactaaatcatgtattgataagtaatctcatttaaaaaatactttaatatgattaagtagattttcaatattttactttttaaattattcaactgacgttcgaagtaagtaaatttacagcatgtgttgcagaaagtcaaagatatgttctttattttgatttatttatattctagcctctagctttttattccagaagaggtaataaaaatgatacaataacgctctattctaactttgttagagcatcataattacatggcacacaatttgtctttgatgtttgcttttattttatcttgtattgcaaatccttgtttttaccttttatgcttttatactcatcctactttggccctgatgtcaaatgatttaagtaatttactacttaattcatttacttatttattgcattcctaaaacatactataccctgggccaagaatttcatttgccaaaaaaaaaaaaaaaagatacatgtttattacccttgatgaagcaaatcttatgggagagaagggcaatgtaagaaaatcattaaaatactctgggaaaatgatttaacatagaggtatagtcaaagtattatgacaacactagggaagcgataactttcaaaagtaatggcagtaggtttctcagtggacagactgagttagtaatctcaagccagaagacagggattggcatgggacaataaagagagcattctgggcagccattataagtgtattatgaaatggtggtatattggtgagattgatttcctagtaggaggagggcctgaaagaaggagattctgaaatgtaaggagatgagtctaaaaatgaagatgccttgcagagtggaggttcttcttatccatgttgtcttagtccattttcacgctgctgataaagacatacctgatactgggaagaaacagaggtttaatggacttacagttccacatggctgggaggcatcacaatcatggtggaaagcaaggaggagcaagtcacatcttacgtggatggcggccagcaaagagagagtttgtgcagaggaactcctctatttaaaaccatcagatctcatgagacccactcaccattgcgagaagagcacaagaaagaccagtcccacttattcaactacctaccactgggtccctcccacaacacgtgggaattgtggaagttacaatccaagatgagatttgggtagggacacagccaaaccatatcacatgctttaccctgtgacattggggaccacaatattattttgaaaaatggaagccagtaggccagaagtttacctttttttacatgcatattatgaaatagttgtactagaagctttgcatactttatatcatgtgttccccaataaacccctgggaaggaaaggtatttttattcccactatatagataaggaaatggatgattatcaaagttgatcatttgtcccaagtcatgggggtatggggtgggttgcaagcttaatcttttctggttccaggacttctgcttctccagtatgccctgtttctttgctagaaatccccatagtgtcaataaagaatttactgtgggtggaaatagttacaatagaataggaaattattactttagtttcagattagagatgattatggacagaatttagacattgatagtggtgatgacagaaaaacagcatagatttgagagcctttcagaagtaacattagtgattaatcactaatgttgagagtaaaggaaagggagaaattgatgtaatactaatgtttctgtatacagcacaaatgaatttcactgaatgggctgaagtaaggcaagaaatggaagaaagaattgatgtatgctggatgtattcacagtgagggtgggcttggttaatgatactctgtctcccgtcttcttagatatgtcttccttatagaacttagagggaattaatggctaaagttaggaaatttgagttggaattttatcagtgaccattgttaggttcagatgcaattttaatcattacaggctacagctaacaattgtctgcagcttttttgtgacattccaggggatcttgccccatagcctcaaaccataggtctggcctggaaggtccttacacatgtattgagctccatcaaagtattttaaatcaagaactagagattttgagcaaatatactaaaatgtggttatttggataatagtcgagtaagtgactggagtcattaatctagttaatcatttcactacaaacacaaaatgattgaggaaaggttaattttaaaaatctaggtttagttcctggcattttgtagtgacaaattttcactttaatgccttaagaatccttagagcttttgctttagttttagtgtgtttaatgcagacctgtactcatgcaagtcaactcctcgcccatgatttacttgtgtgtgaagcccccaatcttatttatgttgtccaaacatggctgagagagacagctgtgacattatgaatccagctggccacagatggtttttcagtgaagtatggatccatattggtttggtgatctgtgtgtactgcctcctgttaaaattcagactcaaccactaaatcacctggcattgactgcaaccacttatgtatgactaatagactgaagtgaactggaacttttgttgctagtgatcaagacccttactgtaagaccaattcactatattatagttttattgactattttgctcatgttagagtctgtttagtttagtcattttgcaacaggttttaataggcttggtatctcgtattgtcaagatgttatgataattagccttttccagatcttgtatattgaaatctccacgtttgttatggatttgatggttaaggtttaaatctcgaggaaaaaataattgaagttagaggctgagaaaaaatttatttaggatcttaaaagcctatatcaatgatcaatagttacttagaaggctggtagaactgcaagattttctagatagtggaaaaaagaaaacaaataaagcataaaagaaaacaaaggatgtatgagttgttaaaataatcagctaatgcaccaaacaaaataactttaattgtgcctcttagcaaataaagtttaattctgaattacttgcccaaatcagtaggtatatgaaacctcacaatttcacttttctagagtccaatgtgatattcaaactggctaaaattgctgatataaatatatgcctgtcttgttgtttacaatccaaccaggaaatcttgttaaatgttaatggatatgcaaatgaatgaaatagtagctgaaaatttttatgacaggtctgcatatttgtaattcttcttcatatttatccaaagcagcaaaaataagaataattactgaatgactagtctttatatattattcttcatttttaagtatattagttatttcataagttgtcagtactatctcatctgcattgttatagcatctagcacttatcatatgtccacagccacaggcaaggatactttattttgtgctgatatattactctgggtgaatacaggacagttatcttccagtcagtcaagaagctataaatgtagctggagagataaagtgaacacacaaaacaatttttagaagtttttaatatcttcctccatggaaaagtttttcatgattcaatctcattttattgctgtttctaggatttaatgtatggagatctacccatgccatatataaataaatatgaatgatttgggtcactttattaaatcataatttaaacaaatatttattaattctccactggagaatcaacagtagacaagatagccaaaatagcttcctattcttctggacagttttttctcttggttttcagtgataggagcttgtttcttgacatcctagtaatttttgaatgatggacagatattatgtataaaagtgtgtagaggataaaacaaaattttatttttccacaaaacatttactttttcctttgttaagtggagacagtagaagctgttcaccacaatctggtcatcaaatggcctgggtaagggctggtttatactttcatcaaggattcatccatctctggttttctgtagccctccagagggctgtattctcttggaccacattctctagctggttctgaactctaatagagtcctcaatataaggaagttgccaaacctccctaatgctctttagagattttacttagtcttttagtctccttcctgtacaagttcagaaaggtttggcaagtgtcttgaaaggcaaccagctgtgtgtcatgctgtcttctgggtttctccttcctcactaggatcttggctccttaaatttccaatgttgtctgttcttcacagttctaactttccacagttctctctaatctggtatcttgatttttctagtcttcattgcctcaacaattttaattttttgattatttaaacagtgttaacacttttgattaacatatattcaaattgtatacacatgtacagtagcaccacttcattaaaactccttttgtcagtaacctccatgataccaaatttgtgacattttttgcatttttaaaaaacttttaagttcaggagtacatgtgcagttttgctatatagataatctcgtgtcatgggggtttgttttacagattgtttcatcactcaggtattaagcctagtacccattaatcatttttcctgatcctctctctcctcccacccttttccctctgaaaagccccagagtgtggtcgtggttttggtttttatttttttagttattagctggatgattgatctgttgcaagtgtatccagccgcctgtctctatttttagatagtaaaataaaagaatgataccttctcttatacaaatgtatgcaattacagggaatataccctaaaatttccactctaccccaagatattctagaactaattggaaaagtggacaggtggggcattgaacaagttcttcaaattaggtatcattgaaagaactgggcaattaccagagctaatcctttatagtaatgttgagttcactgaccaagagctgttcagtgattgtggtactgaatggtgctacaccaagttgtccaagtgaataacttgggggctttcaagtggacgccactttgattggtgaattcaacatgaattgaaactcaagacttgatggttgctctggagagctaaaggttctgcatactattcttgacttcttattaggatttatcttaaagggaaataagttttaatttttatcatctactaagctacttgtggacagagtagatatttgttgtgttttatatcttcactaacacttataagaagaagatgttgcttagtggttaaatttctgcgtttgtgagtcaatcaagtttaaatttaaatcctgtccatttaccagatgcttgaccttaagcaagttgcaaaaactctgtaaatctcaatttcatattgtgaattaggaataataatacatttcattgtaccagtgtgagagttgatgtatacactgtatttaaagtggtaataactatctttggcaccttataagcatgcaatttatggtagctataaattttgggctactatcaaagtccatggaattggagatccagaattttggggttgtccttaaaacacttacagagagcctccaaggtaggtgaatgaagtctgttgaaaaagagttatgttaagaatttttaagtttgctttttttgttaaataaaactagttaaatatctgtttattttatggataacagaaccatctgaaataactccagaaaagaaaagactgaattggagatagtttacctctcagtgacttcaaaaacatgtttcttcataatttcagtagataaataatgaacaatcattatctattggatgtattttaaaattaagaagaattaagttttaccaatactctaaattgtacaggtattattatgtataagaaaaggagcaaaatttaagataaaagtagttaagtgaacaaaaacttaagagtaaaataaaaactaaaagagggagagagaaatttgtcacctagctaccatttgttagttatatgatatgaatagggcgagttatgtgatctgagtcccagttttttcagagaaattgcaaaattagaaaaataataattagtgttttcttgaatattaaatgaaaatgcctgatgaacagtaagcatggtcttaatactaatatttaatgatcagtggaaataggaattagctatacaaaaagtaaatggtataattacattctcttatttatatttcagtaataatttaaatcacacatatttggatcaaatttcatactgctttattatgcatggaaatttttcttaaatcttgatattattctgaacgttattcaggtatgatgttatatctaaagcctaatcccagcatttttccaattgttttgatttgatggaactgaaggaaagttagctcttctctcctctttgaagttactccaatttaggaagtgtttctgctctgctcatacttgagtgagcatgcaataatacctttgctgagtatttctgtttgatttttcaaaagctgtcattagtcgtacagctcaaatatgaagtgcacatggtaattggtggagccacattcagtcttcaagtataattgaaaatgacccagacaccctgagagctcttcttagacttccagatttgtaagcatatgtgatgggacaagagccagacagcttgctgagaatgggagaagtccctttgcctgttgctgaaccagaaagccttaactgtatgactctctgagtccggacaatgtcttgtgtgtttgtttccacagagcatatatcattacagactatatgggcatccgaaatgaaagtttcatgaaattagctgcagtagggacctggatgggggactttgtcacagcttggatggtaagaaaattttaacttcacccatttcaaacatcaaacggaagacatgttcacagtgttggacagacactgcttttgatgatgtagagtaaaataattacctctctttgagtgaaacaaatttatgagtaaagataattccagagattatatccaatatctgtggacctcagaaaaaaaatcaatgcaattagaatacaagtaatggcactccaccagaatctgtcgatcgatctatctatctatcatctacctatctaaacacacatgtatgtttgagcatataaacatatacagtcataacattaatagaaattctccctgtgaagttacaaataattttgtttgtctaaataattttggctttttcttaaggcatgtacaattttcaggtaaggaatgtggtctggcctgtctcagaagaccatatgaaatattttttttagcaatttaagaaatcattttctacatttattttcctcattggaactactaatataatggtaactgagttctgagtattatctcttttaatctcttttgtattttcttactccttgttactataagcctggaacaaacagacaaacatgtctcctgctgagctcatctgtcaataaagtatcttctgtttttaatcattgggttaaaatttaaagatagcatgttgctagaaggctctgggttctataaatttatgagagactcacaaaatgcaaagaacataactcccataaaaatggagcacttcattaataccgttcataaatgcagttgattctaattacctttgtcagtctattcacttgaaaatgaggagatataccagaaggcagataatgcctgactcagacaagacttggcatggacatgtccctgcagatatgtcccagatattgtaggtagatattgtaggtaggaacaaaagagttcctgccatttctattgattgcttcttacctggaacaggtgctttccaggatcaggaagcagttgtagcttaactgctcctactgagaacatccaggaagagtatcaagtaactaccaaagggtttgtatggcctgtttttgagcctccacctacctctgttgatttttagaatgttaacagattactgtatggattctattccattaactttaaaatgtaaacttgaaaaatgatttatttgtaatctctagaaatagcaattagaataaactagacattgagaacaggctgcctcacatgagaattttcttttttctgggccgggcgcggtggctcacgcctgtaatcccagcactttgggaggccgaggcgggcggatcatgaggtcaggagatcgagaccatcctggctaacacggtgaaaccccatctctactaaaaatacaaaaaattagccaggcgtggtggcgggcgcctgtagtcccagctactcgggaggctgaggcaggagaatggcgtgaacctgggaggcggagcttgcagtgagccgagatcgcgccactgaactccagcctgggcgacagagcgagactccgtctcaaaaagaaaataaaaaagaaaaatttcttttttccattggaaaaagctttttaggaggagatacataaactttgaaaaacgtaacttccttgaaatttgaggggatgtttaaaaaaattttttgacattaattatgcattgtgattttgacatcactttgtggcaaatctgcttaataagatggaaaagataactagattaagagtccaggaatttgaattatctgacctgaccacctatggttcgaccttcctacaaataatgaacagttctcggaggctcagtttgcagatttatcaaataggattaatagttccttcctgtgttacatattttctgtaaagcttaaatgtgtggccctgtgatgtgacttaaaatgctaacgtataaggtagacataagtgcttcattgtgcacattgtggggcttctcatcactttagcttggctcagtcctttgaggggatggcaagggccaagtcattgatccaaacctcaggatgcctagacttcctgagccccataagtgtgagcagcccaccttatcccaggcctggggtccagagtgtctggagtttatttcaatcgccaatgatgcaggaggctaagatgatatggtacattgcttcctgacttttgtcttatactgaacctgacaaaagttagaggagaaacaatgaaccagcaggacctaggagctgaagtttgcaggctcatgccagccatttattacataaatcattttcttttccactatggcaacattgtttgtttctaacccaattctatccaattcttccccagccatttcttcaagatgttgctttctgtaccatatacagctctgcctctctttattggttcattattattattttttaaattagccttttttcttttttaaccatagggaggggtccaattgctgcagcacccttaggaggaaaatgcatggtagagttttgaccaaagacctttaacccttcctggttggatttctattctgcacttgtctgccactttcatctggctaaggggagtacaaataattccacagttcagcctgtgatctttgtctcctttcaaggtctggctgaccttcatagtttcttctaattttactgctttaatgtcttatatttctactagctaacctgataacttcacttttttctatatgagagattactgctacatcacagaactaagactggattgagagtcaagaaaaccgtgttctaggttgaacctcacaatgtgatcttaagtcacctaaccccctggggcctttctgtaagctggaagagaatccaaagtctctttatgctatgttatatgaaacattgacctttccacattagacacagggatagaaatagcaaaggaaataccaagtgctcctgattttaaaatatagtcacacagggaggattcccagagcacatcatttctattcccatttctattcactgattgggcagtgagtttctgtataaatatttatatgtctacatatgtgtatattgataacatttaaaaaaataatattttccctcatgagagaagtctaacgtagccttgaccttcatctgtctataggattctcatcgtgaaatgaatatcaatgatgagggtgactgtcatggaaaagcaactatttacattaacaatcaaagtgtgtcttttatatatttctgaaatggaggatttttcttttatggaaataattcaaaactttttcatagttttaaaaggcatatcaatattaatgtgatccaaagataaggatggtgtcaaccaatatgagaagtatctttggccctcacattacagagcttcaagctctgctgggtccagtttcttaggcagctctgacttttcctggctctgtggtactccccatgcagaggacaagagatatataactcagggttaagggtactaattcttttgtcaaataggtttttaaaataggttaatatgtaagaaatacgtaaagtgctgagcgatgtaatccacattgagctgggtctttgctatgggcaggatcagagaaaagcgctgtcatgaagctgtaaataaaacaacatggggtgtctcacgagacaccatttccaggtatccacccgtgcactgtgccattaagtcagaagctggaggagagttggccagttccatatcacattaccccagttttgccattgctgcttcagcttctgatgaggtctaaggtggcaggggattccaaggacatcatgatggcacttgcttctgcccttaatttaatgccagagagaagaagcacttctgctgatctatgcctaataatcccctgttctagcccctggtacatcctgttctagttgcttccatcttacagaagtaaatggtatgactcacaatagaaccagggcatcagactccaggtttgaggttcttgttggggtgaggggtatagataaggtaaaactgagccatgacctaagaagacaactctgggccgggcgcggtggctcacacctgtaaccccagcacttgggaggctgagacgggtggatcacttgaggtcaggagctcaccagcctggccaacatggtgaaaccccatctctactaaaaatacaaaaattagctggatatagtggcacatgcctgcaatcccagctactcaggaggctgaggcagcagaatggcttgaacctgggaggcggaggttgcagtaagctgagattgtgccactgcactccagcctgggtgatagagcgagactctgtctcaaaaaaaaaaaaaaaaagaaaaagaaaaagacaattctgttagccaacactgaagtcatcataaagcatccttcaacctgaaaaccgtatactgtgtgtatcaacttctaacagtcacaggacattgcatggctttaacatagtagccctaggattatctgtcggaatttatgtatatgtgccactactagcaaaggctttaccataaagtgatgttgtagacacataaaacaggaaaaagtcagtttagttgtttgccagttggctttacttttatttaaggcatttatagtgaccgtctgtttataaaattatgtgtgatttttaatggactttttttccccttgaaagttggagtttcattagagccagacaagcttaaccactaaaaatgcttttggattaataaaacatagcctttgtagttggaatatagtaagaaataagttgtaatttttgctgaattatttctctgtattgaggatctagcaagaatatgattttagaaaaaatgtgttgattttagaaaaaaggtattttttagaaatatattttacctttctattttaactgtgtctattttatgtataagtactgcaatatctgtctaaatatttgagtgacaatttttgctgtcttatttttcatacactttgtattttttcagagagattttatcattaatatttatactgctattatctttgcttcaaaagactgttcatactagttaagagaaaaagttaaaaactcttcctgacttgactagaagcttcttgaggggagttacaatgtcaatcatatttataattatattcctaacacccaacacagaaccaggtataaaataggtgctcaagaaatatttatttaaagaataaatagatcataacagcacataagcactgtttcatttcttttttctggttcagttttgtgacttattattgtaaaatgagcattctagaatcctataaaggtggaaggaggtcagctatattgttcagggtatcatatatattaaccctgctttgctcctctccctaccccacctcaaccaggctatgcacttcttcacactaaatttgttcccagaaccacagggacacatgcttgtgaacactcttgaatggaagtgatgaattgccagtgtaagtctcccaaaatggtgatgtcattcttgagtgtaaatggcaaagagtataaagaaaagattgagctctgcagatcctgccagtgcattcttcgaatggtcattactgctctcagtggcactgtgttgatcccagctctggggcagaaggaagctgggttgagatatgtcccttgagtcatgtgagcaagaagagattactacgtaagatagaaaattggttaaatttcagtggacagagagaattaaagaatggcatatacttgagagtaaataccattacatcaagggtcaatattcatttacaactctagaacagaatagagggaggaaatatttctgcagtgtttgagcataaagtattccttctagcttaaatatagataatatgaaataaaatttataattatataaacatacaacctaaaatgtggtgatgtttttaattgtcattttatgcttattgcacacttatttaggaaaggagttaactgtttgtgttattttcattttatcaagttaaaaatagtttagttcaaaattttctagtttatacatgtcactattttgtggactatttcacaaacactaagtgtgtgaatgaacagtaacctggaatataaccagcatctagcttgttattctgtctggaattgagtttgacaatgcatattataatcagtgccaattttctaattatttctcttctactgatgtttcaaaatgacagaataagaagcataattgaatttgatttagcacttgaaataaagtagcaataacagtttaattgaacttcataatagaaaaaaaatttaaaccatgaaacttggaatagaaggccaggatgagcaaactcattggacacatgtatatgagaaatggaagggtgcaaaccagatatttagccatgggagctggacctaagagctgaacattcctctgggtctttctcttttgctgtctttctctgcctgttcattggaaccattttgacctcaacctacccctgattagttaacctcatgtttggtacattcgtatgttccatttcattacttatacagtgaaaatacaaactggatcaagcatttaattaatacactatctttctataaagatttcgtgttatgtgaggttctctaagaaaaaaagcatgcatcagggatttaggggcacaagatttaaagaggaagtactcttggggaatctgtaagagatgagagaaacaggagagagaaagagaaggaggcaagcaaagatatagttctatggtgtcacataaagtctgccctcagcctgatctcctgggactgtgctcttgggcaatggagtgctccagtaggtcaagaggttgcgagtgggacaccaacatggaccatcgcacagacaaaacccaaggacggcagatttagtggcacccacacttgccaaaaaaaattaataataatcagtttgtttgatcatttgattgaagcaaagagcataaaagggaaattattttttgcatttcttttttgctcattaggaagttttgagggaagtaaatgtggtcattttgcttttgcatgtataaatattttaatgtctctataaatattttagctttgtgtttcatgttccttcaaaataataagttccagctaaaaaattaataaggcaggagagtctaacttcctgtgttcagatagcatcctaagtgatgatcaagagtcttttaattttcatgacttttggaattaaaaaaatagaatatgacctggaataaaaaaggatttccgggtaaaaaaggttgtactataatgtatagacacttaagaacagaggcaaaaattctggctttcactgtaagtctcctaatgccaatgcccatcaaaatatcaaataattccatagtatgtgataggtatatgtatgcaatttatattcatttattaaaaatttgtggaatataaattttatattcatattcaccaagaatatgaaaggcacctaggaaaattcacctaggtattgaattgaactacattaagatatgaaagaaactgaggacatctcttatagaaagacattcccaccagagacaggggatgctcatttttcatctttttcatccccaacttagtttcagcttcttccaattccattatactttatttctattacttagtttatacttcctctagttgggtacctcctttgtccacatattctttatgatttttctaacgtaaagttccgcaccttttttttttgatggaattttcttttttttttcattattattattatactttaagttttaggatacatgtgcacaacgtgcaggtttgttacatatgtatatatgtgccatgttggtgtgctgcactcattaacttgtcgtttagcattaggtatatctcctaatgctatccctccgccctccccccaccccacaacagtccccaggtgtgatgttccccttcctgtgtccatgtttaaagcagtatttatccaccatttacctgaagaactttgaataaagcccaggaggcattgatacttgattttttcctctttgaaagtcaatgatataatgaaatgagagctggctgttaatataggctcatattagaacttgaaaaaagaagctatgtgcttttttgtagtatgtttaggagttggatggctcccttaacatttctttcaccttttatttagtgcctcttgtgggccgagaactattctaaatacacatatttagaataatgtttatatataatatataatattatatttaatatattatatattataatatatatttaatatcatttaatatataatatatattataaacattatatattatattatattacataatatattatataaatataagtatatatttatatataaacattattataaatataatatatattatatatttaaatatgtaatatatattatattaatcatatatttatattatagatataatatatatttatattataaacataaatatataatatataatataaatgtatattatatatttatattatttatatatttatatttacataatatatataaaattatatttataaaatatatataaatataattatatttatattatatattataaatataattatatatataattataaatataaaatgtataatcatatttatattatatataattatatttataatatttatatataatcatatcatataaatatatatattatatataaatttatatatttatatgtattatatcatatataaatttatatatttatatataatatttatatcatatataaatttctatatttatatattatatttatataatataaaaatttttatatctataattatatcatatataaatttttatatatataattatatcatatataaatttatatatatatttatatcatataaatttttatatataatatttatatcatataaatttatatatataatatttatatcatatataaatttttatatacataatatttatatcatatataaatttttatatataatatttatatcatatataatttttatatatataatatttatatataaatttttatatatactatatataatataaatatatttatatttataattatatttataatgtatataatataaatataaatatggtgtcacataaatatatatacattatgtttatatgaatataatgtatatattgtatttatataaatacaatatatacattatatttatggaaccattttgacctcaacctacccctgattcgttaattatattcttaagtatatatttatatatacttaagaatagtgcatatacacacacacatattttagaatcatggtgggcctgcaggaggtgctaactaaaaggtaaaagaaatgttcaggggagtcattcgactaattccagaagtactacaaaagaagcacatagcttcatatttcaagttctaatctcagctaatattaatgagtactcattttattgtatcattaactttatatcagatacatactgattttccatccataaaaaccctgaaacaggtggagacactgaagcttaggaggttaagtgtcttgcccttgcccaaggtgacacagatatggcagtatgaatggcagaacttggaatataacccaggcaatctggttccaaagtttttattgttttcacatactattctgacaaactgaataattttcttgcaaatatttaatagtagatcttaatccaatgtggcatatagacatagattttggttcaatttttttttctgcttacatgtcaattgaatttgttgaattttgtcatcagatgggggaagtgagtatatttttaggcacgaaatgatataaccatcacgtctcagccaaactgttgattttcaactttagaaaattcctaaattcctatattcctattcccttttgataaagatggtggaaagcatcttatttctggaatgggaaaaaggtaaaagaataagttttatcttattattgtttaagatagatattgcagttcctggttacttaagtgctaagtgtttttatgaaattgctattctttagcagttgtttgctccacgtatttttagagcagtaaagttttttatattcatagaatatgccacatttttagttaaatgtgttttaaccatatttagttaaacatcagaaagagatttatagcaatgaagtatcttgtatttatgctttattgttgttgcttcataaaagcttcattatgtttcaagagattaaagtaatttgagtgaacacagggaatacaatatttgataagaaatgattaagtaagagttttcctaaaactaagtttgggatatattcttctcttatatatctgaaagctgattaggaaataaataacttctttttttccttggctgacaaaatatgttaagctttatctcagacctggacctgcctccacgatccttcactagtctaccaaattgctcagtgaaacatcttaagtagcttttggaacatgatattgcataaggaatcaattaagcatgcaacagcaatagaaattactggtcaagtgtaagatcaaataaatttctctgccatttccaacgatatcagttaaaacagaagataaagtccacatcaacagtttcttaaatgctatagacaaggacgcacaaaaagaaagtaggacaccacgtgggccgtgttaagaattccaaattgttcttgactactgaccagaggttatatgagaagtaatgcctatgagtcaagtgagtgagagtgagatgaaacagaaaacctagagagaagccatctgttttcattgaaagaacagcacctctcgtaaagattttaaaatacatcataaaaatactatgaacctgtagctattgaagaaaaatgaaacctaataattttcaaaacccaagtgctttttttcttatgttgtaattatcctaatttctctttgacattttcagtttgaacgaaaaataatagaatcaaggaagaattttggcaaatctaagttgcaggtttgaaaaaaaaagaaggcattttattttacttaaataaaatttagcaaagtgaaccagttttcccccaaacaatatgctatatatctaaaaaaaaaaaccccttgttttgattatatgattttttttaaaaaaaataagcagaatattcctggtacttctgcatactttactttcttagccctacaagtctctatcgtaatgccattgctatctttctaaaattggtgacaacttcaattgactatttcttggaccataatatctttgagaacatgttttctctggtgtcaagggatttgtgaagtgcagagcttatacaaataaatgaggaatagtccaaatttatttttgctactatttttgtccaaatatttcttaagataatcatctctttcctccattcagccacctttttgcaacaaacattttgagataaaaaaactcatgaaataaggtatttgtatacatagtttttaaatattttatcaaattttgatgttgcaaaattacagacctttggtattccaaaaccccactgagggtctctcttacttcttcatgaatctattcacttaacaaatatatacgaaacacatgtaaagtcataacaaattagtaaggagtaaacattggactgtattaaatatggtaaaaattgagtcaaaataccattgcatttgaagttaactttctcttattaatctctcaatggtcttgttccagccagcccctccctagacttgctggtttggcaagtggtcatgctgtgtataatttgttctgcaataccttttggtctgttcaaatcttaccaaccatgtttcagtagcttaagtcatcagtttgtggtgaggtcttaatgagtgacagtggctttctctgttaaacttgcataaataataaataccagcattgcaaattcaaatgccctcaaggccaggctcatctagtagaagtgtgaaacatctggtatgagataaaagggtctgtgaggagttgagggcagctgcgttgaaccagagatcgtgtttcttgtaaagaagcattaaaattcagtttacaacaaaaatatcactaatgcaaagtaggatataacttcagcagaaagtctgccctttggtcacctgacagggagtcctgctttgtgctttttaaacagggcacattaatctggaaactgattatggcatgaatgttgcaagaacagcacagcacagggcatgagtttgggacaggtaccatgttgtaatgtctctatcgcacccttaaacttatccatcctgtaaaaggttggttctcccttttctgtccactaaaattcaggggggacaaggactgtctgcatgttaatcatagctgataagaacaaccggaatctttgtactgcttagcactaattccacccaaacatttaaggctcaagcaggcaaaaagcattttcataataacacttactgaagtgttaattaaatgcttgttatagtagtcaggttagcccttaccagcatggattcagagagacctcaagttcatgctgtatttgttgactaacttactagctttagtttctcatcaggaaagtgtgtgcagatgtgtacttaatatgcattgtggaaatcttaaatgaatacaaatatcattaagctgtcaatatttgtaaatctcttaagcagtttatatatagatttagggaacagagcttattgtttagttgggtgctctaatcagtttttacctgaatttcataaggctatgattcccaaatttgtctgcatactggaatcacctgggaagtttcaaagactactgatgcctgtgtctcactctgggatagtggtttaacttgtctgcatgtagtctgggtgttggaatgtttaagagattcctagagattctaaaatgcagaaaaatgcagggactgtttctctaaggtggttccaggaagtttggcatgggaacatttggacatattctatgtcaaaatcagatattatggggtcatacttatcagatattaaggttgaagagaaaccaggagaaagaatcttttggtgctggaagactatacaacaagcaggcatgagggtaagatggatatgaagagggttggctttctttttgggttgcagcaccccaagggcctgtacattgccacgaggcaatataagtgctcagtaaatgttacctagcctccagagttaagtctagaacttgctgtgggattcttacagagcaactttgactctgggttccttttgatgctcacagtgtattccccttttcccaaggctagattctaccatccttcatggaaaacctgacagatgttactatgcccaggctttggctcagataatatttaagttttcctctctctagttatcaggacaagcactgccagcccaccgctttcagttcataatatgaagaacaatccttttataattttgcctattgcaataaagtgtcatctacataaactttcttctgatacctgcccaccagcaaatgacctgctccgccaattcttcatgtgctttaatttgattctttacttcttattaaacattagtaggtattgttgccatttgctcagggggtggcttatttttagtaattattacttagaggatatggctgtgaactgctgtgagataaaagataaagcatgtggaattatgactgctaatattgttagtgttacttaatttaaaaaattacagtgtttcatacattagaacatcttaaaatatcgttctcaatttggattttctgaatgaagactttttactaattttaacatctttttattgttgctctagtgtcatttccaaagcttagccaaacaggaactgataccaagactgtataatcactattttacatagcagcctttttaaaaaaataatgaggtcggctgtaagtaggtcactctgaattataaatatacctgatgttagtgttatgtcattttacaattttctctgcttatagaaattaaaatatgaattatatgaattatgtgatgaaaacacaataaaaagtttgtgttctgtaaggaatgcttatatgttaggtatacttttcaaaagatggtaagacagtcttgagcaggcaaatcatagtcccatttattaaaataagtgactaaaaagaagtattgaggaatgaaaaactttaaaatataatcttgactcaaagtagacaatttgagttttgccataaaactttgtctcataattttccatcctgatgagttctgagttctaaagtctatgagtatttgaggcaaaaattagatactcatccaaatagttttcttgtgtatacttttagtcctgcttattttagtagagtccaagtagcagattttattaaagtatgaatgctatattctctaaaatggattatatgcagaaaaacatgaaggaaagggagtttgggccagatatgtaattcaggaagcaaatttgggaagtagctgagtaaagatggtattttcctagtcagtgacaattatcaggacctctcctctgcgttatgtttccacaacatttcattgacttgtctataaaagtaaagcttggagtcaattcaggtgtgacaacaaaagaattcaatagtaaacccaggggaatcataaaggcaagtgcagattttaattcgaaagttttgacaaaacagctgctcaaggacaacaacttttgatgtgaagtggatcctgacagaagctcagatccctgatatttcagtcctgttcctttgtcaacataaaggcgagatagtgtcttatgggattaagcaaactccatggctaaaaatatagtttgacatttcttgaaagcacttgacaagactccacacaaaattatattagtattcttttcagctgagagacaatttttaagggagtctgagttctattattcaaattcagatttaatctttggttgccatggcatcttaaaaaatttaatcatatattgttggagtttaaatgttgggtctagggtgttttagtacagttggaaaataacaaactctagaaacattattgcaaaaattaaattgcatttgggaactttaaaaaaaaatagcagccctgaaaaagtcaattacaaagattttacataataggaattctacacaataggaaagtgattattgaccatgttgtcagtggccatcagtgtctgccctggtctttggcatccttgctgtggtacagctggctggcagattgtagctaatgtgcaagtagagaagaaaggtgaggaggagcaagggttgcagaatacaagacgccagcagcctcagagactggggtgatgcatgtttgatgtttagtgctgggaggaagaaatctgcagagaatttctgtggtactgggctgattggagatgggggcggcaaatggaaaatattttatgggtaggtaattatattggttctgagataatatttcagcagcagaaatggtgaatggcaatccttaatcaccaaatgttgcagccatgggaagtggaaggctgagtttgaaagtgttaagtcttcttcagatggaatgtctgttactgccttaaaatctctgtcttcttagcatttcctttcctttgaaaaaacattatttgccagcttgttggactctagctcttgttctgtttacctacagggaaaacagactgcagtgtccaacagcattatttactctttaaagacttttttttttaaccaaaaactgcagatggtttagttttctaaaacaaatgcagaggtgtgaatggttaatcaagctgaaacaattgcagagctgtgcttttgaaagcttaccaaatgccagcctcacttttgatgttagcattttttttcctaaacagtgtgtccataatttctaatgaaggctttgcccattcatgcttgaaattcatgataataatgtgcagccagataatcacaagatttggtgtcaaactgtggggcatataatttctgcgtgcctgtgaattagcactgataccctaaacataagtatatttatggttctccgtaaacatgccattaaaagttaaaatgctgataaaattattaattactttgtaactttgttgaaaacatcagcagaatgaacttaattcagatggttcttgataataatactaaaaaataattttaataaagaatctaagctaccagatgcctggtgagaaacaaagtgctggtgtggaaatgacagagaaggcacaggaacaaatgtaggcaatttaagataatgctcatctccacccaggttcctagtttcaaatcagagagaggatgaaagcacaaagaccctggccaaaggagggctcagagagaagtggcagattgtaaattagcaggaccctgctactagcctggaaagcaacatgacattccctgaaggtattccaaggataaaaataagtaccgagaatgtgtagatgtccaatccacagagaaaggctcatgtatttgtaagctgcgttagcccttttagatcgccaagtcaattcagtggtgttatattgagcatctaaattattttgttcatgcattaagtaaattacatacacatacacatatgtatatatatatacacacacacatataactcacagaaaagttaatatatatccatatttctctaccattttaaaagataagtgacaaaaggaaattactagttacagtgcagtacgatccaccaatgaagcttattttcagcaagaatgctatttactttattaaaaatttgatttgtatataatttttcaggaatgtaagtattgaataagttggatttccttatacagtttaaaaaattaactgggtgtggtaactcacacctgtgatttcatcactttgggaggctgaggtgggaggattgcttgaagccaggagtttgaaaccagcctcacaacatagcaagacactggctccacaaaaaatttaaaattagctgggctctgtggtgcatacctgtagtcctagctactagggaggctgaggtgagaggatcgcttgtgcctaggagtttgaggctgcagtgagctatggttggtccactgcatgccagcctgggcaacatagtgagatcctgtttctaaaaaaagaaattaccctatcaatgccttgatccgtgttgatgatttgaaatgaattattgtagctgccatagtaattacaatagtaatatacaaaatttgaatccatgtgctaaagcctgttctaaatgttttaaacctattgatttatttagagccaaatggtattaggtatattatgattatttctattttatagctgaggaagtagaggcattttgagtcaaggttacacagccactaattggctataatcatgaagtgcagtgagcactgggcaatagggttttcagggatattgagtaacatctcatttatttgacatcaaaatacatatttctctttactcaatagttaacataaacacaaattaaaccctggaagtttgtgactataattgtgttttgatgaaatttttctgaaaatttttgcgtctgttcctatcttaataaacaaaattataaagataacctatcatattaataatggaaagaatgttgaatttgcatacagttgggtttaaatctcaattctgatacttagtaattgtatgacctgggtcttaatttccttattggtaaagtgaactgatccctacatccttgtaagtcacttagcatggaacttatgtcatgataggctctcataaatgctagctattgctattaattttattgctcctatttccttaaaaggaaagtgagggactaatgctcaccttataagagttttgctaattaaacgaatggaatttatatatgccatttgtaaatgcatatgtgtgtgtgacataccctagcacagttcttagtaattatcattcagtaagcatatagagtacatgaattaatgcaggcagagcacttagaatatgcctggcatttaggaaggacttatcacatgttgtctgttattattaccatatgataattttgttttggtatttcagttggttgtcctattgtgcttattccctattcttggtttatggtagtggcaaattaattaattaattaatttttattacatggataggtgtaccaagtgacaagttgatactgatcacaaaaatccataattcaggaaggtgagaattatgtggtgagagaggtagtgaggtcagatatatatgttagttgaggcatctatggaacatcaaggtagaggagtatggtcagcaatcagatacagaaaataaattggactttatgcagtcatttgggaatcatcagaatatgcctgttatttgaaactactaaagtgagtttaaagaatgagatgccgtatggagctccagagaacgtgaacattctagagaactccccaaaaataaagatgatgatatatatttggagacatagaagagaaccacagcaactttgggcactgtatgtggacagagaatttgtggtccaccccagtctttaaatgcctcttcacttctacaacagttgacatagtgtcccttctttaggccctcatgcaaagtttggggtgggtgtcacttcttggccccactgtctcagcttcctcaatattcttctgcatgaaaccatgccctcagggtgcattttctctccctccacagacagagctgaatggtgttggacaaagtaactcatctctgatcttttccagtaaaactactccctcatctgtcactcagcctgtctcttagcccttcatgctctgacctaatgcatatccattaactggctgcttgggttttcttggtttagaagcttacatagtcaaaacctaacgcttttacaaagagtcattatatcttgtcctttttctccctcttccttccagatgtatctgtttactgtagcattaagactgaatgaatgaatacataaataaggttgtaatagttatgagactgaatgaatactgatgatgcagtggcctttgcacttgttctgttgaaaatgtctctgatgttgtcttgcctccatttcataaaagtagactaataacacatgtagttgtgtgacctttggagtaggtattgcatgatgacctttctcaaaattaattattaaatcaaagattttttaaaaatagccttttcaagtgatttttgctccctaggaaaaatcctaagagatgtgatcagtgtattttgactggtcaccaacattggaaaaatgcatatgcaaaattcctacaacactaacaggaagatcaggccttctggtcagcctcggttcttctgcctcacttaagtgtctgttgaagagtcttaaataagggatttgccatttgaagaaattgagctagaaaactttagagatgacttgctgcaaagcttgcacattctttggtggaagaaagaatggtttagcaaatccataagattagcattttaacaggtatttctaggcacgagccacatttaagaaataagattaaaattcttcagtagtgactgcattatttttaaattgcccactgaggcttttcagaccttcttaataccttttgtctacaagatgatctcgtgacataacacttagggacatggagaactttaaaatgctgtaaaacctgttttattttattttatttttccagaacaagttcaacatttatttagtaataatataaattttctatctttagctaagtctgcatttctgaaatgatcttttattgaaggtatgaaaagaatcaggtgacagacttacctaatgttaaccaaacttacctaagcatactttgccttagaagcaataggtaagtgtgtgacactttggaaagcactgtaataaagatttcttttaatcatcatcagttttatttatgggacaaaagagaatttggccttgtttcactacagccagaatgatgattggaaaaattatttcactgagtcttcctaggataaaaatgtgaacatcaccaaaatgtactaattttaagagcattgttggattgccattgactagccagtgtcacaaatgtgacttctaaaatataacatcctaggtatcaccctggttactttttatattttaagacaaacattgaacctgctaatggcatttagagattattgaagccactcatcataatatgtcaggtcaactggattttcccaaagtattttctattttcatctagcattgagccctatattggcaaaacctcttttttctcccttcccagatgaaagggatcctaaaataaatggattggatccaagtggatcctgggggcctggtgcaggagctagggtgggattgggattggacaaagctttctccatccccagtggtcttggaatgagaagactataccgtggaataagagaaacccgagagacagcataaaggggttgagacataagccaaagtcagaaaaacatacttctttttttcttcaatgaatttattaatatcttattttaaatttatttaaatagtttttggggtaaagtggtttttggttacatggataagttctttagtggtgatttctggattttggtgcacccatcacccaagcagtgtacactgtacccaatatgtagtcttttatccatcaccaccatcccaccccttcccctgagtccccaaagttcattttatcattcttatgccttttcatcctcataacttagccccaacttataagtggtaacatatgatatttggttttccattcctgagttacttcacttagtttaatggcctccagctccatttaagttgttacaaaggccattacagaaactatactttcatgaggggctggaaaaaaaacccttgtaaaaggcaacagtatggaaatacaggaacatgaattttgaaatgaaaagaataggctatgaagattctgtaaactctgggatataataagaggatttctgaattatggggctacaatctttgtcttgatagagggggcaattgaggcagaaggtgtgagcctgtcagtactctgagaatcacttaaaccatgatctggatggtatattttgtattgatatacaatatttgtacatacttatggatacatgtgatattttgatacatgcatgcaacgtgtaatgattaaatcagggtatttaggatatccagcacctctaacatttatcatttctttgtgttgggaacagctcaaatcttctgttctggctattttgaaatatacaatatattgttaactatagttaccttactgttctgtgaaacactagaacttatttcttctatctgtacatttgtacccattaaccaacctctctctgtcactacccccctgccaccgccttcaccccacactcttctcagcctctggtaagcatcattctactctctaccttcatgagatcaacttttttagctccacatatgagtgacaatatggtgtgaacacacaaaagtttaaaaactcactgattgagcagacacacaaatatcaaagagacaggaatcaaatgttaccactacagaaaaccaccaaatcacaataagcaatgagagaaggaaaggaatagatgatacataaaacaaccagaaaacaattaacaaaatgatagaagtaagacctcacctatcagtaaacttcaatctgtttacaaaacagattaatttccccacttaaacgatatagattggctgaatggatgaaaaaataataacatgaccaaactatatgcagcctaaagaaatttatttcacctgtaaagactcatatacactgaaagtgaaatgatggaaaaagatactccacacaaatgaaaactaaacactgacgggagtagctatacttagataaaacagactttaagtcaaaaacagtcaaaaaagacatagaaggtcattacataatgataaaggggtcaattgagcaagaggacttaacaattctaattacatatgcacctaacactggagcatccagatacataaagcaattattattagatataaagggagagacaggcttcaatacaataacagttggggactttaacaccccactctcagcattggacagatcatctagacagaaaatcaacaaagaaacattggatttaaactgcactttagaccaaatggacctaacagacttttatggaacattttattcaacagctgcagaatatacattcttctcatcagcacatgaaacattctctatgatagaccatatattaggccacaaaacaagtctcaacaaatttttaaaattcgaaatcatgtcaactatcttcttggcttgcaatggaataaaactggaaatcaataacgtgaactttacaaactgtacaaatacaaggaaaataaaagtgtgctcctgaatgaccattgagttgaagaagaaattaagaaggaaataaaaatagttcttgaaacaaatgaaaatggaaacacaacataccaaaacctatgagatacagcaaaagcagtgctaagatggaagtttgcagcaataaatacctacgtcaaaaaagtataaagatttcaaataaacaggccagtgacatcctctcaaggaactggatggtatagcttagccacacatgtttagtagtgctaacatctttagttgagttaattaaaaaggtgaatctataacaatgaattttgttggagggtattaaaaataggttttgtgaaagaaatgaagtttcacattgtgtttggaccaaatatgctaaaaaacaacttgatttccttcatacaaacattttagagggagagtcagtataaaaattaaaaacgtttgaaatttcacatcaagttcagtctttatggggtgaattacacaagattgctctgtttctaagtggacaaataaaattttctaaaataaacatgttttactacttaaatgatcatgctgctacaagccttgcaggaaaatgattatatttattagtcctctagtcaaactcctatctatgttcacatgaatttaagcatcctgcaaaatcttcttcctctgtgaatggataagagcaatttcagcacagaattttaaattctccaagtattcctgtctctgaaattagcctctctacccaaatttacaaggcttgttatcaaatatgaaaatataccagtctctcaaaatttaaaacctataatttttggttccacactagtattgtatgtagctcagtgttattccttaataaatatttgttgaatgaacaaactaattttgcaataatttgtcaaatgtgctctttcttaaaggatttccagtctcttgtgggattattacatcttttttccacttgagtttcacagaagtgtagtatacatgcactaaggtggcccctagaatatgtattttttcctgaaattatatgcaataaaacgtcctccattctacttgagcataatttgttatataccatattgaacgtctccacagatggttttgctgtcaaatccttgagtttaaatgattctgaatgtattgtagtcctgttggacatagagaggttgccttgcattaaatgcctcccagggatcaatataattattccagtgcccactgcactccttttgccccaagttgaatacactggagacttgcagtgtagaaagaacataagctgtaggctgggcgcggtgggtcacgcctgtaatcccagcactttgggaggccgaggcgggcagatcaagaggccaggagatcgagaccatcctggctaacacggtgaaaccccgtctctactaaaaatacaaaaaattagctgggcatggtggcacgcgcctgtagtccagctactcgggaggctgaggcaggagcatcgcttgaacccgggaggcagaatttgcagtgagctgagattgcaccactgcactccagcttgggcgacagggcgagactctgtctcaaaaaaaaagaacataagctgtagaatcagaggggttcttgtttcagctctgccatttcaatagataagtaagttgcttagctttgttgagtcttagtttcttccctagaagagtagaggaaataatgtctataggttcacagttctgaggtctgcattacatagtgcagctctagtgtgtaattcagtgcccagcacagtcagaactacaagaagttatttactctcctcttgaaaattccatatagttctgttacttcctaagtgcccatattcagataggccaagtagaaaaatcctggaatttggccaggcgcggtggctcacgcctgtaatcccagcactttgggaggctgaggtgggcggatcacaaggtcaggagtttgagaccagcctggccaatatggtgaaaccccgtctctactaaaaatacaaaaattagctgggtgtggtggtgcgtgcctgtagtcccagctactcgggaggctgaggcagaagaatccttgaacccgggaggcggaggttgcagggagctgagatggcgctactggactccagcctgagcaacagagtgagaccccatctcaaaaaaaaaaaaagagaaaaatcctggatctgtaggattgatggctaccttggagaacctactgctgtttccctcccccaaatattgttttattgaagcaatagaaaatatttctagcacagtgtgaaaacccatggttaacttgtgatttattttctttataacttcttatgcatttgtacattattttatgacagcataataacataagcatttactcctttttattaaaatcttcttaatggctgtatcgtaactctgtgtggtcataacatactttaattaaccattcttttattgttggacatttaggctctttcttgtgtcgggctattctaaataatgatacatcttgtacaggaagcttttttgattttttcatgttattttcttgataaaagttcccaaaattagaacttttgagctaaaatatatttttttattgtgataaaacgtacataacataaaatttaccattttaaacatttttaagtgtagagtctggtgacgctggtcattcacattgtgtggaaccggaaccaccattcatctccagaacttttcccccttttcaagctgaaactctgtttcataacaataattcctctttttatcctcccctcagccactggcagctagcattctactttccatctctaggaatttgactacactaggcaccttatgtagttgaaatcatacaatatttgtccttttgtgttgactcatgttactaaataaatgtcttcaggtttcatccatgttgtagcatatgtcagaatttccttcctttttaaggctcgtattctattttgtatgtatactaaattttgtttattcattcctccattgaaggatatttggattactttaccttttggctattgtaaataagtctgctgtgaacattggtgtacattatctcttcaagtctctgttttcacttcctttgagtacataccctgaagtggaattgctggatcatatggtaattctatgtttaattttttgaggaactgccattttgttttccactgcttccacaattgctaccagcaatgcacaaggattccagtttctctatgttctcaccaacagttattttctttctttctttttaaaaataatggttattctgtcaggtgtgaagtcgtgtctcttcatggttttgatttgcatttctctaaagattagtgatggttaagtatcttttcatgtacttattgtccatctgtttatcttttgggtatattctttgagtgttaaagatcttttcccattttttaatggacttgttttcttttgttaagttttaggagttatttatatattctggacattaatccccatcaaatataagatttacaaaaaatttcttccattccatggttgcctttccatcctgtggatggtgttctttgatacacaaaagtttctaactttgaaattcaatttattttttgttttattgcatgtacttttggtagtatatcaagaaatcacaccaattagaatggcgatcattaaaaagtcaggaaacaacaggtgctggagaggacgtggagaaataggaacacttttacactgttggtgggactgtaaactagttcaaccattgtggaagacagcgtggccattcctcaaggatctagaactagagataccatttgacccagccatcccattactgggcatatacccaaaggattataaatcatgctgctataaagacacatgcacacgtatgtttattgcagcactattcacaatagcaaagacttggaaccaacccaaatgcccatcaatgatagaatggattaagaaaatgtggcacatatacaccatagaatactatgcagccataaaaaaggatgcgttcatgtcctttatagggacatggatgaagctggaaaccatcattctcagcaaactattgcaaggacaaaaaaccaaacaccacatgttctcactcataggtgggaattgaacaatgagaacacatggacacagggtggggaacatcacacactggggcctgctggggggtggggggaggggggagggatagcattaggaggtatacctaatgtaaatgaggagttaacgggtgcagcacaccaacatggcacatgtatacatatgtaacaaacctgcacgttgtgcatgtgtaccctagaacttaaagtaaaaaaatttataattttttaaattaaaaaaaatcattaccaattccaatgtcatgaagcttttccctgctttgtagtaagttttgaaattagaaaatgtgagacctccaactttatttttcttttctggatgaacttttttaaagcctgcattttcaatacagacatgcatgcattcagtgtaggccaagcaaggtctaaataaccaagcaagtttctttctacctcctggaggcagaaccagtgaattttacatcttgatagatcaatgttctcttttccctgtgactttttaaaattaattattaaatttttaactgtttattttgaaataattttagtctgacaaaacagttgcaaaaatgatgcggagtaccttgtacccttcaacaagtttcccttaatattaatgctttacataatcacaattcaattatgcaatcaggaaactgacatttgtgcaaagacaaaactagagatcttattcaaattttgccaatttttccagcaacatgtttttctgtcctgagatctgatccagtattctgtattttctctctttattaacaaatatcttttttttttttttttttttgagacggagtctcgctctgtcgcccaggctggagtgcagtggcgggatctcagctcactgcaagctccacctcccgggttcacgccattctcctgcctcagcctcccaagtagctgggactacaggcgcccgccactacgcccggctaattttttgtatttttagtagagacagggtttcaccattttagccgggatggtctcgatctcctgacctcgtgatccgcccgcctcggcctcccaaagtgctgggattacaggcgtgagccaccgcgcccggcctttattaataaatatcttgagggagataactttgagacttacacaaatatcctatttctcctcaacttttgcccattaatcttagcatccattagtggatcttatcagcaataattattactgtggtgtttgcctaatggtgatactgtatttccctctttcctttgacattcattgactggaattcttttgaaatgaaaaactgttccttttcccccatttttttcttagaacatatttttgaagcctctgaatacattgagccaaatgtattcctgaaagatttctcccaagttatgcttctcagcaatagtatttaatatcatagtaaaatcgttttacccattcagtggtccaacatgtcaagaggctgtccctaattaccccatctaagttagactcctcttaactatgctattttctatggcagaaactgattaccataataggaaatatcaagactgggagaggggacggtaactttagagatgattaaggaatgcctcttgagaaagtaacatttttgctgagaaggagagaagtatgagaaggagccaagcagagagaaagtggagggaagagtgttccaggcatagggaacagcatgtgcaaagccccaagacggtgaaggcatttgccttagctcaagggagctaacatccctgaggaactcaaagatggccagaataaaacatagtgggtgaggcagcagtgcttgggagatgaagtttggttgtaagcagtggccacatcaggtaaaagtcttgaagactttgttaagatgaatggattttacgctggggacagtggaaagccactggagaggatttttcatgggttcttttaggattgcacattctgttatttactgtctatattagattcctatggctgacataaccaagtaccattaaataagaggcttaaaacaacagaaatgtgttctctcccagttctgaggctagcagtctgaaaccaaggtgttggcagggccatgcttcctctaagccactagaggaggatcctttcttgcctctttagcttctgatggcttgagacattctttggcttgtggtatcgtaattcactccctgcctccatcttcattcacatggctttcttctcgctgtgtgtctctgtgtctttacatagcagttattctttctgaatcgctctcctcttcctattaggacaccagtcatattggattaagggctcacctattccagtatgacatcttaactaatcaaatctaaaatgaccctatttccaaataaggtcacattctctgggggctaggatttcaatatatacttttcaggaacacagttaaacccgtaacactgcctctattgtgtgcatgtgtttttaatttcagcacacctacttatgtggtagttttctgtgcaaaatctttctcttttttttgagactgagtttcgctgtgtcacccaggctggagtgcagtgatgcaatctcagctcactgcaacctctgtctcctgggttcaagtgattctcctgcctcagcctcccgagtagctaggattacaggtgcatgccaccacgcccggctaatttttgtatttttagtagagatggggtttcaccatgttggccaggctggtctcgaactcctgacctcatgtgatccacccaccttggcctccagaagtgccgggattacaggcgtgggccaccgcgcccggccgcaaaatctttctttttttcaagttataaccttttaaagtagcttgtttttgttttgttttttgtttttgggatgaggtcttactctgtcacccaggttggagtgcagtggtgaaatcttgattcactgcaacctctgcctcccagggtcaagtgatcctcccacctcgccctcccacgtagtggggaccacaggtgtgtgccagcatgcctggctaattttttgtatttttagtagagacaaggttttatcatgtttcccagggtggtctcaaactcctgagctcaggcaatccatccacctcgtcctcccaaagcgctggaattatagacgtgagccaccatgcctggcaacctgttcttattttattaatttaataactttcttcattttactgaggatataaagtaaaattgtgttttcaatggatttttacagttgggggccatttgccttggtgtttaacttgattgccttcttttgagtttggatgtggatggttttcatatgtttgtgagatgtgtgtagtttcatgaattggctgtttgacatttttttattctttagttgctgaaaacactagaacctttcttattatcagtaggttcttaatatagataatatattaatgtttctctatcagattttctgcataaaacatcccaggttgttttgggtacttgaaatacttactttcataaaatatttgattgcaatattatgtattttagtttttttctttgaaatatatttcataaattttaataatagaagtttatcagtaagtcaaataaatgtttcccacatattttcttctagttatttatgggtaaattttctttacacttaaatacctttaatgcttattttcccctaattattaaaatgatgaattatttatttctaaatataaaacaaatggttaatgtctaagaaagttcagaaaagctcaaagagaaatcaattctccatacattcatgacccactagtaattgcttttaacttttttttaaagtttttaagctttttccatgcaaatattttaaccatattaatttaactctctgtgtaatatttggagaaccccagatttcttttcttgacactataatctaagcatattatagaacatactttgtgaatatcattttttttaaccaaatgtactatcatgtggacatttaatgaagagatcagagaactatgacccttgggccatatccagcctaccattgttttttgtaaataaagtttactggaacacagccacaatcatttgttaacatattgtgcatagttcattttgggataaaatagccagtttagaagttatgacagagagacactgtggccccaaaagccaaaaatatttactatccagttatttacagaaaaaggttgccaatccctgctcactatacttaactatttttttgagttttgtgctttgggtagtttaatttttttgttttaatatataacatgatgatgaaattttatcaattatatttgttacttatcttgagttttcttaggccagaactttgagtacctttaataaagtcattcatttatttatttcttcttttattcaacaaaaacatactgaatagctatctcataactagcactgtgtttgtttctaaaatacgcttgtaaataagatacacagagttcttttagggagtttacaatttggcagggaaaacaaatatatttaaatgtgttgagcatttgatgaacatttcgtacagagtttatctagtgagattatcacacaacagaaaatcctgacttaaaagaaggaggtcaagtaaaacctctcgaaaaaagtggtgatgcctgaagaatgaaacttggccagcaggttgaagagaggcagtggcaacgggcacggagtctcctggagaaggatcagagtatttgaagatccaaagagaaagagattcctagaaataccaggaccttgaaattgtacaattctggctgaagttgcatgagtgaggaaaagagctggagcggttgaaggaccaggctttacagattttaaagtatggtaaatattttgaattctaatgatataagaaactattgaagcagattttatcactactttggctaggaaatagggaatttttttgaggacaaagagttgctgcagagatttcagttaggagtttaggccagagaagatggagcttaaggtgttgatggtggagaagagagaagaggacatatttgacagatattttggaggttgagctggcgagatttcgtgatactagtggtgggagttgaaaatagggaggaagcaaggatgaccccaggcttatgaaactgggttagtgtcattcactgagtgagggagcactagaagaagagcagtttgtttagagtgggatgggaataatgatgttgagtttgagatggctgaaagaagtataaatggaaatgtcaaataaggggtgaactagatcagctcaagcctgagggcacataactcaggggagaatacagttggatatacatattcaaacgtcttttgcccacagatgattatagaggttatgggagttacctgagcagagagtatggagttaggtgacatgatggccaaggtaaaggcccaatgaataccaccatttagttatttatttatgtttttgtcaaatgaagaaggtagagctggaaaaggtagattgacagagatggaggaggggcagcagataagaacagtatcacaaatcaaaggcatgagaactgtaaaagggagcagtggtcaactgtaacaaatgctgctggaaagtcaggtatacaaaatcctggacagatgtttattggtttaattgaaatgaatgaatggtttttgttgatatgtaggaagtcagttcagtagatgttatgatgtagaaataatctggagacaggttaagtgggaggtgaagataaagaacagcaagtatagatgatttattcaagaagtttgtaatggaagaaaaataaaatagaagctcaagggggagatgggaataaggaaggtgtattatttgtttgtctgatttttaagaaagaagtttaatcttctacatatttcaaaatttcttctcaaacattattactaatattatgaagaataacaccatctacatatgaaagtgcttgcctcacttagggttgactagactggaacattatcatttttagtagaatttaagctctgctagggcaaggatctttttttctctttcattctttgttttatacccagcacctagaatggtgcttggcacatagtacatgcccaataaatacctgtggaatgaacgagtgaataatacatctctgttaatatgaagtatagaagtgctatctcagtattgctttagcgtacaagtctttgttaactagtaatctcatgtatagagatccctatcaaactgaattcctcagtggcaagagctatgatttgtttatccatggatccccataaagttgtatagagtttagcacttaggctgtcaaacatagttgtgccagataactatttttttgccttacatatggagagaaggatgagatttcaaataacttaacctagagtccaagggaaattggccatagagcctgctttcagctctcaattaagctctggtttagttaaaccaaaaggaaatatttttccctttaaaaataattctatatggagaatcaaatctggtggctctcacttgactataaccatttcattctctgcattgtgaggtgtttctagtactatggaattgctactggtgatggaaagaatgctctctctatatataaatgtccttaaaatgctatcctcacagaattttataaaacaacacaagaagagggtaacagtgttaagaatataaaaaatgaagtttggtacagtattatatcatggaggactagctcaggaaggaaaggggtaaagttctgcatgactgtaaaatacccaagccagtcatgttactcatattgataaactactgtcccagctgcatttttcagattaacaaaaatcaagctacaaaccattaaagaaatataagagacatttcttactggtttcatgtaggggcattcaatttacggtgcagtacctatcacttcaggaaagaaacattgctttagaaaagaaagatatttctaacatttttggactaaatggtcaagtctctaagtctgtaaatttcactagataaaaaaattgtatgtgctgggcaaaatattattgagcatccattttccttttcttctttacacaaaaaatttactgttatagctcattgaaggctcaatgcgaaatgaacaacctctttgcaatcctgtcacccaagtcttgtaaacaatcagctctttccacacacataatcataagcacagactataattgggatatttatttatttatagcttatttgtgttctgtgtttatttgtggctgtgcctctgcaggtagagtgaagtggattgttcaaaattcagttaatggtggtgagctgggtatacaaaggctgaaacgctgcatatttctttttttattagatttttgtctcattctattcaccatgcttcaggaaagttattaataactcaatcttcacaacttataaagtggttactgatttgggtatgaactgattaaaatttagctataaatcatccatttaattgtagtttctcagtttaggaggagaatttcatgattattttgttaatttcagcattggattaatcttgcaaaatagactatgcttcgatgcctccaataatggaaatctcattacctcacaggaaagccccttccagctcttgacaagtctcagtatttgaaagtttctccttacagtgacacccaaatcacttttcctgagcttacattctgtgattattgttccaactgttgaagttataccaaaacttactcttccgtatgacaaactcttatataattaaagacacataatataattcacctaagtattttttttcaggacaagcatctacaacatcttgttatttcttaattgacttgagttcaagatgcttccgtatcttggacacttaccaatctttttcttaaaatgtggagttctgctgttacctctcatgttttagatacactgttaatttagcccaatattacatttgtctctgataatcacatcaatttattgacccatattgaatgcactgacaactaaactttgtcatataactcttgtcactactaagccatgccactcccattgtgtacctatctaatttgtttactggctatgataacagaaacttatatttaaccttatttacttttaatttgtaagaccccagtcgtttctgcattcttttaatagacgttttcatccttttctctcatatagtctacttatctctgtcagctccctgtcacctgcaggtttgatatgcagaactgtatatcttcatccagttcattgattgatatgttaaacctcagcattcccgctaggtgggcatcatttcattaatcaggctctttggataaggtcattctatcaatttcaaacctataaataccacattgtagttaagagtttgggttgaaaagagatcctagacatggttctcaaatctattatgtaaaagatacaatattttaattacccttgataaattatgcaattgtctacattatgggttttttccccctttaaaaggagataacatatctacttctgagagtctgggatacactttaaatgggataatgtgtataaattgcttagcataatacctgacacatagtaagtagttgtattagtcagggttctccagagagacagaaccaagaggatatatgtaaaaactgctttatatggctgggtgcaatggctcacacctgtaatcccagcactttggaaggccaaggcgggcggatcacctgaggtcaggagtttgagaccagcctggccaaaatgggaaaaccccatctttactaaaagtacaaaaattagcctggtgtggtggtgggtgcctgtaatcccagctactcaggaggctgaggcagaaaaatcacttgaacccgggaggtggagttgcagtgagccgagatcacgccactgtcctccagcctgggcaacaagagcaagactctatctcaaaaaaacaaaacaaagctgctatatatatatatacataaagggagtttattagagagaattggcttacacaattggctcacacaattacaaggcaaagtcccatcataagtcatctgcaagccggagaaatagagaagccagtagtgtggctcagtccaagtccaaaagcctcaaaaccagggaagctgacaatgcaagcatcagtctgaggctgaaggcccgagagcttctgggagtctgctggtgcaaatcctacagttcaaaaggccaaggaacctggagtctgatgtcgaagaccaggaagagaggaagccaagtgtccagcatggcaagggaagagtgagagtgggaagactcagcagcaagctgcttatctcccttcttctacctgctttgttccagccttgctggcagccagttggatggtgcccaccaattggtgggtctttcttcctagaacactgactcaaaagccaatctcacctggcagtaccctcgcagacacacccaggaacaacgcttcttcagccacctgggcatccctcaatccagtcaagttgacacctaatgttaaccatcacagtggtctattattactgactatctttatcattgtgttagtttgggaaatactagctgtaataacaaataacccaaatatttcagtgctatataacaacaattcattgtgggctgtcctggttggcagatggctttcttccatgttgtgattcagtggtgaggctctttttatttggtagctctgccaccccttagggcctcagtgtcttctttatctaggcagaagaaaataaaaaagaaggtttataactaacaccacctagaagtgaaataaatcacttcaactcacattccaatgaggagcactaatcacatggcctcacctagcttcaaaaaaggcaccaaaaaatgtggcccctgactgggcagccagttcccagtgttaacagttggtgagagcacacatttatggtagacagtgtatcgctgctgtgatcaccatcaccatcatcatcatcatcatcgtcatcatcatcatcattaatattccctcattaagccacatgcagctcatgttcctctatcttgtccagtaagattttgtaaacaacgatgtaaaagaactacctgacatctttttttttttttattatactttaagttttagggtacatgtgcacattgtgcaggttagttacatatgtatacatgtgccatgctggtgcgctgcacccactaactcgtcatctagcattaggtatatctcccaatcctatccctcccccctccccccaccccacaacagtccccagagtgtgatattccccttcctgtgtccatgtgatctcattgttcaattcccacctatgagtgagaatatgcggtgtctggttttttgttcttgtgatagtttactgagaatgatgatttccaatttcacccatgtccctacaaaggacatgaactcatcattttttatggctgcatagtattccatggtgtaatgtgccacattttcttaatccagtctatcattgttggacatttgggttggttccaagtctttgctatcgtgaataatgccgcaataaacatatgtgtgcatgtgtctttatagcagcatgatttatagtcctttgggtatatacccagtaatgggatggctgggtcaaatggtatttccagttctagatccctgaggaatcgccacactgacttccacaatggttgaactagtttacattcccaccaacagtgtaaaagtgttcctatttctccacatcctctccagcacctgttgtttcctgactttttaatgattgccattctaactggtgtaaaatggtatctcattgtggttttgatttgcatttctctgatggccagtgatgatgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattctgtaggttgcctgttcactctgatggtagtttcttttgctatgcagaagctctttagtttaattagatcccatttgtcaattttgtcttctgttgccattgcttttggtgttttagacatgaagtccttgcccatgcctatgtcctgaatggtaatgcctaggttttcttctagggtttttatggttttaggtctaacgtttaagtccttaatccatcttgaattgatttttgtataaggtgtaaggaagggatccagtttcagctttctacatatggctagccagttttcccagcaccatttattaaatagggaatcccttccccattgcttgtttttgtcaggtttgttaaagatcagatagttgtagatatgtggcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaaggcattggtagcttgatggggatggccttgaatctgtaaattaccttgggcagtatggccattttcatgatattgattcttcctacccatgagcatggaatgttcttccatttgtttgtatcctcttttacttccttgagcagtggtttgtagttctccttgaagaggtcctttgcattccttgtaagttggattcctaggtattttattctcttggaagcaattgtgaatgggagttcactcatgatttggctctctgtttgtctgttgttggtgtataagaatgcttgtgatttttgtaccttgattttgtatcctgagactttgctgaagttgattatcagcttatggagattttgggctgagacaatgggtttttctagatatacaatcatgtcatctgcaaacagggacaatttgacttcctcttttcctaatggaataccctttatttccttctcctgcctaattgccctggccagaacttccaacactatgttgaataggagtggtgagagagggcatccctgtcttgtgcacagagccaaagacaaaaaccacatgattatctcaatagatgcagaaaaagcctttgacaaaattcaacaacgcttcatgctaaaaactctcaataaattaggtattgatgggacgtatttcaaaataataagagctatctgtgacaaacccacagccaatatcatactgaaagaactacctgacatcttatcatgtctctctacatacttaaaggttttcagccattgtagaattgttatgaaagctcaggaaaaaaagcctagtggataattcagacatatatcccctgccatatctagagttaacctgaatttcagcaagtggatgcaggtacctcatagcttagttgtactgattggcaaaagtgtgatgagtcggtcagtagcacctccatcttgtatgcagaaataacttcatttgatgtgtagttaaacaaaaaacgcttttaatccaaactgttactttaaaataactttctacatctattagttgccttctctatcttagtacatacctttacttgattttttcatatttaaggataataaaataatccaatgaacatcattataatcatttataagcagcaattgttttgtttttctttcacacatgcatacagaggcatatatgtaaaatcattttggatttagaaaatttagaaatttataaagaaaaaattgccaataatcctcagctagggataattacagtaaaaattttggtgtatttctaatattttccattcatataggataattattatctaatgactatatttagtaaggatataaaaatgccattgtttatttagacattccctattattgtatgtatgtcaatatagttgttgcatgtgtgagagtacactgtggtgtgatcttagtaaatgcattgctctcttaattttggatacttactttgcatagctgttaattgagaatacttacatttttaggtgacatgaagctgggtgtgattaattataaagtgctttataaagtaccttagctatactaaaggtatgtgcttaacatgtttttgcctggttcctgcacaattatcactatattgtttgatgtaaacattaactggacaatcttagagagtgctgtgctgtggccttcattaagggggctgggaaaacttattttagagaccagtagcaagcctagagatcacacagaatgattttgtgcaagtgaaagtgggttttaaaaataggatcaaaggcaagctgcataaggaataaggtctcaaaggattaatatgcaactgagtagcctagtgtgctgaaagaagaggtgggaaagggggcgggactgcatgttcggcctgggtgtatcacataaaacagtgagggagttgatagctaatagcccatttgatagaatccctcttttctacgtattcattgattgactacttccctcacatttcacacgcagcaagaccttcccaagccaaggcctaaaatccacatccctgcagtaggtagaattctaaacatgtcccccagcattcctgtcccctggttcttcaaccaaacaccaatctagatactgctgggaagggactttgcagatggaattcaggttactaatcagctgaccttaaagcagagaaactggcccgggtgcagtggcttccacctgtaatcccagcactttgggaggctgaggcgggcggatcacttgaggtcaggagtttgagaacagcctggctaacatggcgaaatcccgtctctactaaaaatacaaaaattagcccagtgtggtggcaggtgcctgtaatcccagctacttgggaagctgaggcaggagaatgacttgaacctgggagatggaggctgcaagagcaaagatcatgccattgcactccagactgggtgacagaatgggactccatttcaaaaataaagtaaaataaaaaagtagagaaattagcctggattgtttggatgagcccactgtgatcacataagccctgaaatgcagcagaaaaaggcagaagagttagggagatgcagcaggagatatggggcagatggggaggggagcccagggagattcaaagcatgaaagggagttggctcatcatgacgtgccttgaagatggtagaaggggaccaagcaggcagcctctagaagcagagaaaaaccccagcttacagcttaccaggaaatggggacctcagtcctacagctgcatgggactgaattctgtcaacaaccagaatgtcttgaaagcgatcctttcctagagcctccagaaaggaactcagctctgcttataccctgtttcactttgtggcttttctggttttctgttcctggttttataatttacctcattttctgactacacaactgtgagctagaaaatgcatgttgttttaagccatttaatttgtggtaatttgttccaggaacaatagaaaactaatgcaatctcaaacatatgtaagcataacttcctatgccaagtactcgtacctttttgcttgtacgcctccctctgcctagatggtgcttttcttattccttaaggtaagccctactcagtctttgaaataaccatgtcacctctttcaggaagcttccctcaatagggttgagtgtaatttaggtgctcttactctgcactgcaatagaaacctgtttacagctcaatctttgaatttatatacaggtaatcattgatttatttgtctgtattccccttcagccttaaatgccttttgataagagctgacatcttttcttactttgcattatcagtgacttttctagtatctagtcctggtagtaatacaaagcatgattgctgaaacaatggttgaaggaacaatggtttctaagctgaggtcataagctgaatcaaaatgttccatcacgaaaattagataaagattttttcctatttatagaaaaaatacagtgataaaaattcccaatttcaaacctttgtcctctaagttatatttcagattttgccacctgttgttgcatatcttctaagaagagctagtctataaaaagcagaacagaaaagtgagttattaaaaataacaaaacaaagcaaaaatcgttaggaaaagacattggtgcttaaaaaaagcctttgtttttctcatgaactcctatttatggttgtgaatttatattgtatacatattatttagccatgttttactagttggtaaaattattcctagttttcatgatacaaatattccagtatttcaccatgtgcaatgaatagcactgacttagtggtgctctattctctgaatcaagtagatggtctttgctctatcatggatttggggtctttttacttctttttaacatgatgctcaagaaaatatggtctggttaatgctgaagatgaaacagtttatatagttctgctcattttcagacctaaaagacatacacacacacacacacacacacacacacacacacacacacacacacgtgctcctactttcttatagtgttattattagtgccttttctcacatgcattctaccacccattctaacccaaagcagcacttttaaaacatgtaatcagaatgttctgtagcaatttgtgacagaaaataataacatatccaatagaaattcctaaaggtgtttcagcaggtggaatgcagaatgatcagcaaatgatttggctagaacctctgccaaaacctccacttttgtgaaaagggccattgggagtcctgataatgagatgtggttaggattttgacatctgctcttaaagatattactggaagcccttccaggaccaatactgacagctcaggaactccttttgacttgcctttccaaggaatcttatgcctcaaagaaagtaatcagaagatttgtttcctccagaaagccagggttggcaaaccgagcaagactggtctagggaggcagatatccttcattctacaacttgtttgtttaattgatagccaactttgcaaattctctctgagctgttaaatgcacatggaaagatgcagagagggcagcatacatgtgtgaattactgccaaacatctccatatgttgtgtcacacgtaaccagttttcctatggaaagggataggtgaaaatgagaatgatttactctcacaatagcctatttttgcaaggagcatatgtttaaaaaatctagcaatagtcataactctgctcagtttcatgtaactttgagttaccacatggtatatcctggaagactaattttactgtgtctaatattaggactaccttagcactcttcactttataatgatcctgtgaaagaaaaaaaggaataaaagttaataatttatacataaaaatttagaccataatggcactaaaaaagcaaaatggattttgtctccattgtcccaaagcatcgttgtcctgtgcatgtgttcttggtgctttggaagcacattaacatttaaattcttgagagtttacacggtagtgattccctgaagcagttaccctacctttaagcaggcctaccctattccttgggagtcatttcaacagtgggagaacctgggagtatgtataaaataatcttatgttaaaccagcagtaattttatatttagccatccttacttaattctcaaggcagacaagttttctactacgtattagtttcttgcacagatggactctcactagggaggcttcttataactatttaatatatatgtgctttttcattatatccagacttatatttgcttatttatttcctccatatcagtctaatccagatggacaaatgtaaatgggaaaaaaatcaaggtcatcatgatctttaatattttcatctgttttttgatctatatgcttatcaaaacaaaattcttatttctctatttttaaaaaatatactattttatattattccctgtaagcatagctctgactgtatagttcttcatattatgccttttagaacttgtgctgttagcctgatattcacttgttaatttaatcacttatcaaatgtttgaaagtccctgggacaacagctatatatttttaatgcttagcactcagtaatgtttttgcattaatactatgtgctaaggaaattcagattgaataagatgggatctctaacctggaggaatttcacagtctaatggagacaatggatatgttgcatttgtgctgggtcttgagttataaatgggattaaatcaaggaagcagccacttctcaggcaaagcaccatgtcctaatgtttcagtcatctcctgaaataacccttttggccaccagtatttgtttttttagatggctgcttcaggtaaggggtacagtacacactctgtaatatctcttaggatattagagaccctctgtaatatcctaagtgactcatatggagctgccaccaatgatttacttaccattgatctatctattcactacctctaaggaagaatggatacagcagactttctatttcaagagcatttgatgaaataacagcttttttcaggtggctctgagaatggattaagagaatccaacctggtatttgtaagatgtacctagagcctcttctaggacacatttgaaagggggatataaaatacaataaaatagttgtagataaccttaatgaggcagaaaggcataaacacaagacttaaagatcacattaaataagctggccagtgtgagctacttacatgtccatatctattatctattgctgatttggggttctcttttaggcctgcaaatctgttttctctttcaatgactttgatcatcttctatctgaacatccaataagtgatttcagctttgcctttctgcttatcttttgcagctaatcctgatccatttttccttattgtttttctggtaccaattttagtcttgctacatcttattgcttaactgtttcaaggggcccataacttgataatgagacaggatctgagagtattggaagattattgtggtttctagagtaagtcagccctaactatgccattcctgggggccagagagcaaaggaggttcttgtcaggtaccagttatatcttatctcttgtcttcagaggtcagtggatagatagagataatcaacgcactttagtaacaagcttccttgctcctactgctctgttttttgtatataatatctcccacctgctgtccattttgctcaaatgtcatcttctcaataaatttagccttaccaccccaagtacaattgcaaccatccccctcctctgctcccacctcccacagcactcccatttgtcttagcaggcttaattctttttcttttttttcatgtcatttgttgccttgtaacatattatggaacttatttattgtgtttactgtttaagtattttcttcccactagaatgtaaactctgtaattttcgtttgtttttattgatgtagccccagtctagaaaagtgctttagcatgtaacaaattaattttttattggtacataatagatgtacatattttcagggtacacatgataattggatacattcatataatgtgtaaagatcaaatcagggtaattgggatatataccaccttaaatatttatcttttctttatgctaggaatatttgaattattctcttctagctattttgaaatgtacactagattattattaactatagtcaccctattgatctgtcaaacaatatgtcttatttcttttaactatatgtttaatttttaatacttattaaatatatgaatgaataactccaatatccacatcattgccatcattcagaatagacttattttgcattcttaattcttatttcaactatatatgtttgctaagaatctttcttttaatccagtgttactgcagaaaatgatatttctctcttcagtatgaaaggattagctatcacagtgaaaaagaatataaagatatgtgagaatggctttgagaagctagagatgctaaaagaatgttagatttgcttctatacaatagtaccctccaggcaataaaagtatttaccttaggctcatgttatcatgagtatgaattttattaacttacttgttatgtgcaaaaggagatgacagcatgctacatctgaaagaaaaaataaacttttgccttgtgtctcctccagaacaaaacaaaaacctcagtaacctgcagaacttaaagatcgtttacgtaaaagggaagtaaaaaggttcagaagccttaaacaggcaaagtgaagcaagcaatatattgccattcctcagtacttaaggagagaacttagaagtcctgtaaaatcaacttttctgcatcactccaaggagatatagtagtgattatagaaaaaaatagttttataaatacaaatacatagtttaagtcatttcttctaaagtcttggaaattatatgctagatgagatggctgaaaattatatgaaattgtggagttacctgtttttacatgaccagtaaccaagcatgattttttgacagaaggttcacaggcctatgccaaaatatgattaaattgctcaattaagtaagaagagatgacaaactagaacagctgtaggccaaggattggtccacatgaactgtgcgcacagtatggattcagagtatggaagtgtccatctagggaaagtaataatgaaaatggtcactgaaagaatggccatttttgttctgccacttttgtaatagcctaatattttttagtagcactcaaaatgctaaggttttgggaaaggcaactttggatttggagagtggttaattttacacgaaataatcttgtttgttgaatttcttatgctattaagccacatagctataaagcaaaaataaattttagtatattgtctcttcaagctatgcttctcaatgaagggtgtatagcaaatcatctgtagaaatttagaaaaaatacagagttctgggttctacttcatagaacccaaatgccctggggtgaggctcggcaactgtgtgccaggagcattgctcaggtgattctgatgcctgttgctgacttgtagttgctacagaaagagaacccacttaacttcaggtctagacaaatggaaaatgtggagaagaaaatagaggataagtaactgtgtcagttaaacacacttctgagatttacagctccttattcacaattctgaaatcttgaaaacgttgaaagccaaaaaagaaaaaaataaggcttcatgaaacctgcccagccctcatccagtttctggcacaaccatatctgaactgacatgaggcttttcatgatctgtatttatcccaacaagtgtgaagagatatgtgttttgttaccgaagcatgaatgtatttcttatggaagttttacttgataaactgtatatgtgcactctctctctatatatagagagagatacatacatacatatatatataaagtatatatgtaatatatatactagtaatatatatactatatatagtagtctatgctaatatatattatatatatatattagtctattctcacactgctaataaagacatacctgagactgggtaatttataaagaaagaggtttaattaactcacaactcagcgtgactagggaggcctcaggaaacttacaatcatggtggaaggggaagcaaacacatccttcttcacgtgatggcaggaagaagaagaatgagtgcccagcagagggggaagcctcttataaaatccatcagatctcttgagaattaactcactatcacgagagcaggatgggagaaaccactcctatgattcaattatctctaactggtccctcccatggcatgtagggattataggaactacaattcaagataaaatttgggtagggtcacagccaaaccatgtctatctatctatctgtctgtctgtctgtctgtctgtctgtctatctatgtatcaatcatttatctatctataaactatatacatatagctgtatatataccattttctcttctagaatctaaagaattttagatcttaaagggtatctggtctcaataagttttgaataagacatggtagagttgtagtaatggcttcagttgacattttgttctgtcctactcagatgatttgaatatattttactgattctaaattttttgagggcagaaactctgtatgctcaccttatataataatgaccatacatattgggtcatttaaaatagtacctcatccaggtctcacaacaatcatgtcacgaatgcagggctcactgttccaaggatgcgagtcaatgagctatcacaatgcttagtggaggggcacagaattaataatccatgagtatttagtaaactgaatattgttttaaattgaattgaactactacatttttttctataagtaatagaatacattcaatgtgtgctggtcaaaaaaaccttaaatgggaaaatatttaataaatacttttataaaatatatagacattttgtaaatcctatgagcaaatgtaaaaggtcaagggatacaaattttattgatgtatgtaagaccagagtcagctttaagcattaaatttaatgtataagggtaggattggtactaatcacacttattttgataaacacttatttttataagcttccctctagtgatatatactcaatcttagaggagtataccagtaatgtgggaagtgggtttgggataaagggtgcagggtggtcaaatgtcaccctcactccttctccatcagtgaggtcttcagcagctgagccagtggtccactcccagaacccgaggtcctctgcacgtgaggcttagacatgtgattcctgttctgattgcactgcctttcaggacctactggatgcttactgtttttggtgttttcataaggagattaccattttccaaatgctagtataagcgaagggagaagaccaaataaaatggactaatttggctgcagtgctaaattgttctgtgcaaatcatgaaacttctctgtgcctgcttcaccatttgtgaaataaagattgtcaaactggggtgacactgaatggtgatgagtacaaatgaactgaagtttccaagagtcctttgaaagttattgtatatttaatataggtgaagtattggttgaatgcactgaataaataaaatgtttttacaaaaaatctgaaaatataaaataattagtttgaaaaaatattacttcattaaatattgttaacattagtgaaatacacacagaatccatttgctaagagcttggactttgggatcaggcatgattgtatttaatctgcatcctggctctgctgtactgtgacactgaaccagctatcaagcctctccaagctgtctggttatattttcctgttctataaaattgggaacatagtaatgcctggatcatggaaaaatatgttaattagttgtcaataaatatattgtaggtcctaaaaggtacaaagtgaaaacttggttagcctttcccttcttcagagaaataaaggtagaattgaggtatgtgttgggaggggagacacttctcaagtataaccagacttagaatctgtagggtttatttggctgtgcacctttgaaaatcattaaatatctgtattctttctataattaattatttctggactttaagaatatctttctaggactaatgatgaaaacttgaattctctgttaaaacatcttgtgttctacagtgctaaaatgagggtgagagaaagagtatggacaaattgaactgttcctaagaatacagtggacaagataaccaggaaaaagcaacagcaacaatttcccaatacaaaacactttggctatataattttttaaaataaaacagacggataagtaaaacagcaatcttttcaaaaccatggtcttttgtacaaaagtaaaggatatctttagagaccaaaaataaagtgtgactcaaacccagacaggtaatgagtaggactgtgactggcttgagggcatctgccaatgctaatgacttagagcacttgttttttcactcatgtgaaacaaaacccaagggctcagacaaagcctgttgtcaaatcagaagcaactgatataaggccaggaaccttgaatagctacactctcactgaaaaagcaaaaaactaccttaaataaaaaaggtgctttggaaacttggttgtcttgtcagagatcctagagagaggaaaacataaagtatcccctgagaattcataatattctgttcctcaagtgagttgatggcccaaagtctcactacctgtaggcttaaaaaactccacataaaaatttattttggagagatcccaggttggaagtttccttagtcccttcacagaacgaagcaaaaattctctctgagggaacacactaacaaatcagtccttaaaatatctccacaaataaattactgataaacatgactgcataatcaaaaattacaaaacacagaaacaagtgtcatgagaaacagcagtaaatacaactagcagaatcagacccacaaagattttaattattagaattatctatatagaacataaagtaatatatgcaaataaataaagaggaaattgaaaatatgggtgaggaatgaaagactgaaccatttgaaaatgacccaaacagcacttttaggaatacaaattttaaatgattgaaatgaaaagttcagttgtgggttaaagagcatgtcagaaaaagatagagaatatgtttaatatgtttttaaatgtaagcaaacatttatcatattaaacagctaccatagtgatttctttcggaaaaagcttaagcaagtgttaataaaagtcaaatggaactgaaattctggaaaaatttccataatatttgggaaggagggttaaataatcacaaatttttcaaattggtggcagtagaatggtgatattgattagttccgttttgctaatttaagtatgcagagtgaaatttttaggacaacttcctagtgaatagaaatccaaaccaatatagaagaaaggaagaaatgaaatgaaaataaaatctcagggctgggtgtggtataatcccagcacttaatccacttaatcccagcctgtaatcccagcattttgggaggctgaggcaggcagattgcttgagctcaggagttcgagaacagcctgggcaacatgaggaaaccctgtctctacaaaagatacaaatattattcgggcatggtggcatggcacacacctgtagtcccagctacttgggaggctgaggcaggagggtcacttgagcccaggaggccgaggttgcagtgagcccggattgagccactgcatccagcctgggtgacagaggaagaccctgtcaaaaataaaatctcaattaatctgaaagaaagcacaaagaaaagtttgagcacaggagcatataaaatgaagtggtagaaaaaattatgttagtaagcacaattaatgtaatttttctgttaaagagcaaagattagcaggctagcttaaaacatttccatctatatgctgtgcattagttttctactgctgcataacaagttaccataaacttaacagcattaaacaagacacatttgatagctcactcttctgtaggtcaagtctatgtgggctccactgggttctctacttaggttctcataaatctgaaatcaattattggccagacttggctctttcctggaggagccaggaaaaacctgattcccagctcattcagcttgttggcagaattcagttccttttgcttgtagggctgaggtccctgtttcctttctggaaatggccctggccaccttaggtcttttcaaattgtctattccatgtcagcaaaggagagcatccctgcattgaatccctctctagcttccaatatcgctgacttctactgctttttaaaggactcatatgagtaaattagtaccacccaataatctttcttttgctgctcatcatagtcacaggttccacccagaactaaaggaaagaggattacacaagagcaagagccataggaggtcattctcggaattccatctcacatatactgttctcagagtcatgtttaaaacgtaaagtaataatgcctggaaaacatataccaggaaaatacaacctaaaacaaagttgatatagttatattgctgtctagcaaaatagacttttgacaggaaacaaagcatttttaggattaaagaaagatactacctaatgaacatgtaacaattttaaacttgtatgtaccatataacatactttcaaaatttataaagaataaattaggctggatatggtagctcatgcctgtaatctcaactaccagggaggccaaggcagaaggatcacttgaggccaggagtttgagaccagcatgtgcaacatagcaagaccctgtctctaaaataaataaataaataaataaataaataaataaataaataaataaataactgggcatggtgacacatactttgtagtccaagctacttggaaggcttaggcagaaggattgcttgagcccaggaattcgaggctgcagtgagctatgatttgtgccactgcactccagcctgggcaacagagcaaaactatgcctctttaaaagaaaaaataaaagaaagaataagttgacagaatatgctaattgttaaatccaccatcatagtgcttatggtggaaaagaaaaagcactgaagatgtaagcattaagcattaagaatttagaaaaacaaaagaacaggtaaatcagtcaaaaatatattaggaagcaaataaagatatgagcagaattaataaaaataaaggtactatatagaggatcgaaatatacaaaatttgttatctgaaaggctaataaaactaacaaatataagattaatccagattaaaagagtacaaataaaccatgtgaaaaaaataaactatcaacagatgcagcagagatcaaagatgtaaccatatgcttcaatacagaaaaatatcagaaaagtaaaatgaaaatatcttggatatgtaattacatcggatatattaacaaaacaacagaaaatgaaacggtttgactaaaacacttttacttgatgtaatcttaaaaatatgtcctaaagctgatatttcacttatatcttaaataaaaatatttggctttatttttagacactgaatgctaagtaggatttctttttacaaaggtacacatttaggtcgttgcttttaaatttctaagttttctattatgaatatcactgaaacactcattccataacattataattatatctgctttcaagcaacaataaaatatagaagcagtgcttactcaaacttacaaaccatgttactggctagttcccttacttcttaatctttcaaattctgaaaatggttatggttatgtcagatggttgagttaccagtcttttcttggacttgccatttcctaacgttagaaacaaacatcaagcctatagttatcttccgcacattagcctacagatttgggtttgtcacccaatagagctggctgaaccattttgataagtggtattatgcaaacaaaatggcaggctacctagtggtgcaggacctgggagactgagctaactcttttggctccatcattagggatagcatgtagtaggcatttcatttagaaaactggaatgctgaggatctttaagatgagatttattttccctttgagaaaatatttgcttttttgtgtgttccaagggctcctttgtggataatattttttatgatcacatttctgaacacatcctttatttttctttctattagctctccatccctgtatacattttcagagccgttatattatggtatatcgtacataattactttctctagtaatgatcagttatccatgttaacaaagcagagacggtatgcatcctgaaagctactcattctttcaggcaaaaataaatgctcaatcatataatattgggctaatatagtttgataatttagccacccataaggaatggcatgctagaagatggtgtaaatatttttttttctgctggcttcttgctcagcaaaaccagtgatcattctcattttttccatttattctaaattacaattcaatgtggtggaaagcaaatcgtactggggcacatcatatttatttgtatttgttaacacactttttgaaactctgcagaacttgcctggaaaggtactttttgattgtgtatatttctgtattcagatgattcaggtgtctttctctaaatgcttctttattctgagacatgcccaatttccttacttaataataaaacagtccatcactcattgtaaatcagtagggatccagcaataaggtgcaatacatcacaaaagcagggcaggctatcattgagataataagaagatgcattaatattcatgcattatgaaaccctggttgtgcctctaaaaagctgtagaatacattccaggtttaatgttcaccagtaggtgtttgccagtgattttaagatacttcttgtggcaatttattcaaggcatcactaggtgatttaggaaactttcatctgcagtttccattcacttaactgtatactcaggtaatgttcctcagtgagtatgcataatcctttctggttagcctttgggttgttctttatctcagttggaagtgatattgtgtaagacggatcatatatgtatgtctgtgtatgtgatgtgctgtgtatggttagaataggaagggcagcagaagggtggtaaaactacatacatacatcctatatagtacagtatttacatagtgtcaaagacatgaaatttagattttgtttccatctcagagtaatttaagcgcgtgcataagaaaataatgctatgctacagtggatgcaaaattaccaacaaagcagggccaccacagaggatgcttgtattgcctattccataagaaaagttggacctcaaataataaatgagaaaaattaaccagaaactctttacctgtcatgatgatgttgggtttattactgttgttaacattctgtgtacataggatggacacacacccaaaattcattcagatgttgggaccagtgatgtctgacttaccccaagagggtataaaaagatttatttcataagtagtgaggctttctggggagagcatggaggctcccaggcaaatctgaaaataacttgagccagggccaagaaaggaacctggtttggaatttttatggtgtacttggagtgaaaccagggtgagggtttccatacatggtttaaacttcctgctggtaccaaaggaaggggcaccatagttttcttatcagttttctcaagtgtcaggcagaaagggaagaaggaggggtgaggcttaaacgttgtaagcaatcaaacataaaaaaaatggagtcatttttcatactacagttatgatgatgttgggagaaactttgggaaatatgactgtagtgtatttgggactttatatcaatatgcttagaagcagagaagtaaaatgaacaacttgaagaaatactggagccctgttgttcacctcacctcttctccaatttaaattctgacattttctggctggtaaccagtgtctcatcactcctagccagtgctcatgtccttcatcatgataaagagtctttcttcttggcctgtgtatgtgaagatgtctcattctgatgttggctttggctattggtaaatcagtatatcctgaaccatattccatgggcggtaaaagttctcaaacattagatctgcttttacaaattaaaagaaattcagtatctttccatcctgtcactgaatgaaccaccataggaaatttcaaagcatatgttaaattatgggttttcttaatattgaaagcttggcattaattggctatacatactgagaaagtgccaaatacttgcttataatttcacctaaaatattgttcctgatgtgaaccagtatatgaccacaatatactgaccaatatatgaccacattttcttcaatgaaattgaataaaatatcaaccaagtcaggaaaataatatttcagtgatagggaaattcttccctaattgtctcaattgactttcttagttgcacaaggaactaaaagaatgttggccatgatgacagttataccaggatctttattgaagtatttaaaagataattaaggaaatctatgaaaatcctatttctggtggcatattttgctgtaattttcatgagatgggagacactaccaatgtgggactatggtattactattatcttcaagagaagagatgaaaaatctacctactaaatgctgttaaagaatacttagcagccgggcttggtggctcacgcctgtaataccagcacattgggaggccgaggcaggtggatcacctgaggtcaggagttcaagaccagcctggtcaacatggtgaaatcccatctctactaaaaatacaaaaatcagcggggtgtggtggcacacacctgtaatcccagctacacaggaggctgagagaggagaatcggcttgaaccctggagatggaggttgcagtgagccgagatcgtgccactgcactctggcctgggcattagagcgagactccatctcaaaaaacacacaaacaaacaaacaaacaaaaaacaaaatagaaacaaaaaaaccccttagcattccatttatgaaacacttttcatgtttcatttatgtcataaagataggtagtcagataaacccaatgtttagtttaccacatatactgagtattaaacaaaatgttgcttcaaaattatctctcaaaagagctgaaacggttttatgttcaaactcctacagaatctcctattacatttattttattttgaacaaagttgtatttggggaagacattaatagaaaacattgttaattaaaaactggccttaaatgttatttaggtcatctgatggatactgttaaaaaaggaaacaagcctctcatggaaatactaattattttgggtgatatatgctcaaatttgccaaaaatctgtgttattttaaatgggcctcttagaaatcgctttaaataacaattcagaaattttgttttaaaatagagaagttttggcaatcaaccaaaagaacacagagaacaggaattaagactaagtgacatatctaactctgaatcagtctgtaatggagggttcccaaatgcagtgacggtcaactatgtttcaagacaatgaaaagaggaaacatgatggttactgatcaaaggcaaagttggtaaaggacagttcttcaacgtaggtgccagactctaaaagccctggcacaatgcgggtagagtgtgctggctgagtgggtcctgccacccctcagcatgagcctcttggatacagaaagtctggaaaaaactcacatcattcagatgtcaatcagtcccaaaggaactagcgtgagaattttgttaccaagaagaaaaaaggaagaaaataataggaaaatccagcagaagttggaagagtcctccaccagaaaatgctaccaaggatgagaggaaaatgatgaccaaacatattatattgaattttttaaaattagggaagtaattgccttttaaaatgaggtttcaaagcaatgaggtttcaaagcaatggcataagaattcagagaggatgatgtgagacaatagaagatgaaacaagagatggtggactcagggaagaaacatagaagaaagaaaattagataaataaaggtcaaattgaaatctctacaaatattacttgacacacgccaaaatcctcagtatagatcctaactcaatgagcagaattgaaagctaataaggaatgtagacatagaggacagagaaaaccagcatatacataattgttgtccctaaaaaatataactaaagtaatggaaaatagaagtcatggattaggataagattccaaaaagactgaacagaacaaaggaaaacttgaattcttagattgaaagggcaaatcatgcctagaaaattgacacaagtcagtaaacttagcaaaattattctactcaaactataaaaagtatactttataaaactaatttacctggaaagatggaaaaaaataatttcaggttcagttttctcacttcttagcatcaacaatgttaaggcaataaaggaatgcctccagtttcttaaggaaaaaatgtgacccaataattttaaactcagcctaattattggccaagtgttttgaaaataagcaatttggttgtaggctatatcgttgtcttgccaatttagttttagggtcaagtttaaaagaaatacataacacccaattataaagcagaatgtagaaatattcccaaaccctaagaacataaaaattaaatatagtgtaagaaagtaaaatatttttattttctcattttttatagatgaggggagaagatatcatgtggtatctttatatcatgtgatatatcatgtgatatctttatatatatcatctttatatatcaagatgatatcttttatatatcaaagatgataaataaaataggaatataagatattcaaagagttaaatatgttaataggaaaaataataaaatagggtagtgaaggggaagaagacaaaaggggaggaagcagaaataaaattttgttgtttatgctcatagtagggagtaagtaaaatctaaataaatagaaaatattaatacatgcctaaatgaagtctaattataaagataattagaacaaaatagaaacctttcatattttagaagaatgcacataaaaaggtatgatggttctttgatgcctagtttgtttatttttaacgtgaagccatgttgaattttatcaaaagccatttctgcatctattaagatgatcacgtggtaactttttaattctgttcatgtgatccagtaaatggatcgtatttattgattagcatataatgaaccaaacttgcatcctaggaataaagcctacttgattgtggcggattagctttttgatattctgctggatttgtttgctagtattttgttgaagatgtttgtgtgtatgttcatcagggatactggactacagttttcttttttcattgtgactcttcaaggttttggtatcacaatgatgccggcctcatagaatgagttacggagatattcctcttccttgatttttggaataatttcagtaggattggtactagctcttcttgcatgtctgatagaatttggctgtgaatccatctggtccaggactcctttggaagtggtagcttttttttttttttagatggagtcttactgtgtcacccaggctagagtgcagtgtcaccacctctgctcactgcagcctctgcctccagggttcaagcaattctcctgcctcagcctcctgagtaactgggattgcaggtgtgtaccaccacgcctggatttttttctttttcatatttttagtagagacagggttttggtatgttggctacgcttgtctcaaacttttgacctcaggtgatctgaccatcttggcctcccaaaatgctgggattacaggggtgagccaccacacatggcctttgttgttgttgttgttgttgttgttactgattcaatgttgaaatttgtttcggtcttctcaggatttcagtttcttcccggttcaatcttgggaagttatatgttaccaggaatttatccatttcttcaagtgtttctaatttttatccatagaaatgcttacagcagtctgtgaggttcttctgtatttctgtggggtcagtgataatgtcccttttgtcatttctaattgtgttgatttaaatctctctttttaacttaatctgggtagcactctatcaatcttgtttactctcttgaagaaccaactttttgtttcgttcatcttctgtatggattttcgtgtctcaaatttgttcatttcagctctggttttggttactcatttctcctgctagctttggggttggtttgctcttgtttttctagtcctctaggtatgatgttaggttgttaatctgagatccttttaacttgatgtaggtgattagcactatgaaatttccagttaacactgccttagctttgtcctagagattctggtatgctctttctttgtcttcatttgtttcatagaactttttatttgtgccttaatttcactctgtacccaaatgtcattcaggagcagattgtttaagtttcatttaattgtatggttttgatacatcttcttgatattgatttctatttgtataatgttgtggtttgagagtgtagttggtatgatttttctttttttgaatttgttgagaatagctttatggccaagcatatggttgatattagagtatgtgtcatgtgcagctgagaataatgtatattctgtaataagagccatctatggcaaacccacagctaacttcatgcttaaggggcaaaatatggatgcatttcccctgagaaccggaacaagacaaggatacccactctcatgactactattcaaaatagtgctggaattcctagccaaagcaatcagggaagagaaagaaataaataggaagagaggaagccaaattctctctcttctcagacaatatgattctatacttagaaaaccctaaaaggctcctaaactgataaacaatttctgtaaagtttcaggatacaaaatcagtgtacaaaaatcagcagcatttctgtatgtgaataatgtccaagctgagagccaaattgagaacacaatctcattcacaatagcctcaaaaagaaaaaaatacataggaatacagctaaccaggcaggtggaagatgtatctacaatgagaattagaaaacacttttgaaagaaatcagagatgacacaaatgaatagataaacattctatgttcatgaataggaagaatcaatattattaaaattgctgtattttctgcagcaatttacagattcagtgctatttctaccatttttcacagaattacccatagtctattctaaaattcgtatggaacagtaaaagagcccaaatagccaaagcaatcctaagcaaacagcacaaaatcagaggcatcacactacctgacttcaaactacactacaaatctactgtaaccaaaacagcatattggtacaaaaacaaatacagagaccagtggaacaggttagagaacccagaaataaaaccatacacctacaaccatctgatcttcaacaaagttgataataacaagcaatggggaggggactccctattcaataaatcgtgctgggataactggctagccatatgcagaagaatggaaccggccccttcctttcaccatatacaaaaatcaactcaagatggattaaagacttaaatataagatctaaaactataaaaaccctagaagaaaatataggaaacaccattctgaacataggcattgacaaaaattttatgacgaagttcccgtaagcaattgcaaccaaaacaaaaatggacatgtgggacataaactaaagagcttctgcccagcaaaataaactatcaatggagtaaatgaacaacctacatgatatggttttgctgtgtgcccacccaaatttcaccttgaattgtaataaccctcacatgtcaagggaggtgccagtggagataattaatcatgggggcagtttcccccatactgttcttgtggtagtgaataagactcacgagacctgatggttttataaatgggagttcccctgtacaagctctcttgtttgttgctatgtaagtcatacttttgcttctcctttgccttctgccatgattgtgagaccttcccagccatgtggaactgtgagtccattaaacctcttcctttataaattacccagtcttgggtatgtctttattagcagtgtgagaacagatgaatacactacagaataggataaaatacttgcaaaatatccatctgacaaaggtctggtagccagaatttatagggaacttaaataaatcaacaagcaagaaaacaaatatataatctcattaaaaaatgggcaaaggacatgaacagacacttatcaaaggaagacatacacatggccaacaagcatatgaagaaaaaagctcaacatcactaatcattagagaaatgcaaatcaaaccacaataagataccatctcacactagttagaatggctattaaaaagaaaaaaaatgacagatgccagctgggctgcagagaaaaatgaatgcctatatgctgctggtgggaatgtaaatgagttcagccactgtgagaagcagtttggagatttcacaaagaacttaaaatagaactaatatttgaccttccaatcccattactgggcatatgccgagaccagctctgtcgtggagaccctaacccagagaagctgaaggaattaagacaaagacacagaaatggagtgcaaagtgggaatcagggggctgacagccttcagagctgagagccatgaacaaagtttgacccacatatttattgacagcaagccaatggtaagcattatttcttttaattttattttattttattatttttttattatactttaagttctagggtacatgtgcacaacgttagattagctaaaagcattccttatgggaaacaaagggacaggctctgccttgttatctgcagcaggaacatgtccttaagacacagctcgctcatgctattgtttgtggtttaggaatgccttgagcagttttctgccctgggtgggccaggttttccttgccgtcattccggtaaaccaacaacctccagcgtgggcatcataaccatcatgagcatgtcacagtgctgcagagatcttgtttatggccagtttctcatggcctgtttatggccagatttgggggcctgttcccagcaggcatatgcctaaaggatataaattgttgtaccataaagacaaatgcacatggatgtttattgcagcactattcacaatagcaagatgtggaatcaacctaaatgcctatcagtggtggactggataaagaaaatgtaatacataaataccatcaagtactatgcagccataaaaaataatgaaatcatgtcctttgcagcaacatggatgcagctagagactattatcctaagcaaattaataaaggaacagaaaaccaaatactgcatattctaacttataagtggcatctaaacattgaatatatggaggcacaatgatgggaacaacagacacaagggcctacttgagtggggagggtgagaggagggtgaggaccaaaaacttccacctatcggatactatgctcactacctgagtgatgaaatcacttgtacagcaaaccccagtgacacacaatctacccatgcaacaaacctgcacatgtactccctgaactgaaaagtcaaaaaaatttttaaaaaggtatgatggacaattaaagcaagaagaaactatctaaacagctttatatgtgctaatattgaatgaagtcagtatattgttaagtagaaataaataaaatgacaaactatcaaataaaattttatctattatgttcattaatatcctttatgtatatgcttgtttattgatagaataacatttgtttatcttaaatgatactccaccaattagtggctacctcaagagtgacactacatagccatagttatttttctattttggtcttgtatccctaataaatcaatattttacatgaatatcacatgcttagcatacaactatatcaaatatgactttagatacagtatatgtagtacctgcgtgggaattagcttgtaatcaggctaagaagataagaatggcaaaagtagagaatcatacagaatgtcaattaatactcagttttgtcacacaaatattttatgaagccctcttagacgactgcagccttcagtgacctccttcctctgatttttaatagcaattatagactgtatcatagttcaacattaaattatgtctttatcattttctaatagttcagtatatgatagtcttgtctttatagaaaagattgattgtcaaatcctttgactctaaattcatttgtgtgttgtattactgatgtgaagcaaagtgatgggatagaaatctcagatacgaacaacaacacaccaataattattataccacctgctaatatacatattttgtgctcataggtgattaataagaaaacaaggtgcagagaggttaattaccttgccctaaataaaaaaaaaaaacctactaagaaatatatttagggttagaacccaggcaggctggctctggaaatagtgcacataatggtatagatgtgtgaccttgctctgttatttaacttcattgacttctcttcctccattgctgaaaggtggaaaataatgacttactttacaaagttgctgtgactcttaataagaaaaatccattaagagctttgtaatccatgaagctgtatagcaaatgtgaagtataactctcatcattgctattttcatgctgttgttgcctggcatcatataggctcacctcaaaggaaagcaaagatttcacttagatttctgtagagataattgttttttacaatcatttactgacttttaaacctcaaaatgcatgtttttgctcagattgtacaatatgtattctaaaataagttatattctattgaaaaagattatctgacaagccatgatgcggtgagtgccataatgaggttctgagttctgtacagagacctagtagagaggaaaggggaagggaaggattctgagactcaaagagttatgcacatttctcccagcatagaaagatttgcaatttcaaattctaatacctgcctgtgagagaggtattcacaggttttgtgtatttatgctacacagaaacctcatggcattgtctttagtctccctttctggcatcttttcccacaaagactgtccttgaccaacaccagaaatgaatttgatttctctaatgcaggagataattggatttttctttatggaatgcatacctttaatgactgtctctgcttctgccaatttagctacaagtgacctgacattgatctgataatatgacttaaaaaataaagagttcgagctggaggtggcaaagatcagctgcctggcatcagaaagaatgtttttttttttttttttttttttgcttcatctaaccattttcctgagaaaatgctttatccttgaatgtcatttttacacaacatgcagctgtagtaattggtcatacagcagcagattgtctccttctagaaaatataataagtatttcccagaaagtgccctggagaaaacattgaaaattgaataaaacccacccagtaatcattctgttccttggaaatatttattaccatgttgattctttctggaacaggataaatattgcctaagagaattaattaaatcttttaaaagtctaatgcaacaagaaatatttatttacctatttattcatgtaacctttaggttttgttaaaatatttgacactagacctgttattaaagaaggttataaaggaacagtggctgaaattgttgtatttggaaaaaacagcaatttcttcctctagagaagttacgatataaagctctttttatacctaagagtatgtgagatttaaatttctctattttcaactttattctttttttccagtaacaatgtaattcacttgattcatggttaatttttattctatcatcttccccttactccttttgataagtatcatgaatcattttgatggaaaatacaatccatgggcattagtttgagtgagaaaatataatcctgtaatttaaaaggatcaagaagaaaataaacagttgaaaaaatcatcgatgaactagtttctctttaaaaataagcaaaaagtgttttcctttttgaattcttaatattagttgcattcacatttatatagtgattgacagtttaaagagaaatgaactgaaagtttatattaaaaccatgcatgattgttgaatcttttttgattcaacaatgaagccacaaattattgtaggccctatgttagatagagcctacataaatctgtagtgttactcagtgaaggggaatggactaactttggttttcatcaaccaagagaatcttgggaactctattcctagaaatgacattgagaaataatatgaagaattaaaatcagatctttcctgaaaactggaatccttatccaccattctgattgtgtcacctaagtgagcatgtgaagcattgacatgccggtgaatgtttccagagaccattttggatgaccctgcttgagaattgatgtgccttccacaggaagtccggtattattgaaggggtcactgatctaaaaggactccccactgaatcacaatctttcatcataaatgattaaatttcacccatttcaaggccactgttcaaagctatactcaaatgcaatgataaagctttaagcacaagagaaaaatttattttagtggatgacgaaaattctctcttactcaatgcagtaaacctcatttcgtttctgttttcataattttgaatctgtcttgtctggatttgaacattattaattaaaatcataagtaatggaatggtgttctcttctcttgaagggaaggcagattttctgggagtggaaaaaatgtgcatgtgtataacatacacacacatttatgtaacacttttttaaaggaaatttattctccatcctcattggatttttaaaatacctttctaatagattaactatttataatactttgggcttctgctgaaaccattaatatgtgatgtggtagatgagaaatgtactttgttaatggatctttaaaaacaggcatttatatcttaatttattttatcatttcttcttgaacaaatattttggtctagtatataaaaatccctttgacattcttagaagaggtagaaagatcttcactggcaaggatttcaaagcctagtgaagagagaaaaaagcatataagtaagtaaaagagaaggtagaaggtgatacatgacatgagaaggatgggtcaagaaccacaagttttctataagtgggagagaacagtgaagacatcacaatagtaatatgacttaggcctcggaagatgggcagaatctgtgcaggtgaggaaaagaggaagaacatttttagatgaaggcacagaattgtgggtgagagaatgctagctaattagaataaatatgctgtagaactgggtacgagtactttaccacacatatagctggaagaagtaaggaagaggaaaagagaagataatattttgattaatgatatcgctaaaaatctagacatcagggaatgcttgagttttggatttagacaaactttaaaagaatatagtattttatttgttacatatgctttgtttctatggtactgtcttatatccggtaatcttaatatttaaaaaattcttaatatctgacatgttgaatgactttaaatgtgctcattctgtatgtacagtcgaagaaactattaaagtttttaattgaatgaagtatatcctaatttttgtttctgcatatgttataatgttaaaacgtatacttattctgttctcaatagaatgtaaattataggcttatagttaaatctgattttaagatttctgaaagtgctgaataagttcctttcattgcttcaggtcactgatatgatgcttcaggacaaaccctatcctgactggggaaaatcagcaagagctttctggaagaaaggaaatgttaggatcactttattctggtaggaaattgtttcacttatttatttctgccttgcctcattcactgaaggactttagttggatgtaattttccttacaattatagaattctatctagagggacatttttggtagctactatgctccattaaaaccattatcctaattattttatgaattaatttcttcttacatattgtgtatattcacatttataaaacagaagttttgctaatatagtgatagaattaagatttgaccagaggtaagttcttgactcagcaaaaacaagctgtaattttcatcagtaaaatctgatagatgaaactgtctcctataaatactaaattgcctagtatatttgacaggatatgattttgctctgagaagtgataaagaaaaggaacctctttataaatcacatcttctacattggcatttcttctttatgtagtttcgtttagctctccagcccaatctttgcaattaaaaaacaatccatgtcttatggaactttgttttttgtgaagtcaccattatttatgtgtacgtgaacaagttcaaacagaaaagataggaatggagaggcagcaagaagggcactttcacgtggctgtgggacactccccaagcacaatgattctgtgtgatataatatacagttgaataattatataatcccaagaaaagttatgtaaactaacacttataaatgttctacagtatttcccccttatctatggttttgctttccctggtttcagttacccttggtcgactgcagtctgaaaatattaaatggaatgttccagaaataaaccatacatacattttaaattgtgtgctgttctgagtagtgtgatgaagcctcataccctcccgggagatcaatcgtctctttgtctagcgtctatccatgctgtcgatgctacctgccctttagttacttagtagctatctcacttatcagatctattgttaaggtattgcagtgctgtgtccaagtgatccttattttagttaatgatggccccaaagcacaagagtattgatgctggcaatttgggttaagccaaagagaagtgatatggcttcctttaagtgaaaaggtgaaagttctctacttaataaggaaagaaaaaagatcatacactgaggttaacatatcgtatgctgagaaatatggtaagaatggatcttctgtccctgcaattgtaaagaaggaaaaatgtttgtgcataggatatatagggtttaatactatccaggacttcaagtatccactgggggtcttggaatgtacgcccaccagataagggggactactgtaattgattatagctggctctgatgtatattatcctgtatacctgccttttgaaacaaaagagaaaaaaatctgtttattcttggatttaattctggcggttgattttttttttaatgcaaaagcttcaaaaatcatagtaactaagtacttgaggaaaatatacactctatgttatcttttgtgctttagtactatcattaaatgttgctggagatataggacatgttgaactcaattcttaacaggtaaacaaaagtggattttcaatactgttatgaaaatgaatatgattttttagctgtgtattcacacctcatcttcatgggtcacatgtggcctatggtactatttaacctccatcttttttcctatttgtaaacttcccatatagcttttctgaataatatataatttaatgattataagaaatatttattgatagtatgttttgcttgaggcagcaggccaaagactttacatcctatatctttatttatttaatcatgacaatcccataagataggtgctattgttataggcatagttctctgactccagagccctagtttgtaattattacactaggactgcctctaggagaacaaaagatacatcagtgtgcaaatttccaaatgattaatgttcattcttgtttaggtagggtgctaaagaagaacatacagttcttgggagccctcttccctacaaaattccccacatgggttttaaaagtcagaatttgaaaggaggtaaactaatatcaaatgtgtttatggatggtctctcttaaaacaatatttatttactatgtttacacatgtttcttattagtgtactgatacggtctcactctatgtccccacccaaatctcatcttgaattgtagttcccataatccccacttgtcgtgggagggacccagtgggaggtaattgaatcatgggggcggtcacccccttgctgttcacgtgatagtgaggtctcaagagatctgatggttttataaggggcttttccacgtttgtttggcacttctctctcctgctgccatgtgaagaaggacgtgtttgcttccccttcagctgtgattgtaagttttctgacgccttcccagccatgcggaatggtgggtcatttaaacctcttttctttataaattacccgttcttgggtatttcttcacagcagcatgagaatggagtaatacatgtatcttcaaaggtagctgattgatgactgttctctgctagttaccaaggtcacatgtatactatttgcaagggtaagccatgtattctataggcccctatgattgttgtcattagctgttcttaatcatgattgctgtttcagaggagagaaatccattaatatgattttttctttgaacattatcactcaggtctatatatcaccaatgtcttacaaattttttttttaattttttttttttttttttttttttttaagacagaatctcactctgtagcccaggctggagtgcgtggcacagtctcggctcactgcagcctctgcctcccaggtcctagtgattctcctgcctcagcctccagagtagctgggattacaggcacgtaccaccacgcccagctagttttttttgttgttgttttttgtttttgtatttttagcagagacagggttttgccatgttggccaggctggtctcaaactcctgaccacagatgatccacccaccttgggctcccaaagcgctgggattacaggtgtgagccaccacacccggcctcaaatgggtttatttttaacatatgtgataacatagcccagtgggtattctaaaacgtagtttaaatgttgtaaaaatgataatttaattagtcactggcaagtagataatattcttaaatagagagcaactaaaattcacacttttttgtagttattctttctgtaaaattattaataattaggcaatatattagagagattgttttcactgttatatttcaaaagtagtatttcaaatcattgcataaagtaactgaagaacaatttaaatgccactttaaaatttttttccattttatccatttctatacatttagattatcttgacaatggtattcatggttgtaaaaaaggaaaagctgatggaaaaagttgaatatagaaattatgtgggaagtaaagaaatcttcctttttattcatacttttcgcataaaagggatttagcaagtaaaaagggcatttggggtttggtttggttttgttcttttagccctaggagataaaatacaaaactcattggcaaggttttagattaaataaaagacagtatttacatactttatgtcacccactcaaaaatgggtattttcttttgattttgctttagttaaggaaagagcgattagtgtgaaaaaaaatgtatggtggagaaaaaattttgcaaaggaaatctttcttaagttgcaatgtgactatgcacagcagtttgagcagcacaacatgtaattttgttctagtaaacatatctcttacctacttgtagctgctttaactcacaaacacctgtcagaaactgagttcttccttaattttcagtgataggtgtctctacgttgaagaaaatggttcctatttctttctgcagttgtgcaaagatgaggctgctgtagcacctgggctttcatattgcaagggagcctaaatagtggcaatatttgaaaggcggaaagggaggaatatgtatagatctcttccaaagccctttccgtagtccttttgataatgaaaaagagtaaagatctaagaatctaaatgctatatgaatgccttatgctcttctatttttcagaggcgttaccaacaaccattttcactgacttgtgtctgaggtaaaagaacagctacataaagaacaagtaatatgatattcatgttagcttctatccccctgatttgtgtactctctagagaaacaatttgtatgcttttgaagggaagaattttaggatgatatttcccaaagccttagctttttttaaaaaaaaaaaagacaaaatagacttctatgattagtagaggaattggtggaagaagggattgggagatctagtgctcattagggcttcacaaatactccaggtcttcaccttccagacacgtaagaggatttcacctttctcccccctctgattacatgacttgccttgatcaaggcaaatgtgaataaaattggcatgtgccatatctaggtggaaatatttaatattcaatgagatgcactgaaaggagctcctttctttctttctttctttcttttttttttttttttttttgagacggtttcttgctctgtcacccaggctggagtacagtggcccaatcttggctcactgcaacttgtgcctcctgggtgcaagagattctcctgcctcagactcctgagtagctgggattacaggcatgcaccaccacacccggctaatttttgtatttttagaagagagggagtttcaccatgttggtcaggctggtcttgaacccctgacctcgcgatctgcccgccttggcctcacaaaattctgggattacaggcatgagccaccactctcagccaaaaggagctctcttttcagttgcaattgtggaagcctgtgtctagctggagcccttgtcatttggattccctgaatgaccaggataaaacaagcatccttgataacactgcagacttgtagtttgagtgagaaataatccactgagatttaaggactgtttgatactgtagcctaaaataacccattctgatgtttacaaaaagtcatccctagaaatggggcgctgccataacggaaagctgaaatttgtgtattaagggatgggcagcaaatggcaaggaaattgatgctggaaactggaaagatggtaatctgagtattactgagtattatagtggcaagtgttatagtatttgagtattatagtggcaaagcagttggtaaaaactgtggtctgtgatgacttggaagctccaggagaagttggaaagcaaaatgttcatagtgtgttgctgtgtgtatctgtgtacagcagttgtgtactctgttccatcctggaacataaaatcctatggaaatccataggattaaattttatgttttctcttttggatgtgcaatgttgtatattttttaaagtactttctctaccagtgtaatggtgtggatggggtatctcttaatcataattatcttaattcttaactgggaagcaaatgtagcagctgatatttttcctgctttgaatatcatagttattaaagtttaacaaaaggaacttagttgtttacctctgaccagagaagagttaatcaacaaatgattattatcttaatatacattaaatatggtatggagagtaacataataatcataaaaatacaataaggtaataaaaagacctaagaatcaggggaaatgtcaggcagaagagttttggtaatagtattagtaactagtagtttgacgtcctctacagagcaactcatttgccattattaagtgaaagtgaattattatttgttttatgagccatggttcaaaactaagggatgtggagagtgcaggtgagggttcatctgagacaagttgagacctgtgacagtccccattgatgagcagtctctttctgggattaggctgctaccattgcccagatccagcgtgaattcccctcagcactgctggttacatagtgccagctcttgttttcaaaatatcttttttcttcatttcccctgctgtccagagctccctttgtgtgtgccttctttctttagaataagggataaatgcattaaatatattgacggttgaaatgctttgatgtttgtttttgcaccaaggaagttttctgacaaactagaggtagaatctataggcaggtgtcacaggtcagatgagtcagtctctgaattagttctcacaaaagttaaataaaacctgattataatggctgggcatatgagtgactcgtattccagaaaccaaagaggaaccaatgtctctatgtgtaagctggacaaagctttgctattaagtcagagaaaaatacatgcttaccttatttatatatttgttcatattgatatctttcaattgtgttagtccttctgggaatgtaatatggaacaagaaacatacaccctgatgaacagagttgcaacaattgcttaaaaatactagcaaaccaggctggggtgcggtggctcatgcctgtaatcccagcactttgggaggacgaggtgggcagatctcttgagttcaggagttcgagactagactgaccaacatggtgaaaccccatctctactaaaaatacaaaaattggctggacgtggtggcacatgcctgtaatcccatctactcaggaggctgaggcaggagaattgcttgaacctgggaggcagaggttgcagtgagccgagattgcaccacttcactccagcctgggtgacagagtaaggctccgtcaaaaaaaacaaaaaacaaaaaactagcaaaccaacttcaacagcacattaaaaagatcatgcaccatgaccaagtgggatttatctctgggatataagggtgattcaacatctgtaaatcaatcaatgtaattataccacattagagtaacagaatgaataaaaaccacagttatcccaatagtacagaaaaagcatttgacaaaagtcaacatcttttcatgataaaaactctacaaacttggtatagaaggaatgtaccctcaacacgataaaggtcatacatgaaaagcccacagctaacatcatactcagtggtaaaacccgaaagcttctcctctgaacatgccaaggttgctcactctcccccacttcttttcaacatagtactagaagtcttagagcaattaggcaagaaaagggaaacaaacaagtccaaattgttgcacccagacatagaaagacatttaacctatcagacatatgagacatattacctatcagtcattacctctgtagtgaagtctccttataatctccttataattctattctagggcaactatcattcagtgcttcctgtattcctggtactgggcttttcacattcgttgtttcctttaatccacactgccactcttcatggtaattatcattattagctgtattttaaagacaaaaatctgctgtttaagttgcatagctagtgaacctgggaatccagtgtgggcagagcttgcacagtactgcactgtatggcgacagttattctaagattttaagatatttaacatatttaaaaatgattaatcatattttcaacaaatgtatttactataaccctttctttctccttgcaaatgaatttgggttatgtaaaggaagacaaaatatccaggaaacccttggagtttatctacttatgttctattacccttttattattgacaaagaaattgaaacaaaaataagttacttgtctaagcacaaaattaatgtttctgtggcagtgagcacccaggactactgattcctggtctagcagacttttgactatttcacattaactccctatattctttgttgttgttgtttgtatgaaagagtcaataaaattgaaactaaaagaatttgctgatgattagatatattgagataacaactcttttaagtcagtagtaacaatcagaacattctgtgtagtttaacttgatataattgtatatcattttctctcaattatggaggttaagcaagaaaaagatgtacagtatatagttcaatttgccagtaaaacatgatgtattaccagaaacttcacttaatttcacatataaaaagccagttgctgttatttttattttgtttatcttcagggttttcaggggcttaatttctttaaaacatatttgcaaggttgaaattaaatactatagttgatgtcctaaatgttggctatattaagcacaacaaaagcccagcattttattggggacactagaagtaataagatactacacattatagctactcaaataataactgtactccttggaaaataatgagttcattgttcctgccaaaagcatctactagggagataacattccagcattggttgcaagaacagttggtatctaaagttctttgcattctaaaataatataattctgggtagtctatttccttgtctaaggtcatctatgtgttcagacaaacatgaagtcttcagtataatgattaaaacaactcaaagtaacatcctaagaaaatgttaaattagttttagcatgctcattccatagaacacaatctagccactatcttttcactatctttggaaagatatttaatgacatgggaggtggagaaaaaaagatactaatgtaggtatctttagaaaacagtgtgttgactgggaattttaagaattaatatgaagggaactagacatgcacaactgtattctagttggtagagttatttctcatggggttaccagttaacaactctgagcttgctttacatgtttgctagaattgattgatgagtaaatgaatggtagatgacagaatccagatttctcactgtcaaagactgaagttaacagagaagcaaggggttggggacaaactataatcaacaatgtggtactggattagagacagagacatcagtatgaattcatgtttagcttaatacatagaaagatggatagttacaaggataattttagctatgtttgtatatagctcattctaacatagaaagatggatagttacagggataattgtagctatgtttgtatatagctcactctatctgctgagagagcttagatagaataatacctcagtggtaataagcacaccccctacccagatcttggtctctgacatcattctccaataaaaggaaccagggctctttggagaaatgactgattctaaatctggggtagagaatatagaagatgatcctgcagcatcgtgtcatgccagaaagtaaggaagtgttcaaaaaacagaatgatggagcatttcaaagggatgcaagagtcaacccaaaagaagtctcaatggccaaagctagagaaatttggtcaacaaaatgaattacatagtattagattataacccaaactatcaagtactcatgagttcatacttagataaaaatgattaaataaataagtaaattggaaagaagagacaaatctcctgtacagaagaatttacataatttatgtagatattcctgtcctcaagatggtgaagcttaactccccaccccttgagtatgaactgaactttgtgacttgcttccaaagaatagactgtggaaagtggcggaaagtagctttacagtagagaaatctgacaaacattaccttgaccttgtgatgaaacttaaagttatcagtgataagtcatgttgatagaatgtaggttatacatctgtaccataaaaatgctgtaccattataaatattttatatctatttgggcccaatttttaaaatactgtatcctagttagaatagaaagataaaagagaaggccatctaagggggcttctcccaaattattcattaatgttcagttgtttatagcagaagattttgttgttgcctacttatgcataaacctcaaggctgtagcaaccactctcttatagccagtgtgtgtgccctagcataagcttctaactatggactatttctttactgatatcattcagtatagggataaatcaaatgtgcaaaaagttagaataaatttgtgatctgtagttgatcatgtcttcctcatgagcatccacctagctgctataatgtgggatataggggttcatcacaaaattttaaattagtaattaatgatatctgtgaaacttttgtctaaatggtatctttcagagaactcagtcttatttggttaagtctattttgaataaatgtttagttttttagatctccctctttcttttttttttgagacagagtctcactctgtcaaccaggctggagtacagtggcatgatcgcggctcactgcaacctccatctcccaggctcaagcaattctcctacctcagcctcccgagtagctgcgattacaggcatgtgccaccacgcccagctaatttttgtatttttagtagagacgggatttcaccatgttggccaggctggtctcgaactcctgacctcaggtaatccgcccgccttagcctcccaaagtgttgggattacaggtgtgagccaccatgcctggctgatctccctctttcactccatcttcttgacttctttaccttactttataatgatggaggaggggaagtctgtgtatctttgatggtctcaactgttcatttagccttactcatggacagtgatggttgaagtccagcttcctgtttgatcttttaattcctagccttgtgtctctggtcatgaattccactcacctacccctcccttcaggtccccacagtccagggacttagtcttggactgctgggacctaaagggtctttgaatccaggcctttgcagtcttctcatcacctttgcatcctcttagtgaatgcaggaacttctgggtcatctgcaggactttgtggcattggcagagagaaaaggagggcatccagagctttctcagtctcctgtgcctacctatatccatttacaaatgccctagactgtgataatcattcttttataggaaagacctgccatctcccttgggctacagtcagagaagccctgatgcaccttgagtgccttcatgtgaatcttgtcacttctacatatcaccactccctccttaaagtagatgctggtggtataggggaataagatccttgctgtctggctttctcactcttctatccctcttttgctgcctctaggtggaagggaagatttcctccattttcatgggcaggagtttcttttacattgtgtccatcctgcctattctctccacctctgtggtcaggtcagtcaggcctcttgatatagtagctctgagatgttagaaattaggaactaccaaggaataatgtattggcttaatagttccaaaacagaatccccattacatctctatagcaagtagtgctataatgccacaaactaggctttctagcaatataaatctttccagaatgctacattctctaaatcacatgttttggtggttatagatccaggaaggtgttgaaactatttaatagtaagtgtgaaccctgataaaaaagtcataaaccaagaattcaaaaacttttcctttttttttttttttagtgctagtcttcttcttttaacttttattttaagttgaggggtacaagtgcaggtttgttacataggtaaatttgtgtcatggggtttgttgtacagattatttcagtcacctaggtattaagcctagtatccattagttgtttttcctgatctctccctcttcctaccctccaccctgcaaaatgccccagtgtgtgaacacatagatgaatagaagggaaagattttttttttttaacctttcttttcagtcctcagttcttgggccattccatatgaatttctttacacgaagttctcctttttcagcattatcatcccagtgtttctgtagatgacttgagcctttcccccataccagaccttactcaaccccccagaccttactcaacccccataccagaccttctcccttcatggtggcttctacctagatcatcatttggaactagatccctcagtttgtatgactatttgatggagtctctttcttacccccaaagtagaaatttacttattttgtacacatggtttcaaaacaaaggctattaagagtgttctgcttttctccaaattggcacttcctttgctcctaagaataggctgctcacattttaaaccaaagcaccctcttctatataaactatgagtttttccaagttttagggtcctgtttcctgctattcagattggagtttcacctcagttaactaactcagccaaccagagcttatacaggctgacttgtgaggtcctaaagcaaaccaatgcaaaaaacagaaattcaggtcaatgataagcaaaaataccaaagctgccaagagaagcttctgaaaagtataattgtttgcctcgttctgccaattggcttggcccttccagaagataaagaatttctgggatgtgatccatcatcctggctgtcaatctactgcgcttccatattttattaactctgtgtgggcttttactgtactctccttttttggtaaacattcttccccaccatgtcctagcccttatagcttcccttctaatatgaagaaaagacctttaacttcattctcatcccatgtttacctgtctctgccttgattctcttacacacacccacacacacacatgcacaacctcatatatgcacacacccaagcatgcacatacaaacatatattggattgattataagccttgattcactacagttttagtattagcccatgcaagaccatcttttatctatacatctttgtatcaatattaggcgttagagattttatttgttaatctgcccaagaacccaaaatatacaagttctttaaattagacctttttgtcccatctatacttaatctgcagattcattgatgactcttctctacatccttcatctgtgccaactctagcacaaaggggaaccagggatgagtaatgattttttttttttagtttttctttgctttctttgtcttcttcttctccttctcctccttctcctccttctcttcctcctcctcctcctccttcatgttaatataaaaggaaattacctttggcaaaatgccaagtattggaaagcatgtgaagcaggatgtgaaagtcactgggagcttattttttgtctctgaaactctatcgccatgtaagtgtggtcccccaatcgcttgatctgtaaagcaggttttgcttttgaatacccttttagtaaataaactaccccagaggcaatgagattttgctataagaaatcagtgagtgcaggtgtcattgtatggtaaactggtaatttaaaaaaatcaccataattttgctctccccaagcccattcatttcagtcttcctcagctctcttcccaacctccccaaagccgcgtctggaaagcctggggtagagagaccacagtaactccaggcttctatgcagcatctgcccttttccccttccataaggaatgagaatgctgagctcagtgcctgtagatatgcatgatttattcatacttgcagtcttgatgagaatcactgaatgctgcattttcttgatacagtatttttatgtgtcttcatgttagagtggcaatttggggtaaagaaaggaacaaagactatatgtcaaagaaaaatacttagtatactttattcagttgagaaagaacatacaacttttaggtttcccctcacacttctaaaatatagttggctgggattctcttgtaatataccatgaagtaacatagtgcttaatgaaatgaaatttgagtatcacagagaggaaatgatgagccaagaaactgccatgaaactacattaaaatgtacttggcatacatctgaattaccgcagttgcattgcaaaaatagtgcagtgatacagtttctggaattaaaagaacagcatgttgccaaggttgaaactatcaaaggcaatttagtatgtttttttctctatgaataaatgaacggatttttttccttttagcataagatgattacatatagaatcatataatctgaattctaatttcacacctacattatatgaagatacttttatcatttttcccattaaacaattttagtatataaacatcttaatcagtgactttaccacagtatattttttaatgtaaaatatggtaatgccaactgcaggtctctgaggttaatgaattggacacttagcatcattgcttcttataaatccgtcctcgctgtagcagattccagttaagctgtccatgattttctgcactatggaagtattatttaacaaatttgtgtccacagtggattaaagttactggactgggtttggagaaggaagggtactaacatctctgagactctctactaagactggtgccttaaatatatactcacacttaacttgtaacagccctgtgagatagatgttacaatcactgttgtatgaggaagaaactcaatttatctgactaacgtcgcaaaaacagttttaaacacccatacacatgttcatttcgccccatcatgcagcttatagactctacatttacatggcgctctaactgtttaataaaataaatagcaaaaattaatacagctcctgaggaaaacattttccccctttgggggaaccaccatgatttcttagagaaccaggcagaattgctaccactatttatttagaaatttttcttcttgcacctgtttcacaatctgttcaggtctcatggccatcttttccatgtaagtggttattgactgagaagtcatctctctggataagaatgggatcactggggcagagataaaggtcaccagaaatgcccttgaaatagcatggtgatagaattaattatttcttttaaataaggtataataaccattagacctctgggttcagtatcatagcttctcatctatcctgaagtagggagagtttacctcatttatatcccaataaactataaatataaatatatatatgtgtgtgtgtgtgtgtgtgtgtacacatataatatacatgttgttatgggctgaatttatatcccccaaattcacatgttgaagtcctaatgcctcagaatgtaactgtatttggaggttgggacttcaaagaggtgataaggtaaaatgaagccattagagtgggccctagtctgatatgactggtgtccgtataagaaggtgaaattaggatacagacacacacagagtgtagattatgtgaagacacagggcaaagacagccatctataagccagggagagaggcctcagaagaagccaaccctgccaacaccttgatttgaggcttctagcccctggaatggagagaaaataaagatctgttgtttaggcatctagtctgtggtactttgttagagcagccctagcaggctcatatacatgtgtaatataaatacaataaaaattggcccaattaatcccaatcgccaaagcaaccaattttttttttaaataaggagtcaagaaatacaagcacaacttcatttcatggattttcacaaaggcaatttctaggacctgcatgcctttggctcaagacatggcttaggattggacttgttatgctttaattcccacatattcactatttgcattacagggtcatagcagtaacttgatttgcaaaaacatgaccctgggaactttattatttgcagtcatgaaagaaaagattcaccctgctttgggagtccaaggcaggcagattgcttgtgctcaggagtttgagaccagcctggacaacatggcaaaaccccatctctacagaaattagccaggcatggtggcatgtacctgtagtcccaactacttgggaggctgaggtgagcagatcacttgagccttggaggttgaggctgaaatcatgccactgcactccagcctaggtgacagagagaccctgtctcaaaaaagattctgtcatatgtagtctattacacttacaaaagcaagaaaatggattatttgattttacttgcaagttggaacaaaatgggttttggggttggctagacagctctttctgcctaatcatgtggtaaggcagaacaaactttactgaaaagaaatctcatacttctatatttgaacaataattttattttatatatgtcgcattttcatagtgctttacaatgtagaaaggtcctttttgagcattgtctctgcttctgtgaagccttcccaggctcctccaatagactcagcaccatgtgatttcaagtccctgtcttacagcattcatggcactgtagttgtttatttcacatgttgatctcctcaagggcagtgactaagcctgtttagatttcttttcccaaggcccaggatagattctgccacacagcatgtggctactaaatgtttgtggagcatcttatgcctttccagaactactatttttatagctgaagaacgtgagatccagaaagtttaattgacaagatgacttagagagagacacaaaacctggaggttaagggtagggtgggtttgggagggagggagtgataggggagagttggcagcagtcagaggttagatcatctcaggtgaaaaaattttgttctaagagagataggaagtgatggacagttttaaatagaagcacaatatgatttcaattacatttttaaagattgttctggctgctgagggaagcaagaagaccaattaggaaagagggcattgcagtcaccccgagagagatcatggtgacttgaactataaaggaaacagaggacatgaaaaaaagtagatagattctagaaatgttttggaaagaaaactttgctgacattttgtatgtgaggggcctaattataaatttgacaaatagtttttacctgttaggtgtcagtgactatttgaggtatcgaacatatgtggaaaaaacagataaagtaccttctgtcaggacctgcagtttacattctggtggagttatacagacctaaataaataaaagatcaccagtcaatcaataaatcccataatggcatatgtcataaagaagataaagcaatgtggtgatctgaagagaccacttcaaattatgagccaggaaaattcccatggatacctaatcagagaactgaatgactggaaggaatgagccatgtgaaggtctaggacaaagcatcccaagtgcagtatatagttaatgcaaaggctctgggtggggatatgcttggcatgttccaagaatagaaaaaaaggccagcatatcctataggaagtgaaaaaggtggagggtcatttgagatatggtcagtccaagaagtagtgggcaagatgtggtgtggagcctgtgggccacacacagggtgtagcagaaacccattgtgaaattttaggcaactttataaaatgattgctctagttgctgtatggagaatggattataggaaggcagtacaataaacagggatctgggcaagacagggatgttggcttggacgaaagtggcagtggtacaggtggagagatgtacatagatttggaacatgtcttatagggaaaatagacatgaggaggaatggaaagaggctatctccaaagatgacttaacttgtggccttgagcatctagtaatagtgccatttagagatggaaaaactggtggaggagcaggttgggagaagaggatcaagatttctctttggacagatgcctgctagccacccaagttatgatgccaaattagttgattatcagagaatgaaatggggagaaatgtttgagcttcaaggtttctggtcccagcaatgaaatgttacatgttagattgagatgcctattaaacatcatgttagagatattaatgaagtgtcctagcttagttaagaccatttttacctcagagtcaccccactatgacctcccattagttgagatgtgatcacagttccacagtagctgccagaggggaacatgtgctcatggggtccaggtaaatgtaccatgctacaggaaaagacacacagcacagcttatgtgcattgcccagggattttggaacaattcacttctagattctctttgccccacttctcacctttctagaaaccatcttttgacttcttctaatctctggaagactttccctctcatttgcctccttgctttgtaaagctgatagagacaatagatatgcttgtatttccaccaattcccctgtttaagatatcctttgggagccataattaatctgtagcatttaacaagtgttagctttaactacattggaagaaaatttgttatagattacatgcatgggctttggggaaaaatgtttctctttattccaataattttaatatagaacttcattaagcacacaaatcagtgggaacatttgcttataaaaataacataaaccaaactaactttgcattttaaaaatcctcttgttcagttttgtgagctctgcagtcacatttctgatgtatatgctaatggtgtgttttctcacacgttatgtaaaagcaacctattatcttcatttcagattcagattcctgagtcaagcccctattatgacctcagtatggtattttttttactgactcgtttaatcagagcatgaactttgtgaaataatactgttttcccagttttatacataaggaaacaggcttagagtggttcgtgacttgctgaatattatgtagtcagtcagtagaggggctgacccctcgatattttctatttcctgcttttgaatggtgatcaaattagcttggtttgaaaatacgtacccaaaagggaactctattttcctctcaattctgcttttccctcttcccctccacctctctctctctgaaatggcaatgtcattcatttaactttgttttccatttttcacctctacatccaatcaggtccttaaaattcttcctttctttcttttcattactgtggaatcagctatttgctatcctccctgccatttccttgttcagattctcaccctctttctcctgaagaacatcaacagccaacttacttatcatcctgcctacatcctttcttcctcttagtaaaggctcttctgttcttcactaaaagacagatcaaaatgtcttaaacacaaattttattttggtacttccctatttacaatcatcaattggctcccctgtgctcttataacttccaaacattttaatagaatctcaaagctgatattatgcgtcttttttcttgggcctttagcttcattccttgtcactttccacctacaattctctttgacattctttgctctagagataatacatttctttaattcctagatggctgaacattgtcacttgcctttggttctttgaatattttatccctcctccctgaagcacttacaatgtgttctttttaaaaattgtgaaataaaacacacatacacacatacacacatgtgttaaaaagatttaaacacaatgtactatataatgagtaattacaaagtgaacccctgtgtatcctctactgccaagaaataaaatgtcatcaacattccagattcctccaattctcttttatattacattcttcttatcccctttcttccactccaaggacttattcaggctttgtggtgatcatttccttgcttttctttatcatttcaccaattgcacatgcattcccaagcaatacagttcaattcttcctctttttgaaataaataaccacactctgtgttttccttttttcactcataataatgtttgtaatgtttatacatgttttagagtgtatctctagtttcgttttcattattgcattgtattacattgtatgaacatagcctttaaaaaaatccattctcctctcgatgggcattttagctatttcccatttttagctattagaaataatgtcttcaggatcattcttgcatacatgtctcttggatgatgggtatccccataactctagaatatgtatattcaggagtaaaggagagatacatattttcaccttcactagataatctctacagctttctggaatatcactttacacccccacaattagtgtatgaaagttatctttgttctacccgtttccttcacctaatgtttatagacttacattttagccaatccggtggttgttcagtaacatctcattatggcttcaatttgtattcccctgattattgtattgaccattaaaaatctttgtttctgaagtgcctgttcaagtttcttgcccatgtttccattggtttatatgtattttcataatagaagagtttttaaatattttctgcatgctaattccttgtcagttgtatatggtgctcatttggtacctggtctttttactcttcttatgggttaaagcataaactttgatgcaaaattgtctgattcaaataatggctctatctcccttaacaatttgaactttggtaagtcattaaacttctccatgcctcttctgtaaaaatgagaatagtagtagtcctacctcacatggttgttgcttaacctatataaagcagtaaaaagagtgcctgaaacctaggaagtattatgtaaataaacatttgctgttctttatttttattttttgatcatgatttcttaattataatatagtcaactttttaaactttagtaacttttagtgttttattaagaacaaaaaggttctaaagttattaagatattctttgtattattttccaagcttactgctttgctttttaagtctacaatccaactggtgttaagtggttgcagcagaagtaaacttttattttttcttatatagataaaccattgtcccacaaccatttatggaaaagtttattttttttccactggtctgcagtgctacctttgccatataatgtacatttatttgtgggtctattttttaattggcctagttactcagtaccaatatcacattctcttaattactgcacatttattattgatatatgttgaagtagttcctgccactttgctctgcttcttcaagagtatcttcataattctttggttctttatttttaactttaagaatttttccatttaactttatgaatcagcatgtcaatttccacaataaaattggaatttcgactacaattttattgagactatagatcaatttgtgaagaattcacattttaagaattatgaaccttccaatctctgaatattgatacatattcctttatttgtgtctttaatgtttctcagtaaacaatatcatgttctcaattacatattcctttatttgtgtcttctttactgtttctcagtaaacaatatgttctcaatagacgtgtttgaaatattactagcacttggtatttttaaatactattgtgagttatagttttttttaatagttttctttcttacttttgtacataagaatccactcaaatttcatatattgattttgtagccagcaagcttattaaattattatactaattttaatgatttatatgcagtttatttttgatcttattaatatcatatctcttgtgaatgacagctttgttttcactgttttcagttcttttatcttttctctctctgtcttgccttattgtggtggttaaaaccacccaaacaacacttgaaatgagaagagttgagttgttacttatttcaataaagtctttattaagtatgatgtttgcagagagttcatagtttacctttatcagcttaatgttgtctccatttctagtttgcttagaattttattatgtatggatgttgaatttcatacaatgattttctgcatctgtggaaataatcatatgatcatatatatttcagttaatatagtaaatcacatttatttattttcttgttttctttttcttaatttttttttgaaactcaagtacacagaattagattaatcataatccttgattcaggaagctgtttcttctctagttcattcatggtcacgtttaattacttggttaactatttccaataatatgttaaatatgtatggcactgacatgcaaaacaatagctacatcactgacaataattgacatttaccttcattccctgcctaccaaagcaaaaatcatccaaaatatttattttcctttaaaaatattttattgtatctttcatttttatttatctttatgaaaaggcatcatagtggcattttcttttccacgtgatattatattgccaaattttatcacattagtgtctttgtctataattcattgattttgactgctgaataaaattctattaggtgaatatatgcaagttattcgttctcattttgaagagcatgtagtatgctttcaagtttttgtgattattaacagtgcatttatgaacattcttgtatgttaatttcctaatattaaaataacctacataatctggtataaacagaatttagtaatcttgcatcttactctccatatattgctagattcaattgccaatatttcttaagagtttttgcctctaggttcatatatgatattggcctctatttttcttttcttgcactatccttgtgtctctatcccgattatgctggcatcataaaatcagttggggattgtatactcttttccttctcaggaagggtttgtataaaaatagttattgatttcttgaatatttggtataactcaatgaaggcatttgggacaagagctttttctatgagaaattttctttattaattattcattttctttagttgttagaggatgatatatagtcatattctatttctgtcttcagtttgttttgatgaattatacctttttcagcatttgtccagttttttctacattttcaaatttattgcatgaagttgttcttaattttctcttagtatctttagagtctgcaggatttgtagtgatggcttttttatcattcattcctaatattggttatgtgtgcttcttttcttcattattattttctatagtttttcaaattaattattcatttaaataaactaatcttggtctttgttgattcattttattgcatgtttctttattttcttaatttctgctcttttttaattctccttatttcctacattttttttgctgtttcttttcattataccttgaagtgaatactgaaataattacttcacaggcatactttctttttcatatatgcatttcagtatctaagtattactttagttacatatcagcattgtttacttatctattatttatttctggcataattaaattgtgttagattatatactgtgtgtaatttcaacattttgaaatttgtcaagacatactttatatctctttatatatcatcactttttgaaaatctcctgatatgtttaaaaatgtgtattctgtattttgggagtacatgttttctatgtatccattaggttatgtttattaactgtgttcaattcatctatatttttaccatttttatgtgtctacttcttttagttactgagagctacatgtaagtgtattaaaaccctcaaatagtaatggagtccattttttcttattatgctaataatttttcttagtattttgaggacatcttaagtggtgcatagaatttgtaagccatcattttttgtcattttgaagtgattctcttcgtactctctctagatatatttttttgactttaaagtctgttttgtctgatattaatatagaaacaccctttttcttttgttgtcatgggtatcattttgcctactcttttactttcaatcatttaggatatttacgttttaaatgtttcctgttaaatgcacagttagatttttagaaacaatctgaaaatcttttttttttttggactgggacatttggcccatgtgcatttaatgtaaacactgatatacttggatttaaatctatcatctaaatttgtattttaatttttaccttttttgatgtttttgattggatcagtgtttttccacacttgcatttatactcccctatcagtataaaagttataaactctgctttaatataagaatttttaaaaatgtatccttaacttattaaagtcttacattcacttattttcccttcttccagtttgctttcttttattttaattcttttcttcatccattaacttgtctctgggatcattttccatcattccttctgcttgaagtaagttctttattattccttaaagtacaggtctgttagttacaaattcccaggtattgtttccttgaaaatgtcttactttaatcttatagtctatagtcattccaaggtagtctgtatttgggaattctaatcttgaagaatattttgctgactatagtattctaacttgaaattcttttttacattaaacatattgaatatacatttcaaagacatcatttcactctcttctggtttccattgtttctgttaaggagatggccgcttagtctgtcctttctctgtagctacttttgacatttactctctgtttttggtctttctcttttataatggcatgcctagatgtgaattttctgaaaattttatttatcattcttgtgatttcttgggattattgaaatagtagattggttttcattcctcagttttagaaatgttttagtttctagcatatatatatatatatagagagagagagagagagagcgccattgtgccattctcttccacttttctatctgaggtgccagttaaatacatattaagccttctttgtgtatgccctattctctgacactctcctttgatttctcccctcttaacattttgtctctccatgctatgctttcaataggttctcctagcctatttctagttagttttcttttcttctcttaaacctgttcttaatttcagccattgttttttacttctagaatttctatttgtgtttttgtcaaagctgccatatcctttaaaaagttttatctccttcttgaaattttaaaactgaatttttatttcttgactttctttcttagaatataataagcgtggttgtttaaatagtttgtctgcaaattctaatatttgaacattttgagtgaatgtttctattggttctcagtgttgatattttgttttcttgcatacccagttatcactggccctataataggcggtttatattttaaaaacactttatagcggtaatttcaggcataagaggatagcttctttttcagagtaggtttttgtttcttttgctagatgctacagattttcgtcaatacaagttcaaggcttgaggcatcatgaacaacccagaatgaagtaataaagctgggatgggagttcacgcaagggccactttattcaaagttcacctgtcataaggatgtagtctttcatgctcccaacttaaagtcaggaaggaattatcagagcccctacccttgtggataattcagctttcattttgaatcatgagcggttcaaggttgctaaaatcagagttagcaggtcccttccaagcagaactaggcttccttgcaaggccagtaatacctcactaccttgttagctctttgatgcttttaaagaatattctttctatatgttttgcaggctttttagtttttcagcaaggggtttgatctgtttcctagttccccattacttgaagcagaagtttcaagatacatctgattaaaacagtcacgtttcatctgcttagtttttcttattctttgagatgtgacagacgtcatttcttcagtaaaggcttctgaagcccccggacgttgttcgaataggttttttttttaccttcatagaatataattctttccattacagcacatattctacattgtaatttacacttgtttatataccccccattagtctgcaagctcctttaaaacagggactataggccaggcatggtggctcacgcctgtaatcctagcactctgagaagccgaggcaggcagatcacttgatctcagttcaagaccagcttggccaacatggtgaaacaccatctctaataaaaatacaaaaattttctgggcatggtggcatgcacctgtaatccccgctacttgggaggctgagtcaggagaattggttgaacccagaaggtggaggttgatgtgagccgagatcccaccaccgcactcccgcctgggagacagagtgagaccctgtctcaattaaaaaaaaaacaaaactgggactatagctatttttgattgtttaatcatcattatctgatataattcatggcatataataggtattagatacatatctgttgaataaatgaatgaatgccctattacatcagggcacagatgaaatagtatcagttgaaaataagttaatgcatttgcattatgcatgtagagaaatattatttttgtatgcattgagaatatactcaataaaacagttatatctgcagacatttattcagcactgctgtgtgaagagttttaggacactaaaactcattaatagaatcatgagaaaaaagagccatgaaagtaattctttcttacatatcatcatggctttgacttcaccattgaaatgattaaattctcacatctcttaaaaactgtgaggaaattacagataagaagtgtctgtgtgttttgcaacaaaacaacaaaacatttattagaaaagttaaaagagttgagcataggaaagagggtgaagcattacttaatgaaccagtttcgtgtgaagtatctttacaaatattgtaagtacataaggagaagagctttcaaactgatttttgtatgttaaatgttggtttagttgtacataatagtaaactctcagtaaaactttatggaagggaaaatagaaggaaggagggaggggagaaccaggctactaatgtgtttcatttttactaaatcgagggattttatacatatatcgctatgaaaaaactcaacctacctgggcacagtgatgtgtgcctgtagtcccagctacttgggagggtgaggcgtgaggcaggaggatggcttgaaaccaggagttcaagactgttgtgtgcaattatcgtgcttgtgaatagccactacactccagcctagggaacataacaagaccctgtctctaaacaacaacaacaacaacaacaacaaaactcaacccagttgcaactcccttcttaacgggaattcttatagcatgtaaagacaaaggtatttttcttttacccatctgtggagttcaaagaaccagttcaatgctggattcaactaacaaactcaaatggtttcaactagttgattaaaaatttttatcaacttatcttttaagacaaatgcactcaattgatcatggtataccacatgtgatcttttcttcttcttttcttcattatcttttgtgcttgatactgtatttctttgaattctgcctgaagttgctttagattattgtgacaatcatggcacattgtgcatttaaattgagcttattgtcagaaatatctgcattaatataggtttctccatttttcaatcccagtgtagggttttaaatttgcctttgttaaatatatttccttatttattctaggttcagagtataatttctagcttgtcacaatccgctttgtgattttgtctttcacggtattatgtttctcaactttttattagtcacaaatttcataagcgtatcttctcagtgtgtattcaaataatgggtgaaaatgttgaacagaacaagatcgaacacagatctggcaacttattagttctcccagcaagtatacagcataactcttactatttgttactttttgggaatggtaattcaacaagctacaactgtacctgtggcattaaggattgttctatcagaaaattttatcaaatacactgaaattaagatgttcctgtcacaatattcctcttatttatcaagattaaaccttttagcagcacagaaattgttatttttgtatgcctttctcttcttaaacccatgttggttcttagcgatctcaatattcattcaaaatagtccaaatttgttcagtattcagttatagaaactttctaatgagaggtatcaaatttaccagaatattgttttcagaagtatacaatggaaattaggacatttgatgcttttcacgcctgtagcatcttttctatcaacagttgtcaatggtaccagtatgacaatttatatgccagatatttaatatcacaaaatatagtcatatgcccacatgcacacatacacatgctctcatacactaaagagtgttataaaaaaaagatagttgctattttcctctttatctttataagtggctgagatactacctcatatgacttttttttaaatttcagttgtaaagatcatttttgatatataccaaataaatactggtaatttctgctttccatttgataaagtaacatattctattatttaataacttacagaaatgacttttgaatagaaaatgcatgcagatgaaaaaagatcagatgaaattaaaaggtatttgggtaaaagtgactgccctgctatattagcattccatttaactgagagtgacagaaacctatcagcaacagtgacctttaaaaagttcagaattgagccatgtattctgctgcatgatttatagattcccaacctccttatattttgctgcactgctatctttgccattctaatttatgggtcacagtagatgcttgaaatccagtttgaatcttcacattccaggttgtaggaagaaggaaggtgattatgaaaggaacatgtctctttctccttttaaggccatttcccaagagttgcacatatgactttcatttataccctgttggctcaaatctagtcacatgcctgcccttggtgtgactgccacacacttattgaataatcaagtgttctgttctaaggaagaagagggaacagatattgcaacaattggtggtctttgctatcctctccttatctcccagttacccacgacttcttcccagaaactgtggctaatttcttttgtatcacttaagaaatcggtatgtatatgtttgtgtgtgtatgtatttatagacatatgtttatgttaatgcttttttatttcttgtatataaatatgggagtatatcatagagactgttttgcacaacccttttcatttaatgatatattttggagacctttccacattttatagaaaaaaacataatttattaagccacttccctattaataccaatttaagttgttttcagatgtttgcagtgaatatcaatttacatatattatttcacagttgaatgaagctatatgtatgttcctagaaatttagctcttgggccaaagggatatgcatttttaattttgataggtgttgacaaattgcttttctaagttgtaccaaatctccccactattgaatcatgcattggattagagtcttcccttgttatccgtgtgaattggtttcagagcccttgtggataccaaaatccatgaatgatcaagtcccttgtataaaatgccctagtatttgcatataacccatgcacatcctcccttacactctgaatcatctctagattatgtataacatctaatacaatgtaaaacacaatataagcagttgttatactttattggttttttagatgtactattttttattgtgttttttttttatgctttttttccaaatatttttgatctgatgttaattgtatccacagatgtggagcctgcacataagaagggctgaccatatctgataatttgggctttgtcagacacttttaccaaaacagtataatatcaaaatttttaatccttgtctttgatagattaaaaagacatagtgattccttgttgttttaatttgtatttttcttactttgaatgagattgataattttcttattatttggtgatagtggacaattttttgccacgcagaaatattttatttttacgtgatcaaatctatcaacctttctgttgatgacttcgagaatttgttattattagagcgctctcctactccaagattatgaaaaacattttctctttggtttcttttggtagttttgtgcctttatttttgtgtgttgaggcctctgatccatctggaatttgtcatatgttatgagataagaaacatgccatgatattttaaagctggcaaaacagtagtcccacaacaatttgttgaatgattcatcttcccccacagttttgatatatcattggcattatatactaatctctggacttcctagtcttctctatagatccatttttaaaaatctttctatgcatactaaattgttttaatcagtggaactttataaaatattttaacatgtggaggaatggtccccatttattttttctttttcggaatttgcttggctattcttctctttcctgtttaaatttgagaataagtttatgttacttacaaaataaggttgacgtggctctgtttcttccttcttgctctgcatggagttcagaaatctctttgtgaatatttaacattctcctcaagtctcatcatgttttccagtcaactcccagataatttgtcttttttttttttacttttattttagattcaagggtacatgtgcaggtttgttatataggtaaactcatgtcatgggggtttgttgtacagattttttcatcacccaggtattaagcctagtacccaatagttattttttttctactccacatcctcctcctaccctccaccctcaagtagaccccagtgtcttgttcccttctttgtgttcatgagttcttatcatttagctctcacttgtaagtgagaacatgtggtattgggttttctgttcctgagttagtttgctaaggataatggactccagctccatcgtcatccctgcaaaggacatgatctcattctttttttatggctacatagtattccatggcgtatatgtgccacattttctttattcaatctgtcattgatgggcatttaggttgattccatgcctttgccattgtgaatagtgctgcagttaacatttgtgtgtatgtgtctttatgatagaatgaattatattctatctatatatattatattatatctatatgtatagatatccatacatattatatatgtatatagatatctatacatatagatatattctatctatatattatagtctatctatatattatattctatattctgtattatatatatgggattgctgggtcaaatggtagtttcatttttagctctttgaggaatcaccatactgctttccataatggttgaactaatttacactcccaccaacagtgtataagtgttcccttttttgtgcaacctcgtgagcacgtgttgtttactttttattaacagccattctgacttgtgtggtatctcactgtggttttgatgtgcatttctctaatgatcactgatattgagcattttttcatatccttgttggccacatgtatgtcttcttttgaaaaatgtctgttcatgtcctttgcccacttcttaatggggttgtttgtttttctcttgtaaatttgtttaagttccttatagatgctagatattatacctttgtcaaatgcctagttcacagatatttcctcctgttctgtaggttgcctgtttactgatctttgatttttgaatctctcttgtatttatttgtatgttaccttttcaatgatagcattatcagatttaggtcagaatagaactaatgtctttatagaatatctagaaatgggtcaataggtcattatcttgtatactttaacaacagactcaattagaaagctatacctgagagtttacacactcctgaaaatgtaaaaattagattaaatactaattttaaataaataataactaaagtataaatgcattcaaaccagttatccttttttaaaatttaattgacaagtaataattatatatatttatgaggtacaatgtggtgctatgatacacacacgtatatcatagaatcattaaatcaggcaaattaacatatctattatttcacacacttatttctttgtgatgatacacttaaaactccttcagcaaattctgaaatataaaatacgttattattaactatagtcactgtgctgtgccattctgatcgctaaaacttattcctcctaactgaaactttgaaccttttgactgacatcttctctttccccatccaccccccaccctcccacctctggcaacaatcttctactctctacttctatacattcaactttttaagattccacacataagtgagtgagaccatgcagtacttgtctttctgcgcctgacttatttcacttagcataatgttctccagattcatccatgttgtcaagtgacagaatttctttcatttttaaggctgaatagtattctgctgtatgtatatacatttcctttatcctttcatccatcgatgggcacttaggttgatttcatatcttagctattgtgaataatgctacagtaaacatgggagtgacatatacctttgacatactaatttcaatactcttgtatatatatccagacttggaattgctggatcacgtggtaattatatttttagtgttttgaggaactttcacatggtttttcaaaatggctgcactaatttgcattcccaccaacagtgtccaagggctcccttttctctacatcttcaccaacacttatcttttgtcttcttgataatagctattctaacaggtgtgaggtgatgtctcactgcggttttaatttgcatttccctgatggttagtgattttgagcattttttttgtctatctgttggccatttgtatgtattttctccacccataatccaataatttttattctagcaacacaaaacaattcaacattaggcaaactaatgtgtttgtcttttttggataaatgtctgttcaggtcctttgcccatttttaatcagatttttttttcttaatattgaatagtttgagttctttatatactttagacattaaccccttatcaaatatattgatttcaaatatattcttccattacacagattgttttttaattctgttgattatttccttggctatgcagtaggcttttcatttgatgtcatctcatttgtctattttgtctttaggcaactggtgatcgtatacaaaaaatcattgcccagaccaatgtcatggatcttttcctcagtgttttcttctaattattttatagtttcaggtcttaggtttaagtctttaactcactctgtgttgacttttgtatatgaggtgagataagggtccaattttattcttctgtattttggtatcagtttcctcagcaccacttatgaagatactgcatttccttattgtatgttcttgtcttctttgtcaaaaatcaattgactataaattggttggcttattcctaggctgtctgttctgttccattggttggtgtgtctattttatgttagtatcatgctattttgattattataaccttgtaatatattttgaaatcaggtagtgtgatacctctagctttgttcttttggatcaagactgctttgactattcagagtcttttgtgattccatacacattttagagtttttagagtttttttttctctttctgtgaagaatgccattggaattatagtagcaattgccttgactctgtagattgttttgggtggtatagaaattataactatgttaattattccaatccatgaacactggatatctttccatttatttgtcttttcttcagtttctttcatcaatattttatagttttcaacatacagatttttcaccttcctggttaaatgtacttctaagcattttaatttttgatgctattgtaaatgggattgttttttaaaatatttttcaaatagtttgtttttagcatgcagaaatgttactaatgtttatattgattttatgtcctgcaacttaactgaattatttatcagttctaacgtttttttttttgttggagtctttagtattttctatatataagatcaagtcatcaacagaaagaatttcacttcttcctttcctatttggataccttttatttctttcaatttacttatttaaggaaaaagcttagggagcaactaacaaaatgctgctgagaactctggatagtatagtaagatgactaaagagagtgcttgtggtggacattagaatgattgttaggaaaaaatcagtcaggaaaacagaactttctataatcccaaattagcctacagttattggttggaaatgaccatttaaaagaaatacattttatatacaatgtacatagcatcaaaataactccgtatgggaattatccaaaacaattattgtatgcaccattttttaaaaactacttttacttgttctaaattaggttagagcattaagaattttaatttgatcagcatctacagactaacaaagagataaataaatatgagaattataagctcagtttctcaagctgagtcatattacattaacattacttacgtatatctaatttttatgaaccatgcataaaggtaggagttttatttttgcaagtacagtaatggacactttactattttgatatatgtttgtaaaagatcttaagaaacatttagttttccctccctagtagaactaaataataagatattctgggttttatttttatgtaatagaataaaataaatttatatgttttcttacaataaatacattaaccacaaggagaattggaagctgccagaataaggtattaatatgtccacaaatgtttatgctcttcttaaagaagactgtttgcttttgccttgaaaaatgtatttttcgctgcttttttccagcattgtaacttaatttgctgcacactgtattttaaaaagccaattcagataagatgtttagtgtcatcatttagacatgccactttctcctgctacaaggaatttaagtgacagcaatatatgttgaacattttctgaaaacacactttttcttttaatatatacacaaactcaattagcgtccaggtcagtcagtggaaaggcatttatagaatcaatcattttgggttaagaagtagacaccctgcaagcttactaatggaatggaaataatgcctggaacctctccaaacagtaacagtctcaatggagcaattaaatatgtatgaagaatgtttgctgagaagttcgaacacatcaacctggggtttatatttgtggtttaatttattcagcaccttccagtgagccgatgcttgatggtctaaaaacattgctgggccctgcatctgttgcatcctgcacagagttttgagtgacagtcactcagaagcagtggttatttttaatcatctcaagaagtacaggcagagaggggagaatgggagtttttgatttgcatttagatacccaacactgcctcattaataaatttggcactcttaagagtatgtcaggcaatcttcagcccatttaatagaaagtattggcataggcaaaactcctatttctgctcacagcagtggtatttaggccttcaaattacagttcacttgtatgattgctgcaatctgtatcttcagatcattacttttctctctcaaaagcgaagtctgtatggtactaactagctgaactttatactattaggaaataatggtgctactgtgttataataccaccgattaaattatggaaaaatttcagggggagatagcaacaggatgagacggcaacattttcttttatgctcaagctttgtttttaaatgccagagaaacaaggatatattttttcttgttttatttttaaatttataattgatacaacaattgtacatatttatggtgtgcaatgttatatttcagtgcatttatacatcatattatgatcaattggagtatttaccatatccatcactttaaacatttatcctttctttgtggtgacaacattcaaaatcttctaagtatcctgaaatatacattacactgttttttgctaaatggcaaacagatgtatgaaaccatgttcagcatcactaatcaccagagcagcgcaaaccttgacctcttaatcggccctttatcatcacctatgccccaaccccatgccagggggcagtatttcacaggaaggaactttcagaggagccaactctgcctggaccagtcgttgaagaggttagtcctggggagagggtgctgtgatagcctggggtctgacactcaccagagggttgggctggcagcagaatgctctctctcccaccgccttgcctgtggaacctcttatgccaggcttgtctggaggaaatgagttctagcttccatgtggggcttgagggcaagggaaaggtagggtttgagatgagaatgaggacttgggttatgctaacagcttccagtttgggtctcaggttctgactcagaagccaagtatgaggatatagcccccagttgggcggggagacaggatcacagggtttgggatgggtggactcctctcaatcgtgtggttcagggaacaaaccctgagcaactagacccagatgggtgaatttctggagaatttgatgctattgccatcactatcagccccaaggcttccattatacccagtcttggggagggtgcaccatttacatagaccaaacatgaatgatgcttcctggagttggctaattgaccgatctgtaccctgaactttccttcctatggcagacattgctcatcaaacacagtttatgttcagtttagataaggactagagtccttctccacatggggctgcagacaagccctgccaattcctcaagatctccagctcaagagtaagcggttggccatcactctctaatgaaccttgatgagcccccaggaaacacagaggcacctccagtagccctggatgatgcagacagcattgaggatgtgacattagcgctggcagatgtggcacatgtgggctagggactgcggtgtgactgctgcccactcctcccgtgagaagtcctccaatgctgcctgcccactgcctcatctccagaatcctggacagtatcagccaccatcagcactgaatgatccaggtgctgagggctgtgttccacagtgcctgatgcaccagggtgccccaacaccaggcttggatcttgatgactgccatatctttgtcagagagcttcttttggttttctgggggttttccaaatttctcattggcattagccactgtttgtgtcttaaccagagccagagttttggcctctgccttcaactttgaggttaatggtcccgaagaaaaatgggccagcatgtccttctgctcaggctcatcttttgtgtgtgtgggtttattcatttttttaggctgcttcctattagttctgttctgcaagttgtacaggaagcatggtgctgacatctgcacagtttctgaagaggcctcaaggaccctttactcatggcagaaggtgaagcggagcaggcatctcacatagcagagcaggagcaagagaggaaataaagatatttaatgtagggaaaggttgggagggttttgtgtgtgtgtgtgtgtttccaggggtttgtattcaaatgtatgtggtatacaactactaatatcttgtcgaagttacatgtttattattctaggctgaggtctgcaggagatagaattagcaaacaactagaatccatacaacgggtaaaattccaaatatggtcaagattttgagagggttccatggataggaagaatcaatatcatgaaaatggatatactctccaaagtaatttatagattcaatgctactgccatccaaactaccattgaaattcttcacagaattagaaaaaactacgttaaatttcatatggaaccaaaaaagagcctgtgtagccaacacaatcctaagcaaaaagaacaaagctggaggcatcacactacctggcttcaaactatactacaaggctatagtaactaaaacaccgtggtactggtaccaaaagaaacatatagatcaatggaactgaacagagacctcagaagtaacactacacatctacaaccatctgatcttcaacaaaccatgtaaaaacaagcaatggggaaaggattctctatttaataaatggtgctgggtaaactggctagccatatgcagaaaacagaaactggacccattccttacaccttatacaaaaattaactcaagatggattaaagacttaattgtaggacttaaaaccataaaaaccctagaagaaaacctaggcaatacgattcaggacatgggcatgggcaaagacttcatgactaaaataccaaaagcaattgcaataaaatccaaaattcacaaatgggatctaattaaactaaagaacttctgcacagcaaatgaaactatcatcagagtgaacagacaacctacagaatgggagaaaatttttgcagtctacccatctgacaaaggttcaatattcagaaactacaaggaacttaaacaaatttacaggaaaaaaataaacccatcaaaaagtgggcaaaggatatgaacagacacttctcaaaagaagacatttatgtggccaacaaacatatgaaaaaagctcagcatcactaatcattagagaaatgcgaatcaaaaccacagtgaaataccagttcgcaccagtcacaatggctattataaaaaagtcaggaaacggtagatactggcgaggctgtggagaaataggaacgcttttacactgctgatgggaatgtaaattagttcaaccattgtggaatacaatgtggcaattcctcaaggatctagaaccagaaataccatttgacccagcaatcccattactgggtatatacccagaggaatataaatcattctactataaagacacatgcacacatatgtttattgcagcagtatttacaatagcaaagacttggaaccaacccaaatgcccatcaatgatagactggataaagaaaatgtggtacatatacaccatggaatactatgcagccatgaaaaggaatgagatcatgtcctttgcagggatgtggatgaagctggaagccatcattctcagcaaactaacgcaggaacagaaaaccaaacactgcatgttcttgctcctaagtgggagttgaacaatgagaacacatggacacagaggggaacaacacacactgaggccagtgtgggcagtgtggggcgaggggagggatagcattaggacaaatagttaatgcatgcggggcttaaaacctggatgacaggttgataggtgcagcaaaccaccatggcacatgtatacctatgtaacaaacctacacgttctgcacttgtatcccggatcttaaagtaaaataaaataaaaataaaaataaagattttgagagggttcttggtcacatgattgctctggtgcacgtcttgactcagcattacatattgtcttgtccaagatgccgtggtgtcatagggttgagggctgatactccagagtgaatgacacctctgatggatgcactacaaagcccagggattcacctttgaattagatttacaacattattaaaggaaaaagctgaagtatcatcataatttaatgggatataaaatgaaaacaggtcttctaaaatggaaacttgaaatcccagggaggcatttaaaatgtggttactgacagatctgtcatgccaatttatgagatgtgaaagcttgttgctttcaaagcctctttcaggacactggtatttaaggcctctaaggccatcggttggatgctttttttatattgatgaaatcctaagggtagcttataagatgatagatttagcttcactgagaactggcatttaatcatctgtgatagtaacatgaggccaagtgtagtatgaccactgccctacgtcactaaggacacattttacagctcattactttatatgtaagatggatttaaaaaaagtatatattggattaatttataacccaaaccacagaataattggaaatatcaaataaccttattagctgacactgaatctaccaacagtcctaactagtctttgagttagtaactctataccctgggtggtcaaagaaaatatttaaagtcatttatttacctctacatatgtcaaacaaaaatttcagaggccacaaagaaataagcaacaaacaaaaacattcagcattagcttcttaaaatgtggattggatcagatcactcttagaaactgttactatcttagtggtaacttcctacccagagatcaccccacccctccttcactactcccttactgcagattccttacttacaggcgaaaaaagaaaaaaattgcgtacttcttagcgtaatgttcaaggctttacagcatctagctcatccttcattgctagccttttttcgtctcttgacatatcagtgcttcaatttatctacagtcttctctcagtttcacaagcttgctgcatgcttcgtctctggtgactctgatcatgctctacccttgcctacaaggcctttctcctttttttccacctattaaactttatccatatccaaagattcagcctgtggccaggcccagtggctcatacctgtaatcccagcactttgggaggccgaggtaggcggatcacttaagtccagagttcgagaccatcctgggcaacaaagcaaaaccccgtcctattaaaaatacaaaaattagccaggtgtggcagcacacacttgttatccctgctgcttaggaggctgaggcaggagaatcgcttgaacttgggaggtggaggttgcagtgagctgagatcacatcgctgcactccaacatgggtcacagagtgagactctgtctcaaaaacaaacaaacaaacaaacaaaaaacaaaaagcaaagattcagcttgaatgccattttttgtgaagtctgctcccaatccctattatgtaatcagggctccatcctcttcatttgcacatcccttggttaagtcttatagaatagttgtctaggatttggctttgatgtttacacaggtttgatttatactgggatggaatccctttatcagttacataacctggagcaccttattgaaccctccaagcttcagttgttttccccacaggactgtgaaaagtatctagcgggatatttttgacacagaggaggcattaaaggggcagtatggacatgtcagtcccactcctgtccaggaaaaatttcactacagaaaaaatgaggataataaagcttctgaagtaaaatttaatggttgtggttattaattatttagcaaagaaaagaagaagaggtcggaaaaagaggaggaacagaaaggagaaagaggagaaaaaaaggaaaaaagcaaccctctaactaagaaatattactgctgtgtgaaacacaaatgtctataaaccaagtgaatttttggactgtggtttaaaatgatatgtttctaacattatctttctactttatgtgtaatcacctgtcaaaacacaggaaaagaataactaattaaacattaatgaatagggggagtgtgtgtgggagggagcacatatttaacctgttagatttattttttaaattatatgatcaaaaattaaaacattatgttactggtccaagaatcaagagacaggataaatactgctaaaattttcaccatatttgaagggatgttcaggatgatgaacttaaaatgttgtcttttatgatttatgcaaagttcagtctatcctaagggaacaccttaaaaggagatcagtaatccactcaaaatcctaaagctgaggtcgacagagggtaagaaaagacccgatatgagcctccccaaattgaaagccacagggcagagatgctgaatttcagttgtgggttataaggagctcccttttcccacagccaaatctagagattagaatccaggattgcttgattgggtccattaactcagcaggtgagctagtgctctctaggttccttgtgtgcttagtttatgccattttcacatcatagtgaagctgacattattgttatccatgctttacacttagaaaatgtgggcatacagagatcatttgttcaaggtgatgcactagtaagtggtaaagccagttataaatccaatgtgacttcagaacttgcataaaagctactgtgctatactgataattcctacacacacacacacacacacacacacacacacacacacacaccttctctctctcaaagaaacattacaaaactgcagagaacatttctatcctcagtagagaaacttggaaaatcatctatttggaaaaaagtgaagtttgatcatcattttttttccccttcacctcatttgaccaaaaaaaaaaaaaaaaacatagaagcaggctaaccaactcaatgacaacaataaccactgtgaagcaaaaaataaaaaataaatatagattacaatggcatatgtgtgaggagttgagaactgtaaaagatttctaagcctaaaaggaaaaatcaccacaagtaaaaagatttatatattgaactacataaaatatatatattcttgacagaaaatagttatcaacaaaattgaaaatgacttacatgctagaaagttgtttttaattagtatgaagaggattaatagtctcagtagatgagaatcaatcaattagaagaacactatgaagtagacagtttacagaaaaatgcatagaaatgacttctaaatatacaaaataaaaacctcattattgataacacaaaatgaaatgaaaactctaagtaccattttcatctatcaaattagcccagatttttaaaaagtttttactagaaaagataaaagtaaacattctcatactctactgctagagtgtaatttgaatcaacctttcaaaaaataaattttataatatggaaaatatccataaaatagtcatacccttgattcagtaattattctgcttctaggggcgagtcttaagaaagtaccagatatatatatatatattttttattatactttaagttttagggtacatgtgcacaatgtgcaggtttgttacatatgtatacatgtgccatgttgatgtgctgcacccattaactcgtcatttagcattaggtatatctcctaaagctatccctcccctctccccccaccccacaacagtacccggagtgtgatgttccccttcctgtgtccatgtattctcattgttcaattcccacctatgagtgagaacatgcggtgtttggttttttgtccttgcgatagtttgctgagaatgatggtttccagtttcatccatgtccctaaaaaggacatgaactgttcatattttatggctgcatagtattccatggtgtatatatgccacattttcttaatccagtctatcgttgttggacatttgggttggttccaagtctttgctattgtgaatagtgccacaataaacatacgtgtgcatgtgtctttatagcagcatgatttataatcctttggatatatacccagtaatgggatggctgggtgaaatggtatttctagttctagatccctgaggaatcaccacactgacttccacaatggttgaactagtttacagtctcaaacaaatttacaagaaaaaaacaaacaaccccatcaaaaagtgggcaaaggatatgaacagacacttctcaaaagaagacatttatgcagccaaaaaacacatgaaaaaatgctcatcatcactggccatcagagaaatgcaaattgaaagtaccagatattaactaggatttataatactgacatataacactgacatatatgacatatagtaactaaatgtctaataacgagtccaagtaagttagataaatttatatcatggaatattacacagctgtgtaagatagcatgtttgaatgatagtgtgtttgatttttcttaaaaatatccacaatgtaagcagttaattgtaaaagcaggatataaacttggacatggtaggatcacaatttggtaacacagacacatgcatacacatatacatgcataggtatagagaaaatacaggaataaaatacagccaaagaataacaaaatactggcaaaaaatcaaccactgcattactggagggataatttcattttccgctatacccttttctgtgtttttctattagcatttaaaaaatattttttaacatggaaaatatgttttggaaaacaatcctcatatttcagaaagagaatgtcattactggacactgatgataactatagtattgttgttcagtgaagcaaattattaataacctgactcagaaagccaatccagaccattcctcatatcctcaagcagattttatattaaattatttatataagtcatttataactcatattactaaaaacactagttaggaacatcatttgtggtcagcatttttgtaaaactttaaattaaaaataaacataaacacatatgtacacactatgtgcatacatatacacatacatacccacagaataaggatatatataaatttatgtatacttaaatttatataaaaattttatatttacacatatgtgcatataaaacaatgtatgtatgttgaaaggaacaagacttttgcctgcttttttattgcattggtcagatatatggaatctcattattatatttaaactacttactattgaatgtggacccaaaatgtcatgttttaaccttttaaatatgaaggaaggaagaaatatgcaatcacatatttcaataaagttaaattccatttcaggtttcatctcattatttataatttgatcagattcacaagatgaaattactcttataaataatacatggatatttcatgtgaattttgatgtagatttatacaatgtggaattttgctgctatagattactatgcattcttgagttttatgatgaaagatatatccagtagtaatataatgcaataggaattgatatgatgtcagaaaccccaaaaagtgtttgcagatgcaattaaaatgtataaaataacatgggctttcatcttacttgatttctgtttctcagaatagcattatttaggataatcaaagaaacgtttgttttaaaaaatcaatacccttgaagcatcatcattatttttaaatatgtgcaattgtttctacaggttattgattttacctgtctcagtatataatgattgtttggttttaagtctttcctaaaagggtttgtaacttggccattatttacacatatatgttctatggttactgccttctcttttcctggtctgtgactgggtccctgctgaccctgacaaatgacttttttattcctcctagttaacccttcttcacataaaggaagaaaggatttatgaaatatctattgcatactagatgtttatttgtatgtgacttgatcgaatcctcaaatagcctatatgctaggtcattggagaacacatcactcaagcaaagaagaaagaggcagagagaaggagaagttgcacacccatgggaagagttttcctcttacggtggtttagaagtagtcctgctgccctgggctcaatattatgtgcttgagcggagccgtaggcatctgcactcctatccatttgctgattcttctcacccttttgacacgttgactctctctctatatataggtgtccactccatttgttgtttgtctttaccattctgttttgggattggagctctgtctcgaatccagatcttgacacaatgtctagtccttttagccatctccagtagaggaaggaccttgcctgtcatatcctcaactacttgctagggttgtgtcttcaaaggactggtagcttgaaacaatagttgctactaatatctgatttcgagtttctcctctacataaaaccttttctcctgaccagaattttcactggtattggggcaaattgccatatagatttcattgtaaatcactacctttggcatcctaaagccaaatcaactactccaacatagatcccacttgacacccatgtctctggtgctgcaccctgaataaaacacattatacaggagacacagcttattttacattttcctctccgaacaaaaatatatcatatgcaataaggaggaaatttatgagaaaatatggtgtttctatttttaaataaagtatatattatgcacatatgtttttggattttgccagaattatttttgacataatctttctgaactcattgctattaagtcataactatgttaattttagtagtattctttagaataatgttaatccagtatatttaaaataaatagattaggaaacctggagattattaatatttattacctttatgagaagacagaacatagtttgaaaattacctttttcataatagagatttaattatcttttcccaaggaatttctttatcttggcttagctttgaattcaactctgtagctaccaaagcattaggtgggcatttatcaacaaaatgcattttttatgtaatttttgatgctagatagtacaaacccctccaaagcataaatgacctccctgttcattctattacattcaaaaatgtttttatatatttttgacattagttcctcttacctcaggtaattactgtctatgtataatgagcagccgtggcctcattgagtaatggctgttctatttctttcaagagtttaaaagacttgtagctcatatggctgattatgaagtttcattcacttatggaaaacattttttcttcttccctcatgacatatggtgtgtattctagagaaatatttttaacattaaagcatcaccaggaaaaaaaagattagagtgttttgacatttctgttatttaaattcttaacagaagaaaaatcaaccttgttaaatgaaagaatctatatttattcaaactcttttgaaaaaataattaaagattggttcaaaacatttgtaattacattttattttggaaagcttttcacaattcaatagtcagggtttcttttaagtcatctcagtggagaatacagctatccttgagaatcacatataaactttacagaattagcaaatgtgtagttgtggctgtgtccagagactgctggaacattgagatgaatattgatgaattcagccagatgttcattaatgttcattttctaatacaggagccattagctacatatagctactgagcacttgaaatttgtctgaattgagatgtgctgtaagcataaagtcaccatggatgtcaagaattcattaagaaaaaatataaaatatcaaattcataattttaaattgattttattgatttgtggcttgtgttgtatttctgcctttgtatacaaaacatttgagtaaaatataaaaatgtacttcacttttcatattagtgttctgttatccctttagcatttcccatgtcattgtttcttactaaactgcataggaggtacagcagctccgctaatggagtgagctctcttggtattgaggtggccagcattatactaaatgttccagctatatagcaacctacaatatgagtccctacaatgtgctgtgtgaattatataaattatctcacatagtcttcaccatactctatgatgtggttattataactgcagttttaagatgaggaaactgaatctcagatgattcaaaaacatgtttaatatgattattacaaagcttactaaagggactgagtcaggattcaaagcaaagtttgtcagtctttatggtctcactgcgcaaatacttttctttctattttaagactttccaggaaattcatgaagatacggacttctttcaaggagttatgttaaattgatctttgggaatgatgatggtcattacgataattgtcggtaaaagttacacaagacttctccaaccttagtaggtaattaagtatgttccacaaggaatagtaagtgatggcattcactgaaataggaactttatctaaatgtttccatgcatccttattgttataatgagtaaataataacagtggccatattaaaaatagaattaccctttttgaattaaaattatgtatttgaattagaaaaaaagcatttgaaacatgtatttttaaaaagcaacaagaactcgttataaaattatttgtaacctggcccacatttagcactactgctatttgatgagttgaagaatgaaggacatcagtttatgtaatgatttttagttaagaaccaatcgtttcttattttaaaaaccgccatgaaaaattttggagatttatatgatatctgagaacatttagaacaccatgtgaaacctcccttgactaggttctgctaattggtttcactggtcagaattggctgtggacattttccctactgctcccaggccaacgtagggaccgatggtacaagaagcgtctttccatgacacttagctcttctgtccagaagacctgccttggccactaaggccattattgccacagatatctgcaggttagtgaaaggtgagaaagcatgttcttcagcaatttgagttaccaccgtatttacactggtaatttttatggtaatgagattgtgtcttacagactcacttgtgattttttgacttgccctctggctaagtggagtctaaacctttcctcatatgctgcctcggccatcaggtgcacaagtacaaagactcctttcatgatgagaagctgtgtgatttcaaatgaaattgtacctaaaggatgctgtaattcatacttacaaagaaaaagtgcttactagtaaataactttccattttctaatatcctctatttttaatccattggtaatatctattattaacctctatggtaaatacaaaaacaaatagaaacatacagtatttattatttggtaatataagggaaaattgctctagtcataaaattattttaaagttggttactttggttatcatttgccccagcatgtacttcagactacatgagtttagaagggaaaaacaaatatctgtttacggatagagattagttttgttttgtcttgtttaaaaccatcctccaccccttcccaccccagctagtttcacagtggaaaaccatgtgcaaatcatagatcctggcagtgagaggagaggcagatgggcataaatcttgagatttaagtatcttaatcagactccacaagtaaaaagagagacaaatttttttagcaagctgcttttaaaatattctattttgtaattgtgagtggcacattgaactttatatagcatgtttcttgtataataatctctattaactgataactatgtcctttacaggacattatccaattatgtcttggatttttaaaatagattttaaaattgtgagtatatacaagttacattaatgcgtattggatctttggtccatcttaaaacatttttttaaaaaaatcaattaaaaaatcaataatgtctataaaacagaaattatttatggagcaatcttataggcacttcacatgattaactcagtaaagaactgaagggtggcttatcgctatctcagatgaagaagctaaggctcagaaaaggtaaatagcttgcttttattattgcttaatcagtaaatagtaaagattcaaacacgactctgcctaactggaaaactaatgttctcacgtgctatctgatttaaaatatcaaactataatgtggaaaatgcaaaacaattctgaaattttggtatttatgaaatcagtagtctggatttttttgcacaatggataaaaagctttttgatattactgaggatttgggctgtcttggtactgctttggcttcaaggtttatattttaaaaaaacttgatgctacagattcttatcaatagtatcgctatggggagaagtcatattaaaaaaataaagcttaaggaaacagtccaatttgaataataggaacatagatggaaggtacgatggtgttgaataatcctgctgttgctattatgacatttcgcttataaagaaaaccacagtaattttcccagtttagtggtaaattgagaagtaggaatctctgagaaaccttcacatgcgcagcattttggatggtgtttggaacaaagcattggagtgaaattcaattaaagcaagccaggaagcccttctgaatgaagttctgaactagcttttcctttacaccctgcaagattcatcttattgtaattctctattgatttgggtatgaattacaagttaatgacttttgttcaaaggtggagaattaccttgtttaatgaaatggaatgtaaacagccaatgtttttgctattaaaaggaaatccatgtggagtttttataaaagaaatacctgtaaggattaatgtaggtgtgaaccagcttctccagagactttcctgaatattttatgcaaaaagtaagtcctgcctttaaaataaggagaaaaaagtgtaaaaggttatgctgactatagtcaataggctaaaattttgatagtaccacaaatttttccatttgtacacacacactatgcggtgtgtatgtacatgtgtgaattccagtgtctagtatatactatactcatacattgtttagttttaggaagctatgtaatataaatatagcaagaaaactttattttcccttggcagaaagtagaaaactgaagagagagttaaaacatgaccaaggatcctgtggttattctggtagaaccagtaaaacagagaagtctgttcattcgtgttgcttccacaaacccacgtgtttgatggaaatgaaagaggttatcttgtccaaactataaaagtataaaagaccttcatactaagatagccaccagagtaaaaaagtttcatgtgatttgctgtcatataattctgtagcagttaaattaatgtgatctaccatgattttcattgcatgaggttcatttacttatttatttatttttgagatggaatctcgctctgcatcctgggttcaagcgattctcctgcctcagcctcctgagtagctgggattacaggtgcgtgccaccacgcccggctaatatttttgtatttttagtagagatggggtttcaccatgttagccaagatggtctccatctcctgacttcgtgatccacccgcctcggcctcccaaagtgctgggattacaggcgtgagccactgcgccccgccgaggttcatttttaatattgctgtcttactaaaatgaagcagttactttaagaatggaaactaagtaagaaaaattctcacaaccagactttgttttaatctgtgctctattttttatgcaataattctttattgaaattgtgctttttataaggctgtgacttttcttttgctatgtcacagacaggcaatgacatttataagttaacactttaaataggctggtgtttgaaatagcattttcactttgaaaagttaataatatcgtgaaataaattctgttgcttttatctataacaaagttttctcagaaatctgcttctctgtggtgtttctttaatgtggtcaaaaaacatatgaaaaaaagctcatcatcactggtcattagagaaatgcaaatcaaaaccacaatgagataccatctcacgccagttagaatggtgatcattaaaaagtcaggaaactacagattctggggagaggatgtggagaaataggaatgcttttacagtgttggtgggagtataaattagttcaaccagtgtggtgattcctcaaggatctagaatcagaaataccatttgacccagcaatcccattactgggtatataccccaaggattataaatcattctaccataaagacacaagcacatgtatatttattgcagcactattcacaatagcaaagacttggaaccaacccaaatgcccatcagtgatagactggttccttacagaattgtttttaaaaaacgaaataacttcttcatttgttattttcatcacctttaaagcaagataatgccacttagataagaggggtaattagccatttgattgatctgccataataatgctacacattctttggacttatttgtcattatgcctctcataagaaaagataatggaagaacagaccactgtgcatggaaaatataaatataaaatatacagtctcttcactttgtaagataaaataatcaagaatacttttagttcataatttatttcagtgaaggtgcatttgtatcctggaggatcatattaatattttcagagcaatagaattgtgtgatgttttacaacagttctactcaattagaatccctgttttatgctttaaaatgttgctatgtcagtttcatggctttctaaagactttagagttctcagtatacctacaaatagcaatgactgtctacatatacaaaagattcagtgaatatggtaaaactataagttgatgagtgtttaggagataacctatttttttctgacaagtttgtttttctgtctatttgatcattgtttttcatctttgttgtttacctggatgatctcccactagctggaaattcaaaagccatttctcagtgagccctctcacttccttgattttataactattactgaagcttcaccctaagacagttacttttccctcaccaagcacaaatgtgaatgtggtgttgtaccttcagaatcccctatcagctatgctagtcccctccatatttgttaccttaactctgtggctctcaggacactggagccagtgtttctgtgaggtgggtatttgtgaaggaatatgtagactggagaaggctactcacagatccctcagataagaagaatgttgatgggaagctcttagggaagggataaggacagcagagatgtcccacctaattgctgcaagggaagtaaaggactgagcaacttttattattttgatagtgtatgtatgtcagaaggatgaaactgctcacagaaccatagaaatctgaaaaaacagatgctttttctaggtaacataaaaccaacagaaaaagaaaaaaatataaagatgtggtttgaatatatgaaaatcataccaaatgtcatcatttatatggatgatcactaaaagaattgaaaataaataataataataactagcatatactacagctttttagcatttactaaagttttaagcattctataaaaattacatctaagcttcacaacaaccttatgaattatgtacagatattataatttgccccaaaagtgacagagctgggattagaaacctagcagtataattccaaaatatgtgctctggggatagtagatgataaagaaacgaatgagaaacaagccaaagaaaataccagctttgaagatgcttgtcaagaagtaaaatactatgacaaaaagaaacgagtgtttaggtggctacttttgcctgggagtttagagaactctctgaggtttaagcggaacactatataacgagaagccagtaaaggaaagagaccaactaatccaaaggctgcacagcagaaaggaggctgttatgatccagaaacaaaggaagggccagagtgaaaatggtaccacatgactttggagaagggaacaaggtgtagatcatgtagtggggctaaggtagggtattcggatttcattctaagtgcaatgacacactactggaagaagtgagtgataggatctggtttaagtttaaaaggtcatttttggctgctctgtggagcatgtatcatagagaggcaaaactaaaagcagtaattccagttagaaggctatgtcagtggtttgggtgagagagggcagagctttgactagaaggtgaatagtgaagatggagacaagtgaacccgtttgggaaatagtttcttttttccaacctttatttttttattgaggtgaaattgacataacataaaattaaccattttaaactatacaatttagtagcatttagggctttcataatactgtacaaccactctctctgattctgaaacattttcatcactccaaaagaaacgccctacctattatgcagttgcttcccattctccccttccccaggccctggaaaacatcagtctgtgttctctctttatttatttacctattctggatatttcgataaatagaataatacactatgtggtatttttagctagtctttcacttagcataatgctttcaaggtttgtccattatggagcatttattaatcattcattactttttattcacaagtaatattccattgtatggataaagcaaattttatttacccattcatgacttgatagatatttgggttgtttctactttggggctattagcaataatgctgctatgaacattcacatactttatctatggatatatgtttttatttctcttgggtgtatagctagaagtgaaattgctgaatagtatggtaaacctataacattttgaaaaaactcctgggtaatatagtaacatttaacattttgaagaactaccaaactgcttaccaaactggctatagcagtttgtaatcctaccagcaatgaatgatggttctaattgttctctatcctcttaaacatttattatcgtctgtcacgtttattgtaaccatcctagtggatgtgaactgctatctcattttgatttgcattttcctaatgactatactgagcatctttttatgtgcttactggccatgtttatatctttcctggagaaatgtctatttaaaatatttacccatttttaaattgggttatttgtctttttatggttgagttgtaagagtttttatatattctgcatataaggcacatatctgataagtgatttgcatgtattttctcctagtttgtggcttgcattttcaatttattttgctgtcctttgaagcacatatgtttttaattttgatgaagttcaatttatctgtattttctttggtcagacttcaggtatcacatttaagaaacagttgtctagctcaagttgacaaagatttattcctataatttcttcatgagttttatagctttagctcttatatttaggttgttgatccattttgagttattatatatggtataggatagtatctaacttcattattttgcatgtgattttccagttgtcccaacaccatttgttggaaagattattcttttccccattgtatagtgttggcagccttgtcagaaatcaattgaccatggatgtatatatatgggttgctttttggattctcaattctgttttgcctatgtatatatctttctttatgccaagggtcccttgcatttccatatgaattttaggattagcttgtcaatttctgccaataaagcagctgggattttggtagggattatattgaatatgtatatcaatctgaagagtatgtccatcttaacggtgttaaatctttcaacacataaacataaaatatatttctttttatcttcgtcttctttaattttttcaactatgttttgtaattttccgtgtatgggccttgacttattatgttacatttatttttaaatatttagttctttttgatgttatcataaatgaaatctttttcttaattgcatttttagattgttcattactagtgtataagaaataaaattgattatttaaaaatagttaaggtatgattgacatacaaaaagttgtacatatttaatatataccacttaatgaatttggaaataagaatacactgtgaaaccatcaaccacaatctatgccatgaacttgttcatcccctctaaaagtttgctcccaatttctttattattatttgtatgataagaataattaatgttaagatttactttgttagcaaaattgtaagtttacaacacaatattgttaattataggcactatgctgtccagtagatctctaggacttacacaccttgtataaccaaagtttatacctttgaccctcctttctccctccaagtccctagcaaccattccattcactgcctctatgagtttgacaattttagattcatcttataattggtatcatgtagtatttgtccttttgtgtctgacttactttattcaacataagcctgaataccttaaaaaagaaggaaatgctgtgatttttgataacatggatgaagctggaggacattatgtatgccatgttttccttgtccattattcatcagtggacatttaggttgtttctatgtctcagctactgtgaacaatgctgcattgaacatgggagtgcagatagctctttaacatacttatttcatgtcctttggatatgtacccagtagtgggattccttgaccatatggtagttctatgtttaatttttaatgatttttataaaggttatgggtctgtaattttcctttgttgtagtgtctttggaaaaaattctacttgatcatgacatcttttttttttttgagacagagtcttgctctgttgcccagcttggagtgcaatgacgtgatctcggctcactgcaacctctgcctcccaggttcaagcaattcttctgcctcaagctcccaagtagctaggactgcagacatgcaccgccatgcctggctaatttttttttttatacttttagtagagatggggtttcaccatgttgcccaggctggtctcgaactcctgacctcaggtgatccacccgcctcggcctctccaggtcttgggattacagacatgagccacagcacctggccccatggtgtcttttgttcaggggagaaatgaagtcatttttaaaaattatgagaaatactacatatgtatgagtttatcatatatagaagagtgtattataaatatatttgttacatattacatatgtatgagtttatcatttatagaagactattataaatatatttgttacatatatgtatactatacagtatatgtttctatgtttaatataggtatactaacaactctcacattgttggcaaactagtaggtgtatgcaaatgtatctttgtggtttaaattttaatttccttgaaatctaataagtatgagcactattttatattgaaattggcccatagtcttccttttctaataagtgtcaagtacccaccactcaggtcaagaaatagacaagtatagggaccccaaaaacctctgttgtttccctcccagatcacagttccctcctcccttaagatagccataatttgtgctttgtaataatcagttacttggtttcctttagttttaccaaccttacatggatccctaaataatatagtcgattatccatttctgaattttatctaaataaatacatacttttatctcttgctttttttcactcaacattacatttaagagattcatctctgttatttttatacctgtatctggtatctaaggcaagttttctcctttctctattgtctgacattcaaactggattgcttttgggttagctatgtgataattttattactctaaaagtaacacatgcaaatggtaaaaacaaaaataaaaattcaagtaacaccaaaaggcataaatttaaaaggaaaacactaccaccccaatccacactccttaatgactacacaacccttcttgtaattgactccttttgttttaaaatcctaaattattctattatgctaattttaaaaatgtatccgtttcacacagtaattattaacaacacacaatcagtgataggaaatttactgtcttatattactaccctctactgcccctcccagactactttttgcaattattcttattttttttttagttttgttttttctattcttatctttaaataatggctccatgtttctctctacctcgtctcccttcctcatcgtctacatttttatgagctatgttgttttcacattgttaaaattaaacattctctcattggaattatgattaccttcgattttgtttattgattcagcccaacatttgtaaatccactaattatatttatattatgttatatttttcaatttgaggaatgatactttccaagtcctcattgggtcaaaacagatacttatgtttctatatcagcacatatgcttcttatcacttaatactaccaaacaaagcagagaaaattattgtcaataagaaatctggttttgtggattacagatatcatctctggataaaaagaaatcttaacagtcttataatttgaaagaaaatttccccaactacttgttagtgggataatttatagtagctttatcttggaatacctgtgaaacgacctggaaaaagaagactaaagaatgactaaattgttgtcatttaagtgcaataataacaaatatatttttcagtgttatttcacattcattatttcatttaaccttcacaacaaaaccataattaggcacacccaaatagcacagtgtctaagagctttggtgttggagtcatagagattagggtttaaatttaaactccatatttaataactttgtaatgttaaacaggctacttaatctctcaaagtataatgctccttacacagaaagaggttgttaatagtttctttcagccatgttttgtagttttccctatagaggattttcacctccttggttagatacattcctaagtattatatatttatttatttatttgcagctattgtaaaaaggggttgcgttcttgatttgattttcagcttggtcgctgttggtgtacagcagagctactgatttgtgtgcattaattttgtatcctgaaactttgctgaattcatttatcagttctgtagctttttggaagaatctttaggattttccaggtatacgatcatatcatcggtaaagagtgacagttttacttcctctttactgacttggatgcccttcatttctttctcatgtctgattgctctggctgggacttccagtactattttgaatagaagtggtgagagtgggcatccttgtcatgttccagttctcaaagggaatgctttcaacttttctccattcagtattatgtttgctgtgggtttgtcataaacaacttttattacattaaagtatgtcccttctatcccaattgtactgagggtttttaatcataaagagttgctggattttctcggatgctttttctgcatctattgagatgatcatgtgatttttatttataattatgtttatctaatttttgtttttaattctgtttatgttaattctgttttaattcacattaaacaatacattaaaaagatcacttgtgtttgttaaaccatccctgtttcctgggtatgaaacccacttgaccatggtggatcatatttttgatatgctgttggatttggttagctagtattttgttgaggatttgtgcatctatgttcatcagggatattggtctgtagttttgtttttttgttatgtcctttcctggttttggtattaagatgatactggcttcataaaatgatagtatttacctcataggatgtgtttgaaaagtgagtatatgggtatagtaatataattttaactacctaataaattttagcttttataatcattgtctccttctgcccattctgcttttccttcttctccttcttcatttcatagattaagaaattaggcctgagagcataactgtcttttccaagtacacataaacagtacaaaaaatatacatataggccactggaacagaatagggagcccagaaagaaatccatccatttacggtcaatcaatttttgacaaagatgccaagaaaatacaatagggaaacaagcatcttttcaatacgtgatgctagaaaaactgacagtccacatgctgaagaatggtttttgatcctccactcatatcatatttaaaaatccacttaaaattgtttaaggtcttaaagataagacctgaaactataaaactactagaagaaaacatagggaaatgttccattatattctgggataatactcaagatgatcaaaacacaggcaacaaaagcaaaaacagacaaatgagattacatcgagctaaaaaatcttctgcacagcaaataatcaatagagaataaataactcatagaatgagggaatatatttccaaacggtatatatgataaggggttaatatatgaaatatataagaaactcacacagctcaatagcacaaaaacaaatagactgataaagaaatggacaaaggagctaaatagacatttctcaaaagaagacatacagaaatccaacacatatgtgaaaaaatgcccaacatctctaatcatcagggaaatgcaaataaaaaccttgagctatcacctcatactcgttagagtggctgcaatcaaaaagatgaaagataagtattggtaagaatgtagaaaaaagtggaaccttattcactgttggtggtatgtatattggtacaaccattttggaacacattatggaggttcctcaaaaaattaaaaataagaaatccaaaagctaaacagactcaataacaagtaacaagatcaaagccataataaaagtctccccataaagaaaagcccaggacctaatcacttcaccactgaattctatcagacatttaaagaactaataccaaaacaccaaaagcaatggcaacaaaagccaaaattgacaaatgggatctaattcaactaaagagcttctgcacagcaaaagaaactaccatcagagtgaacagcccacctacagaatgggagaaaacttttgcaatctactcatctgacaaagggctaatatctagaatctacaaagaactcaaacaaatttacaagaaaaaaacaaccccatcaacaagtgggcgaaggatatgaacaagacacttctcaaaagaagacatttatgcagccaacagacacatgaaaaaatgctcatcatcactggccatcagagaaatgcaaatcaaaaccacaatgagataccatctcacaccagttagaatggcgatcattaaaaagtcaggaaataacaggtgctgaagaggatgtgcagaaataggaacactttcacactgttagtgggactgtaaactagttcaaccactgtggaagacagtgtggcgattcctcagggatctagaactagaaataccatttgacccagccatcccattactgggtatatacccaaaggattataaatcatgctgctataaagacacatgcacacgtatgtttattgtggcgctattcacaatagcaaagacctgcaaccaacccaaatgtccaacaatgatagattggattaagaaaatgtggcacatatacaccatggaatactatgcagccataaaaaatgatgagttcatgtcctttgtagggacatggatgaagctggaaaccatcattctcagcaaactatcacaaggacagaaaaccaaacaccgcatgttctcactcacaggtgagaattgaacaatgagaacacttggacacaggaaggggaacatcacacaccaggacctgttgtggggtggaggtggggggatagcattaggagatgtacctaatgtaaatgatgagttaatgggtgcagcacaccaacatggcatatgtatacatatggaacaaacctgcatgttgtgcacatgtaccctagaacttaaagtataataaatatacatatatatatatatttaaaaagaactaataccaatagtactcaaattattctgataaatagaggaggaaggaatacttccaaactcattctacaaggacagtattaccctgacaccaaaatcagacaagaacacattgtaaaaagaaaactacaggccagtatatctgatgaatattgatgcaaaaattctcaacataatactagcaaaccaaattcaacaataaattaaaaagatcattcatcatgaccaagtgggatttagccctgggatgccaggatggttcaacatatgcaaatcaatcagtgtgatatatcatgtcagcagaatgaaggacaaaatcatatgatcatttcaattgatgctgaaaatgcatttgataaaattcaacattcctttatgataaaaaatggaatcctcaaaaaactgggtatagaaggaacacacctcagcataataaaagccatccaaacagacccaaaactagtatcatactgaatgggaaaaaactgaaagcctctcctctaagatctggaacatgacaagaatgcccactttcaacactgttggtcaacatagtactggaagtccgagaaatcagacaagaaagaaataaagcgtgtccaaattggaatggaataagtcaaattatccttgtttgcagatgatattatcttatattttgaaaaacctaaagactccacaaaaaaactattagaaatgataaattcagtaaagttgcaggatatgaaatcaacatacaaaaatcagtagcatttctatgtgccaacagtgaaccatgtgaaatagaaattttaaaaagtaatcccagtggccacacacacaaataaatacctagcaattaactttaccaaagaagtgaaagaacttagtaatgaaaactataaaacactaatgaaagaaattgaagaggacaccaaaaaatggaaagagagtccatgtttatggattagaaggatcaatattgtttaaatgtccatagtacccaaagcaatctacatattcaatgcaatctctatcaaaatactaatgacattcttcacaaaaataggaaaagcaattctaaaaatatatgtaacaacaagagacccagaacagccaaagctatattaagcaaaaagaactaaactggagtagttgcattacctgtcttcaaattaggctatagagctatagtaaccaaaacagcatactactggcataaacacagacacatagaccaatggaacagaatagagaacccagaaacaaattcatacagctacagtgtactcatttttaacagacgtgccaggaacatacacgttggaaaagatagtctcttcaatacatggtgctaggaaaactggatataaatactcggaagaatgaaattagacccctatctctcaccacattaaaatcatatcaaaatggattaaagatttaaatccaagacttcagcctatgatactactaataagaaaacattggggaaactctccagaacattggtctgggaaaaagttttctggagtaataccccagaagcaaaggcaaccaaaggaaaagttggcaaatgggatcacatgaagttaaaaagcttctgcacagcagtggaaacaatcaacaaagtaaaaatcccacagaatgggaggaaatgtttacaaactacccatctgacgatgaatgactagaatatataaggagttcaaaccactctatagaaaaaaagttgaataacccgatcaaaaaatgggcaaaagttttgagtagacatttctcaaaagaagacatgcaaatggcaaacaggcagatgaaaaggtgctaaacatcgttgatcatcagagaaatgcaaatcagaactgcagtgagatgtcgtctcaccccagttaaaatggtttctatccaaacgacagacaataacaaataatgaagatgtggatcaaagggaaccctcatacactgttggtggcaatgtaaattagtgcaactgttatggagaacagtttggaggttcttcagaaaactaaaaatagagctaccatatgatcaagcaatcccactactaggtatatatccaaaagaaaggaaatcagtatatcaaagatatatctgcagtcccatatttgttgcagcactgttcacaatagccacgatttggaagcaatgtaagtgttcatcaacagatgaacagataaagaaaatgtggtacatatatataatggagtactattcagccattaaaaagaatgagatcctgtcgtttgcaatgacatggatggaactagagatcattatattaagtgaaataagccaagcacacaaataagaacatcgcatgttttcacttatttttgggatccaaaaatcaaaacaattgaactcatggacatagagagtagaaggatggttaccagagtctggaaaggcttgtgggggcggggaggtgggaatggttaatgggtacaatagagatagtgaggaagaatgaataagacctactattttatagcacaaaagggtaactatagtcaacaataagtgtatatttaaaaataactaaaatagtataattgcattgttcgtaagacaaggcataaatgcttgaagggatggatagttcaatttttatgatgtgattattatgcattgcatgcctgtatcaaaacatcttatgtatcccataaatatatacacctactacatacccacaaaaattaaaaatagaactgtcatgtgatcaagcaatccctctactgggtatatatccaaaggatatgaaatgagtatgtcaaaaagatacctgcactgccatgttcattgcagtagtgctcattactcacactagccaagatatggaatcaacttaagtatccatcagtggatgaatggataagaaaatgtggcatgtatatagaatggaatagtattcaagttttaaaaagaaggaaatcctatcatttgcaacaatatgaataaagttggaggacaatgtgttaagtgaaataagctaggcacagtaatacaaatacagcatgatctcacttataagtgaaatctaaaaacttgaactcatagaaaaagagaataaaatgggtatcagcagctgggggtgaggggactggggagatgttggtcaaaggacaaaaagtttcagttaggcaggaggaagaagtttaatagatctactgtataccatggtacctatagttaataacactatgttgtatacttaaaaatttctaagagagtaggttaaatgatgtctcccaaaaaaataagtctgagagataatgcatatgtcaaatagcttgattaagccattctgcattgtattgtatacatatatcaaagcattatgttatataccataaagatatataatttttacttatcaatctaaaagctaataaattaaataaattcaatttaaaaattaattagtgtgagctatgtctattagctagacctgttttttttcctttgagaagttctttttaaatacatgaaaagtttgtgtgtgtgtgtgtgtatgtgtgtgtgtgtgtgtgtgtgtgtaatagatcctgactagcaatcttctaaggctgtggtggttaaatttagctaagagaaattgcatttagatattaggtagcattttaatatgcctggatgggttttgaaggcattattctttctcgtgaaattttgggaaaagaggtagatacagccttccttgaacaattatttataaatttgaagacaagtagctggacaagattttctttcaatgctaatttttattttctaattcaatgatcattttcctgtgaatacatgtttttgcttaagccgaggtttattttccagtttgtataggtaatccttcttagttgatcttaattatagctgtcaagagctaaacatttcttttctacatctggactaggaaatgtttccaatgaacaatcattttaggatcccaagtatcctaaatttctaaagctgtattagttttctattactgcataacaaattacaagaattttgatatcttaaaaaaaaagacccatttattatttcacagttctgtaggtcaaaagtttgttgagacatggctgggtcttctgctttggcttcagtaaaattgtctgctgactattttaatacatttttatcttgagcttggggctctttacaaactcttttctattgttggctgaactcagttccttgcacttatagaactgaagtccccattttcttattgtctgtctcgtagggctgctgtcagctcccagagtcactctcaaatttaagccacatgatttccccccatttcagcaacagagaacttccctcccatgctgcatctactgccactagccagacaaaactctgagcttttttttttttttttttttttgacagagtcccactctgtcaccaaggctagagtgcagtggtgtgatctcggctcactgcaacctccaccttccgggttcaagcgattctcctgcctcagcctcctgagtagctgggattacaggcgcatgccaccatgcccagctaatttttgtatttttagtagagatggggtttcaccatgttggtcaggctggtctcgaactcctgaccttgtgatctgcctgcctcggcctcctaaagtgctgggattacaggcgtgagccactgcgcctggccaaaactctgagcttttaaggggctcatgtgattgggttaggcccctacagataatctcccttttgatgaacccaaggttatctgattagaaatcttaattaatgctgcaaaaatccctttgccatgtaaggtaacacaatcatgagagtgatgcctcatcatattcataggttctactcaggattaaaaagagattacacgagagcaagcatcattggagatcatcttaagagttttgcctactaaaaagtactagtatctggggcaagcaacataggtttttgaggctatctgaatatctgtcttacagtcttctattctcaaacaagctttctttccaaattccctgtttctgtaagtgtcatccaagtttagtaataagtttcattaactttcctttcaaacatattttatatttgttctttatatcattgctatttagctgtaagcatgccatacatatattactgcagcagtctactttctgctgttcctcaatgtgagctctctcttccctccgtgacagaatccatcctgaaaagcaatgatgttaaagaatattatactacttaaaaatcaatcaatgggatctcttttctgtaacattaaaataagtcttcattgaacaattttaagaatttaagaattttaagtccatcagaaatatggttttgcccataaatatctaaccttattttgcttggataagcatggatctaaacccagtccatatcccctatcctttttcttgtctaggcagatgtatccacttcctcacaacacaatggtgttaattcctgctaattttatccctagatatcacatgatcctttctcttgattttatttgctctttcttcaaggcaatggataattttagtgccttcttgagactttcctttattcttcattacagttagaagtacatgatagtcttctctacctaattaaattatagcccattttccaaattatgttataaagtgcttgagagtagatatatttgtatcttataattttgtgcctatatataattgttcctcaaaatattaatgccaactactttctcttaataaggaaatgataaagtcaaagtcaaaagctatgactgagaaatatgtttctacaaagtggaatgacttgatattaggtagcattttaatatgcctggatgagctttgaatgcccttctccattcatgaacataatggaaaattaaagtactaaatacctttgcctccgatgtttgggtaaacgctaataaagttgtcaattacttggccagttgcagccaaattgttttaaataaattatccaaataatgtttttttctcttcacccttaccaagagagaccctgggagcagaacacaaattaagcccatatctgaatttacaaggaaaatatctgaaactatatttacatccaagtttgcaattttcttttcttttcttcttttttttttttttttgagatggagtcttgctctgttgcacaggctgtagtacagtggcataatctcggctcactgcaacctccgcatcccaggttcaagccattctcctgcctcagcctcctgagaagctgagattacaggcgcatgccaccacgcccgcctaattttttgtattttagtagaaacggggtttcactgtgttgcccaggctggtcttgaactcctgggctcaggtgatccgcccaccctggcctcccaaagtgctgggattacaggcgtgagccagcgcacccggcctacaattttcaaagcaatctcgtgttgaagaaggaaatgtcttcaacagtggtccatcttcagtctttatcctatgaaacctctatgtggtttttggagttttgggccactagtttgttcctgaaattctctccttccctagatttttactggttttctctggatttcttaagctatctctggctacaccttactagtctcaatctgtctctgaatacaccataaaaagcagtaatattcaagattctatttttgtttttccctatatatactttttatttttattttttttacctgaaaaaattcattcatcgctgtgactttaactttcatttgaaagattcaaaattcaggccctgaccttttcttggtctagattcctatctccagctgactgttgttaatccctgtatagatgtcctgccagttcataaatttaacaatcagtgcaaaaccaaattcatatttcatttctatttcctttcctatttctcagttgagttaattgtttcacagttcttttattcacatagtctagaaactgtggaaatatctgccattcttctcccatgttttactacccacccgctacaatttcagcatttcctttcaaatttgtcttcctgcctgcagtatcctttctactgtggaaatttactcatcttttaggtccaatttaatcagaactctcagccacccctcatacatggataaaaatcaatcagatattcttagaaacttctatagcatcttttttttttcctgaggtatgattatttgtgtacatattggcatccttcaattggcagcaagttacttaagggcagaggtcattcccatgtctctatattttagctctgtgtctttatcatggtggttgctcaaaaaatgtttcctgaattctctgtgcccttgcctacatgacaatataactttcaaattcaaaaagcaatcctattttccaatcttttacattacctgaagtaacattttcggttaagggaatttctaaattctgatgaaattatactttttatatagctttaaaattccccactgagtttaccaaacaaggttgatgatttgcctttaaaatgccgacaatcaattcttaattcagtcaaactgatgagtgggtcccccaatcacaagtgctgtcatgcattttccttatttttgagtgaagtatggttgttttcccagtttttcctgaattagtcttaaataagtcagcatcttcacaagttcccaagagaaattaagtatattgctacagtaataaagcattagatgctttaaaaaatctttccccttagaatttaagagtgaaatatcttacatgaatcctaatattaattttttgatctttcattgtgacatgacattacatcctttaaatatttacgtataatttcaggtaatttttgtgttacttttattttatagttttctttcacaacagaaaattattttatgtttataatatctgccttcctagccattatgtcatgcggcccttatcatggaaaacattgtctcttttaggggtacttttggggcgttatcaaaatatgtttcttggtggaaagtctcatgatgatatatcctcttcaagagatgtttgagatgcaactcagacatactcttgttcttagccttgatttatgtaaacactttgtcttcatcaaagtcacaaaattttatcagaaccttatttttaacccagtatataaattcatcctatttagaaatcaaataaaacatgcttttgtcctgttcactgccatttgacagcatcccactttttcttttcttttttaaaagtacttttaacaacaggtaaaagatgcaacttgatacagttagttaagaaaattctactttgtatttttaaaagctgagacaatgtttggagtactgtaggtatcattttattttcactacatgaataataatggatatagttcttcctggcattgtctgtattaatgggcattaatctattgccatatctttattatgactttctttaccaatcttgcagtaatattttatgcctggggtaatgattaatagataatattttgtgtatttctgttatgatttggctgtgtccccacccaaatgtcaacttgagttgtagctcctagaattcccacgtgttgtaggagggatccaaggggaggtaattgaatcacgggggctggtctttcccttgctattctcatcacagtgaataagtctcacaagaactgatgggtttatcaggggtttccacttttgcttctttctcatttttctcttgttgccaccatgtaagaagtgcctttcgcctcccaccatgattctgaggcctccctagccacgtggaactgtaagtccaattaaacatctttttcttccccgtctcaggtatgtcagtgtcagactaatacagtaaattggtaccattagagtgggacgttgctgaaaagatacccaaaaatgtggaaatgactttggaactgggtaacaggcagaggttggaacagtttggagggcccaggagaagacaggaaaatatgggaaagtttggaacttcttagcgacttactgaatggctttgcccaaaatgctgatagcgatatggaccataaggtccaggtggaggtgaggaacttgttgggaactggagtaaaggtgactcttgttatgttttagcaaagagactaacgtcattttgcccctgccctagagatctgtggaactttaaacttgagaaagattatttagggtatctgcagaagaaatttctaagcagcaaagcattcaagaggtgacttgtcattcagttttataagggaagcagagcataaaagtttggaatatttgcagcctgactatgtgacagaaaagaaaagtccattttctggggagaaattcaagccagctgcagaaatttacataagtagcatggagcctaatgtgaatccccaagaccacgtgtaaaatatctccaggctgtgtcagagaccttcacagcagcatccccatcacaggtccggaagcccaggaggaaagtggtttcgtgggctgggcccagggtcctcgtgctgtgtgcagcctagggacttggtgccctgtgacccagccactccagccatggctgaaagaggccaatgtccagctcaggctgtggcttcagagggcggaagccccaaactttggcagctcccacgtggtgtggagcctgtgggtacacagaagtcaagaattgaggtttgggaaactccgcctagatttcagaagatgtatggaaatgcctggattcccaggcaaaagtttgctgcaggggcgaggccctcatggagaacctttgctagggcagtgcagaagggaaatgtggggtcagagcctgcacacagagtccctactggggcactgccttgtagagctgtgagaagagggccaccgtccttcagaacccagaatggtagacccaccaagagcttgcaccatgcacctggaaaagccacaaacactgaacgccagcccatgaaagcagccaagagggagtctgtccactgcaaagtcacaggggcggagctgcccaagaccatgggaacccacctcttgcatcagcgtgacctgattttgagacttggaatcaaaggagatcattctggagctttaaaatttgactgccccactggatttcagacttacatgggctctgcaacccctctgttttggccaatttctcccatttcaaacagctgtatttacccaatacctgtacccccattgtatctaggaagtaactagcttgcttttgattttacaggctcatagacggaagggacttgccttgtctcagatgagactttagactgtggacttttgggttaatgctgaaatgagttaagactttgggagactgttgggaaggcgtgattggttttgaaatgtgaggacatgagatttagaggagccacgggcggaatgatatggtttggctgtgtccctacccaaatctcaacttgaattgtagctcctagaattcccacgtgttgcgggagagactcagggctaggtaattgaatcatgggggctggtctttcctgtgctactcttaggatagggtgaatatgtctcacgagatctgatgtgtttatcagggtttccacttctgtgtctttctcatttttctcttgctggggccatgtaagaagtgccttttggccgggtgcggtggctcacatctgtaatcccagcactttgggaggctgacgcgggcagaccatgaggtcaagagatggagaccatcctggccaacatggtgaaaccccatctctactgaaaatacaaaaattagctgggcatggtggcgcagcctgtagtcccagctactcaggaggctgaggcaggagacttgcttgaacccgagaggtggaggtttcagtgagccgagatcatgccactgcattccagcctggtgacacagcgagactccgtctcaaaaaaaaaacaacaaaaaaagtgactttcacctcccaccatgattctgaagcctccccagccacgtggaactgtaaatccaattaaatctctttttcttcccagtctcgggtatgtctttagtagcagtgtgaaaacagactaatacaatttccctctgttgaactggtgaacaatttagcatgtaccaggtaattcagtagtaagaaaaatggggctggtgagttactaagagacacacaggattaacatgcccattaggtgcatccaacctaattttgcaatgcacaggcctctttgctttgtaaagaggaatgtaccattatttgcagtagcatctcagcttggtggatgataaaggatgaacattttccacctcaggtcaaatagatgaatttattcattctactagttattaagcagcagcaatgtagcagtcattggtaatcaataataaatggcataggccatctcctaatggctttgcattctactaggtattttttttctattttttattctacaccctaaaactgtgaaacacagagaaactaaaatggttcttcctaaccaagattaactatgttctataccaataagctacttttaagtgcctctcagtaaactaacatccttcagatataggtagaggaattcaagccactacaataaatacaattatttcaatcatcactttttatatggagattgccaatgtgcaggatccaacatagttgcagtggctgggcactgcagaactccaggggactttatttacgtagattaggatgctggcacactgttcacatacattacaatctgagtgaccaaatgctccaacccagacgtatttttttcagccacctcttttatggcctgtcaagaacaagcattaccaagttgttccttcattttattttgtttacacttttgaggtgctgctgtgctcagggttcttttcttgttgaagtaaagagatatacaaagataaataacacgtaaatgtgtactttaatggacaacattagagtctagtaatttcctttacagactccagatctcaatggagccacaaacaagataagttcataactgcatctccgttctcaaggatgctatcttaacaaatgtgttcagattggccaaaaaacagcagcagcatttacttactgaaagccatatggagaagctgtactctttcactaggtcacttggcaaacattacctttgtgctccctcgacatttcctgatctcaagagtaggaaaccagaagagaaccaaatcacttccttccctacttcctaaagagcaacgttgacctcatcagctgggcttcagggttcagtaaacccacatatttcaggataaactggcttgagtacatgagtggtgattgcttttgttacagagttgaggtgacaatattgatcattaaaacaaggaaaatgaaaagtgttggcattctttcatggccatctgtgacttcagtgtgctggtacttagtgttcacaggcaactgaatgtttgaactggttcttggttttgcagtgaaaaatgaaggaaagcattcttctgcttttgcctgtttatttttttctcatgaacaacatggttagaaattatgacatttaattgttttaaattccattgtcatgccatattttgtttcatgtatttagcattttcatatgtgacactatatcataatttaattgtaaatttaagtttgctatcccacttcactttaaacctttctatttaataagattcacagatttttatttttctgtaagaaactgatacattatttgacttttttggttgcattccaacattttaacattagtattataaaaagaaatcaaagttatttttatttcctttaagattttataataactgtgcagcatgaacataaggaatatgatattcatgactggaatcaaagattataaacatttagaacatgaataatagttaatgtattaaaacagttttatatatataatatatataaacataataaatatgttttattgtgttgaatcacatgaagtttctatttttgatagaaaaaaatcgtcaaattttggcaatcagcttatattaggtaattctgcacatttttgctaccagtttaatgaaaattaaattgcatgatagttaaccaccataaatgagtcagccctttgtggattgtctaaacctaataccacttcctctctcttttgatttaatgactgctttcaggctgactactcaagaagtctatcttaagtggtaatgaatgaaagaaaacaatatccataaatttagatacctaaagtaaaagttccgtattttataaaacccaggagttagaataaaggagcagttaagactatgaattaaatcttgttttgggagattatctggatttatttacatgtgctactatgtctctaatcccatatataataaacaattgagtaggctctaaaatgcatgtttccaacaaatgatatcaagatgatattatatttttgagaatttgtgcagctttttagctgaacagaaaaaaggtggtctactacaaaacttgaactctactacaaagcaaatccttactgtcaatagatgtaaattctcatcagttctgtcactggcagcctctgtgacacaagcaggtggcctaacctctatggaagcagtttatttgttcactttaccgagatcttagtgcacatatgcattcacacttttttaacaacaactctgtgattctcaggagcccaccccagaggttaggaaccattggattataaaagctctgttaacccttcttagtctcacattctaatttctattaacctaagaggtattagcaacaattgaggaaaaggaaatagactaactggaaatatggaatcattataatgaagattccaaccactcaagctgataattatgtatgagttctttccatttgactagaggccagaaaccagagagggtggaattgatgagccagcgtgtcttgctggcagtggctgcagcctgaaaggaaagtaatccagataattatttaattggatactatttaaaaagagaagtagaaaccccccaagaagtatggtccagattaaacatcttttccaccatattggttaaataaaaacccaaggatggtgcactgatggccaacatccatgaggttccattttcactgccatgaaatttccttttaactgttccctgctgtccttgacagtctctgtcagctttacttttcaatgttaagtacttctggatgatgattttacaatagtatgcttataatgaaaaatgaaaatgaatgaaatcctagctacaaacataataacaggagggtaatattcaagtgcttcctatgaaaggcattgcagtgcagtgcttatgacaaaaactgtcatgagtcagcctggacttgaaccatcttacatcatttctatcttatatgttacataatttataaaatatgtgttataagtttggtttagttattgaaacttcctgtgattcagtttcagcacttttaaactgggtgggatggtattggggtagtagtaaacattacataagttaattggtggttaatttgtataaagactttatgccagtgcttggcttaagtgccatatgtctgaaatagtaatttgctattattactatttcctgcatggcagttttacagaaaagtgactctttttatatgacctaactaactgagccctggctctttaaaagtattggttttggctgaattatcatagcatggtgaagtctatcaattttacaagaagtggctcagaaaaacaaatggcatgcaatacaatacatttgcatctgcagttatatctacataagacgctgagcataattttggaggtgatatgaccaattaaagtattttgctccctcttttctgttttccattctcttgagattttatttttaggtctttttctctgagctgtatgcattgatatttaatgattgccatttttattccttttggagaattaaatattaaatatcaggcagaatacctcctttaatttccctttggagtaataaaatggtaccagtaactgtttcctgagatctgtagcaataccctttgtcaaaatggaagtacattataaagccagaaaaccacgtatcaagagctcttagaaagagtgttttatattatataaatatgtcaaataatgaaaacatccaagaggtgaattggtgctgatttggcctcaggaatctctcacacaaaatgttacaataaattctaattaccgaagtacttatcaaattataaaaaagttttaattactaattttaattactttattcacaatgagataattagcatgaataagaattactccctttttcagctttattggggtataattaacaaaattgtatatgtttaaagtgcacaacatgatttaatatacatatgcatgtatcaacacaatcaaattaatgaacatattcatcatacatagttaaccattgtgtgtgtatgtatgtatgcatgtggtgaagacactcaatacctaccttcctagtgaatttcaagtaaaacttcagtattattaattatagtcaccatgctgtacattagatcctcagaacctattcacttataactgaaagtttgtacacttcaaacaacatctcccaattttccccactcataatccctgatatctgttcttctactctttgcttctatgagttctactttttcagatatcacatgtaagtgataccatacagtatgggtatttctatatctggcttattttatttagcataatgttctttaggtgcatccatgttgttgcaaatggaaggatttcatctcttttaaggctgaatactatcccattttgtgtgtgtgtgtgtgtgtgtgtgtgtgtgtgtgtgtgtgtaacattttctttcttcattcatccattaataggtacttaggttggttctacatcttggctgttgtgaataatgatgatatgaacaagaaagtgcagatatctcatcaagatactgacttaattgcctttagatatatattcagaagtggatttgctggattgtatagtagttttatttttaattttttgaagaacctccttactgtttgccatacttgctgaatcaatttacattaccattcccactaacaatgtaaaagagatctgttttcttttcttttctcttttttttttttttttttttgagacagagtctccctctgttacctaggctggagtgcagtggcacaatctcagctcactgcaacctccgcctctcaggttcaagcgattctcctgcctcagcctcccgagtaactgggattgcaggcgcccgccaccatgcctggctaattttttgtatttttagtagagacagggtttcactatgttggccaggatggtctcaaactccttcctgatccgcccgcctcagcttcccaaagtgctgggattacagccactgcactgagtctagggatcccttttcttaacaccatcaccaacacttgttatcccttgtctttttgataataaccattctaacagcaatatgtcattgtagttttaatttgcatttcccagatgattagtgagataaagcaccttttaatacacctgttgggcatttgtatgttttctttggaagaatgtttattcacaccccttgcccattttctaaccaggttatttcattttttgctattaacttgtatgagttccttatatatttttaatattaaccccttgtcagatacaaggtttgtaaaaccatctcccatttcatagcttgcctttttatttcttttgcagtacataagtgtgattgtttcttttgcagtacataagtttcttactttgatgttatcccgtttgcttatttttatttttttgcctctgctttttgtgtcatatacaaaaaatcattgccaatacgaatgtcaaggagctttttccctgttttcttataagagttttatgatttcaggccttacatttaagtctttaatccattttgagttaatatttgtgtatgatgtaggtgtctaatttctttcttttgtatgtggatattcatttatcacaatgccattctctttgtattcttagtgcttttgtcaaagattagttgactgtctatgtatgggtttatttctggctctctgttctattggtctatgtatctcatttttatgccagtagcatactgttttgattactgtagctttgtaacataatttgaaatcagaaggtgtgacacctccagttttgttcttttttattttttaaggacaagtgtctctctttgtcacctgggctgcagtgcaatggcttagtcatagctcactgcaaactcaaactcctggactcaagcaatcctcccacctcagcttctggagttgctggggctataagcatgcaccatcagccccagctggttattaattttttatatataaaagcgaggtctcactatgttacccagggtggtctggaacttccaatctcaagatcctcctaccttggtctcccaaagcactgatattttaggcatgagctactgtgcctggccctgctgtactttcccaagattcgtttggctattcaacatcttctatagttttatattaattttagaaatgtttttctgatttctttgaaaaatgccattggaatttttatagggattacattgaatctgtagatttatttgggtaatatggatattttagcagtattaattattcccatctctgaagataggaagtattccatttatttgtctcttcagtttctttcatcaacatcttacaattttcagtgtacagatctttcacctctcgttaaatttatttgcaagaattttattctttattattcttttgtaaagtggattgttttgattctttttagatggtttattattagtatgtagaaacacagctaacttttgtatgttgatttttttgtcctgcaactttactcaatttgtttattagttctaacagtttttttttttttttttttttttggtggagtctttagggtttcctgtatgtaagatcatgttatctgcaatcagaaacagtttttcttcctttctgatttggatatcttttatttcattttcttgcctaattgctctggctagactttcagtaccatgttaaatagaaatgatgagggtgggcatcttttcttgttcctgatcttaaagtaaaagctttcatcttttcattgttaagtacaacgttggttgagaggttgttatatatagccttagttcttttgaggtacatttcttctgtaccttattagttgagagtttttatcatggaataatgctgaattttatcaaatgctttctctgcatttgagatgatcatatgatttgtatcctttattctcttaatgtgatgcatcacatttattgatttgtgtaagctaacatatccttgcttgccaaggataaatgtcatttgatcatggtattcttttaaagtgttattaatttggtttgattacattttcttaaaaatgtttgtatttatattcattaggaatattgacctatgattttctttttttgtagtatccatatctggctttagtatcagaataatgctagcttcttaaaatgagattggaggtatcctctccttctgaatttttagaagaatttgagaaggattgatactaattcctctttaaatatctgatataattcacttgtgaagctatcaggttttaggcttttctttagaggtttttactcatgatcggtctgttcaggttttctacttcttcattattcagtcttggtaacttgtatgtttctaggaatttatccttattccaggttatccaatttgttggaatattattattcggagtagtctcttatgaccctttgtatttctgtggtatcagttgtaatgtcttcccttttatttataattttatttgagtcccttctttttttcttggttggtatggctaaaggtttatcaattttgtttatattttcaaaaaaccaagttttagctttgttggtatttcattgttttattagtctctatttgatttatttttgctctgatctttgttacatcctatcttctactaactttggcattagtttagtttgttcttcttttcctagttccttgaggtataaaatttagcgttttatttgggatctttctttatgcttattataggcagttatgattataaacttccctcttagaactgtatttgctgcatcctatcagtttgggtacgttctgtttttattttttgtggtctcaagatactttctgatttcccttttgatttcttctttgacccattggttgttcaggtagcatgttgtttaattttcatatgcttgtgaattttacaaaatcttcctgttactgatttctggtttcatactattgtggtcagaaaagataaagtgctgttttgtggcttaatatatgatcttatcctgaagaatgttccatgtatgctggagaagaaggttcattttgctgcttcagatggaatgttttgaatatatttgttagtcatttggtgtatggtgttattcaagtccattgtttcgttgttgattttgatctgtatgatctattcattgttgcaaatagaaattgaagtcccctattattattgtattgctgtctcttttttttcagttctgttagtagttgccttgtatgtttagatgctctggtactggatatatatatatacaaaattgttacattctctttatatattgacacttgttattatataatgaccatctttgtttcttgtaacagattttgactgaaagtccattctgtctaatttgaatatatccacccctgctgtcttttggttaccatttgattagaatgtcttttcccattcctacatttcagcatatgtgtgtccttaagactaaaatgattctcttataggcagcttataatgggctcttgtttttgctttttgaatctattcagccactctgcatttttagattgaagaatgtaatccgtttacatttaaactaattattgataggtaaagacttatgacttccactttttaaaatgttttgctattcttctgttcctttctttttctcctgctgtctttctttgtattttgatgatttcctataatcttatatttttaattcctttttgtcttttgtgtgtctactagaggttttttctttgtggttacaatgaggcttgcgtaaaagatcttataacattccattttaagttgataagaacttgacttcagttgcatacaaacactctacacttttactccccagtcaacgttttatgctattgatgtcacaccgtgcatctctttatattgtatatctttaacaaactagtgtatctatagttatttttaatacttttgtttcttaacttttactctaaagttaacaagtggtttatatacaactattacaatattctgaacttgactatatttttaactttactagggaatcttatacattcagatatttttattttgttaattagcatcttttcagttcaatttagcattaagttctaccttcagcattcttttaaaagtcagatctagtggcaatgaattcccttagccttagcttctgtggaaaagtccttctctctcctacatttctgaaagacagccttgttggatatagcattcttttttaactcttcgtttcctgaacactttgaatatatcattccactctctcctggttttcaaggttttttatggagatgttcaccaatagttttatcagggtacccttctttgtgatgagtctcttttcccttgctgctttaaagtttccctctttattgaagactttagtcaatttgatcataaagtattccctctctatctgtgaggaataaattctaagattcccagtggatgcctgaaactgtggatagtactgaatccaattgccatcagttggaacctgtttctgttcatgtcttctacaaacaaatttaatgccttttccatctttgcttatcacacattgtgaccataacttctgcagtctgaagtgcaacagcaaatggaaactagtatgaatttccattttttcttcttaatttcatgggtagaagatttgttcttaccatggatcttgggaaactcagcataccattttttttctttctttactaagtcaagagctttcacctttccacttgatggcttctctttggcatatccaaattgccagcatcactactcttgtgctttggagccattattaagtaaaagaagtattacttgaacacaaactgcaataccacacagtcaatctgataacagatggctactaagtgactaaatgactgttagcatactcagtgtcatatcctggaaaaagggataatccacatcctggacaagaaagagcaggacagagttagatttcatcactctgctcagaacagaatgcaatttaaaacttgtgaattgtttatttctggaattttccgtatagtattttcaaactgtggttgactgactgtaggtaaatgaaagcattgaaagtgaaaccacagataaaggggaactactgtaatgtgtctcagaaaaatattctctgggtgggtccttctttagattctttgagcttcataaatctggatgtctgtatccctctgggaagttttcagacgttatttctttaagccttctgtttctttctttctctcttctcctgtgactttcataaatcgcgtatttattatcttgatggtacccataggttagtatgctctctttctatatatattgtatttatttatttatttatttgagacagggtcttgctctgtcacccagactggagttgagtggtgtgatcttggctcactgcaacctttgcctcctgggctcaagtgattctcctgcctcagcctcccgagtagctgggactgcaggcgcaggccactatgcctggctgaattttcttttttctttttttaagagacagggtttcactgtgttgcccaggctggtctcgaactcctgacctcaagcaatccacctgccttggcctcccaaagtgctgggattacgggcataagccactacgcttggcctagtatgctgtctttactcttttttaattgtcattcctctaactggctaatttcatgtgacctgtctttaagtttgatatttttttcttctccatgattaaatatgatattgtagctctcttttgaatttttcagttctattattgtattcttcaatccaggatttctgtttttttttttatggtttctattttttatgaacttctaattttgtccatgcattgtttttctgatttcatttagttgtctgtttcctcttccatcccattgatcttctttaatatgattgttttgaattctttgtcagacagttcatagatctcaatttctttggggttgttactggtgcttattagtttccttctgtggtgtcatgtttatctaattctttattgtctgtgtagctttgcctttgtgtctgcatttgaaggaacaaatacctgttcaagtctttacagattggctttggcagatattgaccttctcctgtagggttcccagcctgctaggattggttttgggaccacagtcgactggaattttaactgggtcacgagacttttgctggttcttacaaggagcagagtgtatatggatcctgtctggtctcaagacagattggactttgggcagtagaacagacactagggcaagggtgtgctttagattccacagttggctccacagatggtaggcctattaccaggtatactattcggtgtctttctctccaggttcttaagagggctcccactgggtcactaggtggatccttggtcaggcagaactggtcctggactatggctgagaggggctagaactgagttagagagtgtgcttcagggtccacagctgagttcagtgtttttaggtctctctccagggtcacagacaaatgtacctcctgccaggttcttgattgggcaagactgcccctgactgcagccgagcagggctggagctgggtcacaggtctacttcaggatctacattcagcctgaggcctatttctgggagcatggataagcatgtttcctataaagtcccttggtgggcagaactgctctcagatcacagctgagaggagctggaaccaagttaaagggctctttcagcatctacagtgggaccaaagttggtgggactgccaccagggcatgaatgggcatatctcctggcaggtccctgtgtgggaagaaatgctgtcagactacaggtgagaatggctagagctgaattacagggcctctttatggtcgacagctagggctgagatcagccggtctgttgtacaaagtgcatgtgggcatgactcctccctcattccttggtggatgattctggtggcaggacaaaggccaaatggagttgtagccaagttcatagggggctgaggctgtttctgggtctgtatccaggaccactgttcataagcctggcaactgggtacaagcctgccctctcagacagccctgatcagtcttggacttcgtatctgaatccaaagctcgaaaaaggcacttttttccatagatagctgccaaattattgttctgtgggaggatatgagtagaggatctcctattctgctatcttgctgactcctagaatagttcctttataaatattgtactagatgaggtttctaatttctcagcagacacttattccaaactcctagactttcacacctaaaaatgtgcctctgaataaatatttaattttacagtatcagtttacatttttagacctatgaagtaatattagagtattaattcttcttaatcaactgtctttactaaagggggttccaggtgaaaatacagtaatgatattaaaaataccacagagcacaggctctgaccaatagaatagacactggctatagaattagagtgaggtactagagtacccttgtttcaccagaggttaaccaggcagtgctggataacagggaggtgagaggctctgtgaaggaggctggggagaaaaagaaagtgggatataaggaaattggagccccaactatttaccaacctatacagccatatgagtgcattcctgtaaagtgtatatatttatagcatccttgtgggaaatgcatttgaaaagccaagaatgataagaaaatacccttactaccaaaaaactttgaataataatcaatatttattcttcatcaaggttgctatattccttcttgaaaaaagaaattgtggtgatttcattcagagttgtttgaggtttctcaagctcaagaaaacaaaatcaaaaacacatagacttaacctggagaaaattttgcttaaatcccactattcttattacataatacttgcaatttctatctattgagttataataattagttagaacttctcccatgcttatttaattcatttgaatttttgtgatcaaagttactctacaccacagcaggagacaatctgtattttatattttagaggtcgtgagtcaaattcttttgaaagtttgcaattttaataaaataatgaggtttaataggaatgtttattttctaaaattttaaaaaataatgtatctttccattcatgaggagaaaaaaaaacataagaagtgtttctttatatccattatattaaagtataacttgcctcaaataagaaattgtgaaaaggaaaaccaaatttttggcttagaggtttacactatgtacaattgaaaagagaattctatgaagattcatattattttatatgagtttcaattattataagacattagagggcaaaaacggttttgttaattgccaaaacggatatgtgttctacaatgttatttcacctctatgttttttcttctgttttcctttatttcccttttctttcttgcatttttatctgattaaatttatttcaagtaattgtttttttttttcttcttataattctaaacaatatctagccatcaatatagccctgaaaagcacaggcttaactacattatggacaattctctggcagatcaaattttcatcacccacatttcagatctactttaaaagtcagcattaaagactaatttgagtatttttctgatttttaaaaatgctttagtttcaactaaccctcattgaattccatctgtgtatacttatgcaagattttatgggggctacaaagatagataagagaaaatgtcaggctcctagtatcttatctagcagggagcagttgctctgacatggagagaggtcactagaccacaagccatggatgatatatgtcctatgagaacaggctacattattggcttttagaggtggtccctgtatggagcttatcaagtcttagagatggtgatgagtctggtctaactatccctctcttttgtagaaggataatggaatccaaagatttcctcacccattcaccatctgccttatcttcttacattgcatgtccactacccttggtaaacaatgtacaggtttactaagagctacacaccaatgttttcttgggacacttactgcactaaccaaagtcatttttaatattgttgttgttaattatttgttccataattattatcttaatgttctttggggaaaactgcttttgatagaaggcatttaattttttttttttttttttttgagatggagtctcgctctgtcacccaggctggagtgcagtggcgcaatctcggctcactgcaaactccacctcccaggttcaagtgattctccagcctcagcctcccaagtagctgggactacaggcgcacaccactgcgtttggctaatttttttgtatttttagtagagacagggattcaccgtgttggacaggcttgtctcgaactcctgacctcaggtgatccacctgccttgggctcccaaagttctgggactacaggcatgagccaccatgcccggccaacttttttcatcttccttttggctaatataccttagggtaggtgcttgccaaggggcagacatttaatacaacacagataacatgcactctctagtatctatattttatgccttatgttctttaatgagtgtcttgttccttacaggacagttctttttactctgacgtctgtggttgtacttgtgattacaacggactggatcagctgggacaagctgaatcggggatttttgcccagtgatgaagtttccagagcattccttgcttcttttatcttggtctttgaccttcttattgtgatgcaggtaagtgtatttccctcccctcagtgaagctgctgcatgctctgttcccagtataacaaacaggatatggcaacaggctccataaatctaaataagtacagcatttacagttacttttgatggggccttctctgtttatattttcagctattatactgggagggaaagccaattggacttttataagaggggcaccaaaaatgtattttatgaacattgcaaggtgggcccctagaaaccatatagcacattggtattttctgcctaggctttagggggaaaaaaaacacactcagaaacaaaaaccaaaaatccttgtcatttagtaaatggaaagctgcagacatgaggattatataaaagcagcaaagcagggaaaagcaattgtcaaagcaactcagggttttatagcagttgaaatgaagtgatgtaaaaattctttttctggttatggaaattgttactttctttcagtattcaccagagatcattccattttcatgtaaaccatatttctgccctgcttagcaacagatttttcatacaatagcatcacactaaccagtgttactcatgtaatctggtgtgactctttggcgttttaggactattcttttgaatggggcagaaagagacactagctatttcttgctcattaaatatccatccatttgttagacattttcttattgctttcataaggcaatttttttccctcctgaggcattgtaagtcaccagaccaaagactacaattactgaaggaatactccactgtattctgaatttatgtgagatttcacaggatagcagattggttttctcatttctagaggcaaaaagaggcctttatgagagatattcagtgttgtctcaaaagagaataacagtttatttattgattttttttaaatttgttaaataatatatcttgggcattaggttcaagatggttctttgagtatattactactttaatggataatattttaaaatacactatcatttttaaaaattatttaaagaggtaaaacggaatatttttgttgcatttgaaaattgataaatttcttatttcctgaaatagcaatggaaaaaactttccaatctgactttgagttagacagcactggcaggttctagatctgcctgtcactaagctgtaggacgtcccatgggtatctacagaattgaatttttagcacttatgcaataatgtatcatgcattacttatataaaggctatttttatcttcctctatttcctaactaatataatttctcttgtaaaatgtccacattggccagatggcctactgatacctctctgaacccatcttaaagtcaatggtattagtagcccagtagactgttgtctaattgaatttgcttacattcatatatttgagagcataaattctttgattgtccattaccatcctcatgcttctactctgtttgtgtaagttttcagtattcttccaataagttcactaaaatcaaggacttcaagtgggaaaatataacattgtaatttacagatattatggattcactcaaaaactgcttaataaagacagatggaagaaagaaaggatagtcaggatttacataggcagagtcagcaaaggggaagggaaagacattctagatgaaaaaatatcataacaatgtaaaatgttaataacatgctgaagtgttcagagagtagtcagagcaccaaatgaccgacgatgaagagtttatgctgaggaatatttaagtttggaccattttggctacaagtagcaataacccggccaagctaacttaatcaaaggaggaatgtattgctgcattttagggatatcctacccaattcaagaggagggatgtagttgcctctagggacacatgaaagcagagaccagggtgtaacagggaatccagacctagcatttattttccatctcttatcttttttgtttttgccttctctttttttttctcttattgtaaaatggcctttccaggtttctcgttcaaatggaagaaaatggctactgccgacacctcagagggcaatcaccctctagctgtcaggcctgattccagatttcctaggaaggaattggagaaactcatgggctcagcatgggaggctatggtgatgaggtcatctgaaagaaaaggggagagaggttgggctataactccaaattagtaggtttctaatataaagatgagtaaaaaattagccccaaaatttaggtctcttaacttcttcttttctgtctcccctaacactaagtcagctagccaggcctactgatttatctttatgcctttaatatcattcttctttctcgtttccttgccaccattccagtcttgactcccctctatactatttaatctcctatggatcttctgccaccacacatccacgtaccatatgccctatgcagctcttcttcataaccttccagttggaaatgtcatgttttacacttctcagccctagatattgtccatgactcctcattgtccgagaggagagtccagcctctgggagctctctgagtgccctccatggtctggccctgactctgtattctcccacgtcttctatgctctagttccacccagatcaacatatttgctgctgggcatttgcccacagcatacttattccccagtgtcaggagtctcttgttcctctacagattgtgccttttctgttctgctcatttggatcctaccattggagaccatttcaactttctcttcattaaagtcatgtgatcacttcctcttcagaactcctgtagcactttttacctgaactgcaaatcaatatgtcactttttccttataactcttcatatccatggagcttcccaagcaaagtgccttacatggcaggagtaggcccagagtaataactgcttgatgaggataaagaagtgacagctaagcactgagtcatgtgcaaactgtatccctctttgtgagcatcatgtagaagttgtaggaactagtacatgtggtaagagagttaatttaaggaaacagagccccagaaagcatatgtactcaagacatttgaaaatatataagacaaatatcctaacaagttcacaaccaactaaactgtgttctaattcatcccatatttacatattccagatgaaagaaaaataaagaagtaaaattagtgtcactgaaacacctgtccttattagaattatttaaatgatttgaaagcagtcgatcctaggttctctattggtaggaaaattccacttatactatagaaaggtattgtattttttttttttctgatatggagtttcactcttgttgcccaggctggagtgcaatggcgtgatctcggctcactgcaacctctgcctcctgggttcaagcgattctcctgcctcagcctcccaggtagctgggattacaggcatgcaccaccatacctggctaattttgtatttttttttttagtagagatggggtttctctatgttggtcaggctggtcccgaactcccaacctcaggtgatccgcccacctcggcctcccaaagtgctgggattacaggcatgagccaccgtgcccagctggtattgtaatttttttttaaaagaaaccattagaatttggtgctacttttgtaaagttctttttattatttttaataaaattagcaggccagttctgaatacttttagagaaagtaaatcattaatttttatagatatttactaaataggatttttctacctttattgttgtatcacatttttctgtggttttagtaaactcactagaactagggcataaacagataccagcaaagtgtaacgtgactcacacatgctacgtacaggacacaagaaataaattgtagagaaaacattcttctaaggaaaactttatctcagtttctgttaagtatttgtaattatgtcatttgatttatatatatccctctatttctttgcataagtatttgacttgtagcatatcccacccaccgttcttctttgctaggttaaggaaaagattcaggtaatggataccctaaaagtgcagacttcaccactacacaatctatccatgtatgaaaattacacttgtaccccataaatttacacaattttttaaaaaagagttaaaatatgtttgtaaacaaaggaaaaaagtgggacaaatggagcaaaatatccaaatagaaccttccagtgatcgtccccctataggagcatgaaagttaacaattcatataagaaagcacctccataagaaccaaaaatcagatgaatgatcacagtgcttggttttaacattatattaggaaagaggcactgaagagggtaagagagacagtcttgaattgctgatacctctcttcccccatcccccagcagtggccacgtggcacagaatctatgtgcttaggggagggaggagagcacagtgactatgggactttgcattggaacttagtgctgcctgtcatagcagaatgcaacacagggcaaaattcagctggcacacatagagagcatctagaccagccctagccagaggggaatttctggtagcctcccaactgcaggctaaagtgctttgggatcccaaataaatttgaaaggcagtctaggccacaaggacttggaatttcttggctagtccttgtgctgtgctgagcttggaggcagtagactttgtgtcatgcgacctagtgagacaccagccagggtggccaagggagtgcttgaaccactccttcttcaatccctagtagtgcagctcacagctccaggacagactcctttcctctgcttcaggagaggagagcagacagtaaagaggactttgtcttgcaacttggatactagcttaccacagtagaatagggcaccagagagagtcctgaggcccctatttcaggttctacctctggacaacatttctgggccagaagggaacccactgacttgaagggaaggactcagtcctggcaagattaatcacccattgtctaaagggcccttgggccttaaatgaacataaggagtagctaggcagtactcactgcagccttgagtgacatccagagccatgttggtttcaggtgaaacccaaacatccccacctgtggtggccatggcgagatattccttctacttgaggaaagcagagtgaagagtaaagggaactttgtcttgtagcttgggtaccagctcagccgcagtggggtagagcacagagttggctcctgaggttcctgactccaggccttggctcctagatgacacatctggactcatcctgggccagaggggagcccattcctgaaaggagagagccaggcctggcagtatataccataagctgactaaacagccattggatcttgtgtgaacatcagcagtagccaggcagtacttgccatgggcctggggcagtggtaaccatgaggaaagactcttccttcttgacattggctttggcaaagaatttatgacttaagtccccaaaagcaattgcaacaaaaacaaaaattgacaagtgagacctaattaaacaaaagagcttttgtacagaaaaagaaataggagagtaaaaagacaacccacagtattggagaaaatatctgcaaactatacatccaacagaggtctaatatctagaatttaaaagatacttaaacaactcaacaagcaaaaaacagataatcccatctaaaattgggcaaaagaacatgaacagacacttctcaaaaaaaaaaaagacaagcagccaacaagcatatgaaaaaatgctcatcatcactaatcatcagataaatgcaaatcaaaactgaatgacataccatctcacagctgtcagtctgacctattataaaaaagattaaaaagaataacagatgctggcaaggctgcagagaaaagggaatgcttatgccctaatggtgggaatgtaaattgttcaaccactgtggaaagcagtttggagatctctcaaacagcttaaacagaactagcattcaacccagcaatcccattactgagtatatacccaaaggaaaagaagttgttctaccaaaaagacacatgcacacatatgttcatccagcctaggtgcccatcaacagtggatcagataaagaaaatgtggtacctgaacaccatggcatactatacagccatgaaaaagaatgaaatgatgtcctttacagcaacatggattcatctggagaccatcatcctaagtgaattaacagagggacagaaaaccaaataccacatgttctcatttataaatgagagctaaacattgagtacaggtgaacataaaaacaggtactacagacactggggactactggagagggtagaagggaagaggggaatggaccgaaaaactacccatcaggtactatgctctctcctgggcaacagggccatccataccccaattcttagcatcacataatatacccatgtaacaaacctgcacttggaccccctgagtctataataaaattggaaattattttaaaaagaaaaagaaaaaaatggaaagtagatgataaacctagcagaaatctactcatatttctatatcaataaatacaaatatatgtgtgcctatatacatagatatatatgtgcaggtgtgtgtgtaatatcttagatttatgtgcatcaagttcataacagaagctgaatagaggagagactattaaaaaaagaaagtttcaaagatcaagttttggatccttatactattgatatctttcaatacttctgtctcctgtaatttatctaagtacctgcttgtcacctgtgtacatacatacctcctataatgtgtaagctccttgaggagaggaagtgttttatcaattttttcattcccacagcatgattagtgcattgcagttttaccataaatattttgctttgtgaaagagtaaaggaattaatgtaacattatttcacatgcaccaaataatgtgatttttcaagaggtgaaataccagcagcaggagaatgaactatcaataatattacatttggtcattttcactgaagtatgatcttacagtaattaactatctaaatataaatctgaataaattgtcgttaggtgttaaaaagcactctgtggtatagtcaaaaggcacttggagagaagtgatatttcctgaaaagcaattgttaatgcactgaaaaaataatcatgaaaattgcattccacaaacatttcaccatgtaacagatttgaagtgtgtttgtattctgttttgtgcgtggctctaagaagtaggttgactactttaaaaatagacattgtgactcttggtagactttattttaaaaccccattgacctgacgttagtagagcatttcttttgaggtcacagttgtggaaagtggattcagtcatttcagagcatatggcagagcaacaagcataaacctatgttaattaaatagtcatggtgttttaacaagttggaatatattttcaagataagttattccaactgattacatttacaggctacttagaaagaaagatttgtttaaatgtttgtccactagatttaacatctccttgagctttgggagtattttctataacttcttcaaactattttaagttcctctttacatgtgtttaacatcttcatttttccttactaaaggaaaaatactatttgaaaacacaatagtgctggcttctgttatagggtcccaagtggtgacgtggaataaagggcttatcacttaggtaatacctggattaaccataaatgcctactctcctcatggtatgtgcttaagggattaaatctcaactttatttactctcacttccctcattactgctagtacagcggggagacagagtgttcagggagaatcacggaggaggactgcatcatgtttattagcagtcctggcaacagacctccaaatagtagacagacttaacacggtgagtttgtccatacagaaggaaggagtccagccaagtgggtagtctgcatgaagtgccaaggaggatgtcctaacaggtggcccatggtatcagaggaatttggcagaaggtaatagtgagctggaagcattgggtttatcaggcaaaaacttttaggattcaatcatgggtactggagtgacaaacgcattcacttgaaaatgaaactaatggtctggttagcatatgatatagatgacagttgaaactgatagtaaattctgtgagggattatcgtgagcgggagagatcactcaggtttttatgtataacatggaaagaatgtagtttgaaggaattataagatttggttaagtaagtggaaaatagagacattcaagttttatcccaatttaaagtaaaatgcttcagtccctggggtattcgtttaaaagagagctagaacatgatttaaaaaactggaaatatataaattctatactactgcagatgggcaggaattttttcaaagccatcctgaagcagcaagatataactcatttgcatttgtctttttccaatgaatgtgctttttcttataattagagcttgaccatcgctctgaaaagaatatttcagccctatccctcactctcatctttgcatgtgtgtcaaggttggccctggaagtcttgtgtagtagttgctacttgtcattgtctcacttgtacccagtaaaaaaaagtgcagcattgaagactgacacattcagccatgctattggcacccaaactcagagcactgctgtacttcaggtcagaattgtataggtgatgctaaatgcaagctatggtgcaagcttttcctagatctgatggactgattctttgtaacttttttttttttttttttgagacagactcttgctctgtcgcccaggctggagtgcagtggcgccatctcggctcgctgcaagctccgcctcccgggttcaccccattctcctgcttcaggcttcccagtagctgggactacaggcgcctgccaccgcgcccggctaattttttgtatttttagtagagacggggtttcaccgtgttagtcaggatggtctcgatctcctgacgtcgtgatccgcccaccttggcctcccaaagtgctgggattatagacgtcagccactgcgcccggcctgtaactatttttaatggatgctgtcagggatatgaagtatttctatgggctcctctatgagctttttaagttacaatgataaagctaaggaacaaattacaaaagaactttgtaggcaatggaatcatggaagccagtataacaatcctctataattcagagcattcattttaaactcatgcctaaaataagaaatgaaaaagagctattgttagaccgacaagttcattaatatcatgaagtcatgaaattttagagcaggaggaaaatttaggatcactttttcatatcttgagttttacagctgaagcccagggaggttctttaatttgcctaaggtcataaagtcagtcagtggcaggacctgatgtagaagctgggtcttctgaacctctacccactaccccaacgggcagtttctaagtcaaggtttattaactctggagttggacgtgaagaggcacgttggagaatgttgtccaagaggctcagtgtcaagtctagttagattaaatgtggaatccagtaacaggagaccatatgagaacactgcacagtgaaatgaggaacaagctactaagatgggcagaatggtgcaatgaaaacactactggactaaaaagacaggagttgagggagggaagaaggcagaaaaactaaaaggccaacattcattgagcacttaatatgtactgggcactgtcctggatgcttagatgtactttatttcatttaatcttacaaaaccttccaataaggataatattattaatattatttataactttacaaatgagaagaaaatgggaatttcctaaggcacacagatacagtctggattcagcagaatgagaattaaaaaaaaaaaaaaaacagatctgtctgacttcaaagaccatactttttttcataacttgttttactgttgtgcatataaaatgaaataatatgctgtatacaaagttgaaaacaaagcacattgcaggtgataggaagtttagtgaatgacgggaacactcttgcaatagactaaagtcagggctgcatagttcttagtggcagtgtgaccttagttaagtcagcttgtttctaggaatccacttttctcgttgatagcatgacagttttttccttcctcttgttacaagatttttttgtgatggtcaattttttttaaatgcttgaagtatgatgtttttgcatgtcaaaagtacataatgtggatagaagaaaattaatttagttgaaaaatgtttcagtttttctttgaattacaattgatcattcagacctttggttttaactaagaaaaactatagtaatatgacggtatataaagaatttggagtaggagaaacaatgtagccataacctacaaatagaggcatactctaaggcagtgattctcactgttatctgatgataagaatcactgggggcagggcacagtggctcacgcctctaatcccagcactttgggaggccgaggcgggtggatcacctgaggtcgggagttcaagaccagcctgatcaacatggagaaaccccatctctactaaaaatacaaaattagccaggtgtggtggcatatgcctataattccagctactctggaggctgaggcaggagtatagtttgaaccctggaggcggaggttggggtgagctgagattgcaccattgcactccagcctgagcaacaagagcgaaactccgtctctcacaagcacacaaaataatcaccggaacctttacagagatgtgagttctctggatcagaagagctccaggagtttcttgtttagtaagtgggtaatggtgcctgggatatatgttcctttaaatcattacagatgattcttgcaatcatagttacctgcattagaagcacctgggttctgcttaaaaatgcagattcttgggtcttcctcttacatctagtagtatgagaatcactaggggattctgcctggaaatacgagtttaaaattagactatgatttctcagctctcatgtaactctggtaataagtgaatgtttgctattgctttgatcagatggctgtacatgacagaactgcaagaaaattctaaactgctagatgatagtctcagtttattgcatttgaagatgtttggggaattgttcagaattttgaatttctcctataaaactatatcactactgttgtgtatttgtggaaagctgaaaaataaaactaaatatattctggatacatttttctcaatttttatgtgagtatatatatatatgtatatacatatatgtatgctgaaaacgatatttatatctgagagattaccgtttgttcaacctttgatttcagtagctgagtacattcatttggcaagtcgaataaggtctaaagcagagaaacagcaggaaatcaaggaggtacatatatctcagttttataacaaaataaatttacacacaaaaatgtgtctagaaaaaagataagtagttgtttataatcccttcctgggccttctaaagagggtgaatgccaagaaagatcttttgttttaatgaatagggtggtgggtgtagatgcaaactggagaagctcaggaacctaggtgagtattcctgcctatgcagaaggttgagaagacttgttatggggaaagaaagagggaggacgtagagatgacagctgccacagccaacagaaattgtaacagagaggattttcaaaacaattttgctgtattatacataatgttacatcttacatccagcttcagcttcccaataaattttcagttaatattaaatatatatatgtatatatatatgtatatatgtgtatatatgtatatatatatgtatatatgtgtatatatgtatatatatgtatatatgtatatatgtatatatatgtatatatgtatatatgtatatatatgtatatatgtatatatatgtatatatatgtatatatgtatatatatgtgtatatatatatgtgtgtatatatatatatatatttttcctcccattcttttggcatttgatggccaggtcaatcctcctctttacatgccagatgggtttctgggcaagagccaggggaaggaaaaggtcatggaggccaaggtacattatttttcttaataatttcaacttttattttagattcaggaggtacttgtgcaggtttgttacatgagtatattgtgtgatgctgatgttgatgaatgatcctatgaatgatcataggatgatgatcctatcatctatggtgtgcatcatcctatcacctaggtagtgagcatagtacccaataagtagattttcagtttttcagcccttgtcccttcccttccctctctagtaatccccagtatctcttgttgccatctttatgttcatatgtacccaatgtttagctcccacttataagtgagaacatgcaggatttggttttctgttcctatgttaatttacttaggatgacggccttcagatgaatctatgttgctgcaaaggacatgattttttctttttcatggctgtgtaatattccagggtgtacatgcatcacattttctttatccaatccaccgctgttgggcccttagattgattccatgtcttttgctattgtgaatagctctgtgatacatatgtgagtgcacatgtctttttggtgatggaatgatttattttttattgagtatatacccagtgatatgattgctgagttgaatggtagttctgtttaagttccttgagaaatctccaaattgctttccaaaggggctgaactaatttacattcctaccgtcagtacataaacattcccttttctctgcagcctcatcagcatctgttatttatttttataatagccattctgacagatgtgagatggtatctcattgtggttttgatttgcatttctctgatgattagtgatgatgagcattttttcataagcttgttagctccttgtatgtcttttgtttttgagaagtgtctgttcatgttcttttgcccacttttagatgagattatatgtgttttgcttgttaagttgtttaagtatattacagattctggatattaaacctctgttggatgcataatttgcagatattttctccaatactgtgagctgtctgtttactctgcttttcattttgctgtacgaaagctctttatttaattaggtctcacttgtcaatttttggctttgttgcagttgcttttgaggacttagtcataagttctttgccaatcctgttatctacaatgttattttctaggttttcttttatgatttttatagcttgagattttacatttaaatctttaatcccatcttgagttagtttttctatatggtgaaaagtagggggacagtttcattcttctgcatatgactatccagttatctcagcaccatttattacatatggagttctttccttattgcttatttttgttgactttgtcaaaggtcagatggctgtaggtgtgcagcttgtttctgggttcacttttcagatctattattctgtctgtctgtttttgtaccaatatcatgctgttttgattactgtagccatgtagtgtagtttgaagtcaggtagtgtgatgcctctggctttgttctttttgcttagcattgctttggctattcaggctctcttttggttcaatatgagttttagaataattttttataattctgtgaaaaaagacattgatagtttgaaggaatagtgttgaatctgcagattactttgagcagtatggacgttttaatgacattaattctttcagtctatgagcatggaatgtttttccatttgtgtcatctctgatttttttcagcagtgttttgtagttctccttgtagagatattttatatccttagttggttgtattcctaggtacttttttgtgtgggtgggtattgtaagtgagattatgtccttgatttggctctcagcttgaacctctttggtgtatagaaatggtactgatttttatatgctgattttgtgtcctgaaactttactaaagttgtttatctggtctaggagcctttggcagaggctttagggttttctaggcatagaatcatattgtctgcaaaactgagatagtttgacttgctcttttcctattgatgcgttttattctttctcttgcctgattgctctggctaggacttccaacactatgttgaatagggttggtaacaggatccttgtcttgttccagttctcatggggaatacttccagcttttgcccagtcagaatgatgttgactgtagattttttatagatgactcttatttttttgatgtatgttccttcaagggcttatttgttgaggttttataatgaagggaggttggattttatcaaaagccttttatacttctattaagatgatcatacagttttggtttttaattctggttttgtggtgaatcacatttatttagttttgtgtgttgaaccaactggcatctcaggaataaagcctacttgattgtggtgacttaactttttgatatgctgctggatttcatttggcagttttttttctttttttgaggatttttgtgtctatgtttatcagggatattggcctgtagtttcttcttctttttttttttttttttaagacaaagtctcactctgtcgccaaggttggagtgcagtggcgcaatttcagctcactgcaacctccgcctcctgggttcaagggattctcctgcctcagcctcctgagtagctgggactacaggctagttttctttttacattgtgcctttatcagtttatggtatcagggtgatactagcttcatagtatgagttaggcaggagcccatcctcctccattttttgaaatagtttcaatagaattagtacgagctcttctctgtacatgtagtaaaattcagctgtgaatccatctgatccagagcttttttgtatgtaggtttttttgactaattcaattttgtaactgggtattggtatgttcaatgtttcaatttcttcctgattcactgttggggcttgtgtgtttccaggaatttatccatttcttctagagtttctagtttgtgtgcatagaggtgttcataatattctctgagaatcttttgtgtttctgtggaattggttgtaatatcacctttgttgtttcaaattgcacttttttggatcttctcttttatttgttaatctagctagcagtctatctgtcttgtttcgtctttcagagagccaacttttgggttcattgatgctttgtatggattttggggtctgaatttcattcaattctgctcttattttaataatttcttttcttctgctagctttggagttagtttattcttagttttctagttcctctagatgtgataccaaactgtaaatttgagatcttcctaacttcttgaagtagatgtttagagctataaattttcctgtcaacactgtttttgcttcatccaagagattttgctatgttgtgttgactgttcgtttctttcaaagaattttttactttctgccttaaattcattgtttacccaaaaattgttcagagaaaagtagtttaatttccaagtaattgtgtggttttcagataccttcttggttttgattttatttgtattccactgtggtcagagcatatggtgggtatgatttctattttttctaatctgttgagacttgctttatggctgagcactattgtgtggtgggctaaggcttttcatagatataggagtatttgtattattaatgtgggtgctccgatgttgggtgcacatatacttaggattattaaatcttcttgttgaattgaacctttcatcattatataatgtccttctttttcctattttattattgctggcttaaagtctgttttatctgatataaaaatagcaatgatataaaaatagcaacccctgttcttttttgttttccattttcatgatagatctttctttctccagttctttactttgagcctgtaagtgtcatttcctgtgagaggggtctctggaagacaggagacagactttttaatccagtttaccactctctgtgtcttcttagtgaagcatttagactattttcactcaaggttaatattgtcatgtgtggttttaatcctatggtgaaattattaactggttgctttgtagttcctgttatataattgctctatagggtctgtgaactatagacttacatgtatttttgtggtagcaggtattgttattttgtttccatttttaaaattcccttaaggacctcttttaagcctggtctaatggagatacattctcttagcgtttttttattgttgggggtgtctggaaaacattgtatttttactttgcttataaagcttagtttgatgggatatggaattcttggttgaaatttctttcccttaaggatgctgaaaataggcccccaatctcttctggcttgtaatatttcagctgagacatatgcttttaaattgatgggattccatttgtgcatggtctgaactttttctctagctgcctttaagattttttctttagcattgtccttgggcagtttaatgactatatgccttgatgatgttctttttgtatggtatctcacaggtgttctctggatttcttgttcctgggtgtctacctctttaaaaatactagggacactctttgtactattgcttcaaatatgttttccagattgtttactttttctcctcctctctcaggaatgccagtaatttataaatttgtttgctttacataatcccatatttttcagactttgttcattaaaattttttttctttattttagtctgacttgattaattcaaaagactagtcttctagctctgtaattctttttctgtttggtgtagtatattgataaaaccttcaattgtattttgaaattctttaattgaatttttcaatcctggaagctctgactgattttctttaaagatgtttatctccttcttcatttcctggatttcttcagaaatttctttttctttttctttttttttttttttttggctttcatccttgtcttgaatcttgttgagcctccttgcaatccaagctttgcattcttaatccgtcatttctgagtgtctgttttagtcagggaccattgctggagatctagtgtgatcctttggtggagtcacaatattcagatttttcatggtatgagaaaagttgcactggttctttctcatctggagacactggcacttctaatttttgtaattattaatattttcatgtgaataggattttcccctttctttccctattatatatatatatatgtttttttttttaatttttctttgtttttctccctagtgggtgtaactgtaaagaatgttggctagggtcttttggctttgcttcatttttttgtttttgtttttgtttttgagacaaagtttcacacttgttgcccaggctggagtgcaaatggcgcaatctcagcttactgaaacctctgcctccagggttcaagcaatcctcctgcctcagcctcccaagtaggtgggattacaggtgcctgccactacacctgactaattttttgtatttttagtagagacaggatttcaccatgttggccaggctagtctcgaactcctgacctcaggtgatccaccagcctggccttggctttgcttctatagccctatgcacttctgtcagctggttttatgttggactgtgtggttctacctacaggccagtagatggcacttatgggtaaaagtcagctctggccaacgtgaacgggtatatatttcaaccttgtttactgggaggtctctgatgctgcaggcaatgggctgaactgtttagtgcacagtggtcttagctccctactcaccaccacatgagggaaccaagagagtagggcctggactgggcaggctcacctacagccactcaatggcaggtactagcaccagcacctaatgcgtggccacctagcgcccagaggtatgtctaggcatggagcttggtaacctgcttggccctaagttctctgcatggggaggggtgacggcccgaactcctaatccagtagagtggatgcacctggagatcttcctgggcatgtagcatagggggccgtactgcaccacagtctctccacagaaagtgtggggcaactcaggccactgacccaggcaagggggtacttcagatgcctggagatatgcctaagcatggagtggagagggtcctgttacatcacaatctatgcacaggaggggtgggagactcaggctgctggtccatgataggaagtgctctgattgtctggagatctgcctgcatgcgtggaacagaagaggccctgctacactctaatctatgtacgttaaggtgagatggctcaggctactagtccaggagagtaggtgctctgaatacctggagttctgcctggatgtgtagcagagagggccctgctacaccctaatctatccacaggaaaggtagggtggctaaggttgctgatccaggcaacagggtgctccatctgcatggagatttgcctgggcatgaagtggagagaatcctgctacaagccaatttatgcacaggaaaggtggggtggctcaggctggtaatccagaagagcaggtgttctcaatggccagaaatctgccagggtatggagcagagaggaccccactgcatcccagtctatgcacaggaagggtggggcagctcagcctactgatccaggagagtgggtgctctgactgcctaggcatggagcagagaggtctctgctgcaccacaatctaggcacagagagggtgggatgactcaggatgcaaattcatgtaagtgggtgctccaaatgcctggaaatctgcctaggcatggagcagagagtgtcccctgcaccatgatctcaggtgagcaggatggagctcccagcaaggtcacacacaggccatttccaggtggccaagctaggcctggctacaagtctcattgctcaagagaaactgtcgctgtagcagcttccctctcaccctagaactacacacggggagcacaattccagcacctacaactggggcactgtccacacgcaccattcaattctggctatggaggcctctactcagcaccagagcaagctctgcaatctctgatccaagactataatgcctgcatggccatgctgctgggttgtcaaagaattactgactttgtatgcacctggattaaaaatggcatcctgctctccatcctgagtctgggaaaatgcctgcaggaattcctggtatcttttcctctcaatgtccccaagcctcaccccaagctagtcccaaggcttgggagaaacaaaatgctctttcttgtcctgggttgcatggatccccattggaaaagtgactcacagagggaggctctctgcccaccccctgttctgggtcttcactcacttttatttaccaaatgccttcccaggggctgcttgcccaccttctcctccctggggtctgggacgtccttcactgtcttaatgggttcccgttttcccttttgaattaaaattcatgcatttgaattaaaatgtatgattttgctgtttccaagtggctaagacacactgcaagcttctaatccgctgtcttggaagaaaaataatgcattttctgatgacgtaaatacaaaagtgctaagttcttacatttattaaatgagtgtagaaataagatctggtggctgcattcactttgtcttctgactaccagttaattcaatatttaaaattcattctttggttttcataaaattacctattttttttcttggctcaaaacctaactatatgtctctttctttccagtccagtttgtcaaatttccttcctctagctgtccattatacatactctgtgattctgccctgtgtttccttatcttctcatccaagttattttttaaggcagttctgttcactgccatggcctaacagcctcccaataggctagtctttctcaaatcttcctcaagccctaagacttctgctgaatttcagacctggatatctaactggcaaccagctctatccacctggatgtttacgtgggcatctctggttcatcatgtctaaaaccaagctatcatcaacccttcaaacagttatctatccagtcactcacaccaaaaaaccttttaaaaatccaagatttctctttcctacttatcttccagtcagccatcatgcctatatattcttcttgccaaatatcttttgaatctgcccctcctttagactcttatcacctataccttacagttcatgttaccatcaacttttgcctatattagtacaaagccctttctcttcttttggtcttactccattattccaaagtaatctttttaacaccaaaatcttatcttcaaaattctttaaataataattcatttgcatgtcatctatacaaggccttttatcatctagctcatgcctagcttctgaccttctcttcctggtcattatcaccaccttccctctcctacccccacctcttgcattttacactctattaaattttgaaatacttgttgattaccgaattctgcctttttaaaatagtacagacctttgcatgtgcaatacaagggcatctccccagtgtgcgtgcttcactgccctcagccatccaaccctcagcttatatgctgtcctctctgtgaagtctcatctgcctctctcaaataaactttagtgcttcttttattatttgttcatggcaatttttaaatatttcgattagagttattttactcttccatttaaatttgtttggatgtatttaattgttttactaaaaagttgtaagaattgcctagaatagttcacgtcagacacagagaatattcaacagatgttggctgaatttagaccagcacctaaactagttcctttcaggtcattgggactcaatattcacattttaaagaaaagattttagagtattctcaactgggagcaattttattttttcatttctttagaatttcggatcaatgtacttgtgtgagctatttttaagataaattttctatgtgataattgtatttgaattgatcagaaactgaaagatttgttttacagggattatttaaagcctgttgacattagacaattcctgcattaaatttactgtaagctgtaggagtgtttatgatgtaattcacttttcatagtattttacaaagcacaatcatcatagacccagagtagattgtttgtgctgactcctttatacatctctgagcccagcttttcttctggtaactcttttagttgaaatgggtatcctctatgcgtgccattggcatatctcctagagacagctgcaaagagtagcaaaatcagggggtatgattgttcttccgtgtattatgaagcaagctaggaaaattctgaatgcaaagtcaccaggaagagattctgaacatggcagaccccatgttgtctttcctaatccctagaagaaggaaaagaggtaaaaatattatgataaaatctggattcattttgctactgccgacagggatgaatctggtgactcccacccagaggtgcttccttgagaatggagagatggaaaattgcaatcacagactttcacattaggagtaaaaacttatattatgatgggtgaaaaaactatgcctaacgaagtacaacttttaagagctcataaatcttgagctcagtcatagattattaatttagaaaaataacaactatgtattctcaactgcaagctactcaatattaataacattagtgtgtattgtatatccagatagagaatcactaaaggtttcaagcttagtggcaaatgtatctttaaatatgcatttactatgctctctgtaataaaatgaaaatcatggtttatttgatggaaagagaatgatagtttgtaggctttcacaataaaatgagagaacttgaaacagggattctcataaaatgagatttttttctaaactggaaaattctctagccataatgacctgggtagggatgggagaaagagaatgaagtgtaacaagggcgtaatttcatttgaataaaaggaattggcgacttatgtcagagaagctatgttagagatatctaacggccaaccagctctgtccatggatatctacccagatgttgttacttcgtagcatggctcgggtattagttctctctgcatctgcgtggtgagtagctctgagacatattcttttgacctctaggattccttaggtcataaagtgtgtattttctgacctaacgaggcaaaaatgtaaatgaatgatagaacatctttttaaaattgattcccagagatctagagtgtttatacaccctctctgttttcttctcagagttgcagaaagcttcatttcgctactaaaaggtttcctgattcccttatctatcagtaagagtaagcccaattctaaaaaatgtttttagaaaattactttcatctctgcatggcctggaatttgcttgaggacaccatgaatagtaggtcatcaccactacatttcaggaaagagagccaatgtaactatttttgaacgtctttgagatatggtttaaaactatgctataaaaaggaacttgcaaatctaattaatatttaattttagtctcacgatgcaaagtaacctacatggacattttaatgccaaactgccagataggttgtaagaatatactgtacactcacaccaatagtgactggaaatacctggtatagtaggcagaataatgtgctccccgctggccggccccccaccaaaaaagatactcataccctactcccaggatcctgcaaatatgttaagttgcatggcaaagggggattaaggttatactagaattaggtttgctaatcagctgactttaaaatgggagatttccttaaatttccttatccaggagggcccaatataatcacaggagtctttaaaagaggaagagggaagcagaagacaaccagagagatagcagtgtgagaaggacttggccctacattgctggctttaaaggtaggagtgaaggccataagccagagactgtaggtgacctctacaatcaataaaaggcaaagaagcacattcttccttagagcctccagaaggaacacagccctgtcaacaacttgattttagactagtgagacccattttgaacttttgtcctctagatctttaaaataataaagttctgttgttttcaggcactaagtttgtggtactttgttacagcaggaataggaaactaatacacttgattttctccacatctttcccaacactgagtgttaactgattttttaaatcttttgctagccaatagtcaaacataccctattgctctttttttattattattagttagatggatcttatttcctctattagatgcttgatgaatattcatattgttttatgaacatccagctcacgggctcatcctatttctttattgaggttttagggttttttcttacccatttgaccatgtagtatcacttttgctgttggtacctgctaaaacattaagaaaataacttattgttttatcaggaatttatgatgaattttatagagcacctttttacattctaggtaatttcatgtgctttctttaagtatgttttctactttgaactattaatgtaacaaactttaagaatagatttcttaccttatcccaaacttacattactacggtgtgtcccactttgtggtactgcattattcttttaagatacttctgaatccagttttgcatctatatttataaatgaggtgtgtgtattctttttttcctgcaatttttaaaatcatggttatgttagtcttataaataagctgaagcccttctgtcttttgctgtgctctagaaccatttacatatataggagctatttgtggtatactctatttttttcctgcctcattactgatcctctttcttcacctcattttgacatcatttcaataattttaatggtatttagagagaaaagagaagtaaatatagtatctcaaattgttatcttgaggtagaacctgccccatcttttaaaatcagaaagcttttgcattcttgagccattctcatataattatggaaggaaaaggaggtgagacatatgaaaggattgctttggagagttgttggcaagttgacttctgcttgcctgtaatttcattaatttcttttctttccccttcttttcctatgatgatactattattagtagtactattttcaccatcttcaatatcattactatgctctataacatattagagcctgtttacactgcactaaattatagttaatcctttatactgtaaacttgggctgtattaacggaagtgtccagggtaagggaaatgataacttcatgttactttttcatggtcagaatatttcagcagaattatgttgagttcagggtactacattaaaaatgtgttgacattttaagtaacaaaaacattacaggttctttgggaaaaaaaattgaaagactaaatagtaaaaaggaaacaaaaatgaccctgatacaaccttatggataaatccatcattctaggcttcaatctgtgcacataattcatatatatttttacaaaaatagaattatcttctatgttactgttttgcaaacctgctttttcaggtcacaatatgttgctaacatttctcatgtcattaactattctttcccaagatcattttaatgaatgcattgtaattttatctgtaactgtattaacagattctctattgttaaatatttgtttccattttattactatttatggtgcagcaatgaacaagatatggtgattattttcttgagataaattcctggaagtggaattgttggttgaacattatgacttataataagctaagccaaatttttctctagtggttatttcatctctcattccatagtaagagtaaaaaggcaaccattccttaaaccaacaaagaggactgtatttatattagtagtttccaatttgattgacaaaaaagaatatttcattttgacatgcatttctttaattacacatgtccatgatctctagttcaatgattcttttaaaatttggattttgtttagatttttagcaaggtaatatagaactgcatattgtacaaccacctcaggggacctgagatttaaaagctttaaacaaacaagccccttcatctttctacagtgaaaactatgaatatccacactaagtgggggcagacattggccattcatattctcccttattatcaggttttgccatcaggtccagttcagttttgctgctgaatgaatgatgaaaaatctttattttcagagcttttctatttcaaaattgaggacaagggacgaaagatgtgcagtggagatattttttctcaactatttatatttatattatttattatattatttatagctatttatatttattctttttgtgaattggttgttcacatcctttacataattttatcttaggatggttaatatttttctcattgtcttgtaatagctccttgcacattaaagaaattaccccttttcctgttatatatgttacacatatttgttctgagttttatttgttgagattgtttacaacagttgttttcaagattgaatctacccaagaatcacctgatatgtgtgtgtttatgtctgtatgtggtgtggagtgggtgtgtccatgcgtgtatacaaattcttgaacactgctcatagaaaattttatataaaacatataaaaaaggtcaggatagaactctggcatgtgaaggctgggtgcagtggctcacgcctataattccagcactctgggtgtccaaggggggcagatctacttgaggtcagggattcaagaccagcctggccaacatggtgaaaccccatctctaccaaaaaatacaaaaattagccaagtgtggtggcgtgcgcctggaatcccagctcctccagaggctgaggtgggagaattgcttgaacctgggaggcagaggttgcagtgagccaaaatcctgccacactgcactccagcagcctgggcaacagagtgagaccctggttttgtttttgtttttgtttttgttttttgttttttgttttttatttaaaaaaaagaaccctggcttctgaatgttagaaagcccaaatatgttattaatgcagaaatccatattttaatttatgagagggtgtgttcaacatacagttgttttaaatgtatcaatctttttctttgtgatatctgctttttatgttaagctgaatgttctgtgtttcaaatgagacagtgaagaactggaaagtgtgtccagagaccaacatccaggatcttgagagacctagagaatgatattagaggactgatggaggaaagggaggtgtttagcttgaagcatagactttcagtaggaacatgctctctaccctcatgtatttgaaagactgtcatatggaaaagagaatgtagctattctatgttgcatcagatcatatgaagagcaatgtgctgaaattcagggcatcaaatccatcttccactgtgagttttcctttataaaacagctctgatcatatcactcccctatttggaaaacttctgtggcttttgttgtctttaaaacattcaatgtcctatgaggccctttgcaatccaggcctcattggggaacttcaccacactattcaccaaatgtgtcgcccaaatgaatggttctatgtttcttaaaattcagtaggttcacactgtcctccttttcaaactgtagagtttcacaggctacctatatactgaagcctccttctttctagcctgagccgtatgttaagctctagtcaaggcggaggccttggaagtcagtttctcaacagcctctctgcagaatgtcaccaatttgacctaatacaaaagataagtcattaaaaaacttgataaagtacttatatttgtatatatttacctatatttttatgtatttaatatttattggctatactgtaggtactggggctacaaaggtaattaaatacatatcctctcttctaagaaccttaacatctcaaaaaaaaatgaaaattcaataggaaagattagtgaatatttaaaaattgaagaggtgattacaactctgtaattcatatttcagccattgttgaaatttgaatgaatttatagtacattcaggtataaaactatctttggtaatacagtgtttaggaggataaataaaaggaaaagaattaaacttgtttgagttgtgtagaggaataacaggattgtgtttggaatcgaaatgcataatttttgccaagatgattaagtagaagatgtttatgattccattgaaaatttgattggtgttatacagtatgttaactaaaagacacactcatttttacttgctcaggaatccttataatgttcattaaagtgcctgcatgtttttgcataacaaaagagaatgtgcatagttaaccaccgaacatcttgggataataaacattttatatattttaacatctgttatatttatgtttcattctggccattaacggatagttttaacttccatgactttttttttcttattgttacatagaaatatgaagcaggagttctagtttttctagcaatcagttactcaggtgtattgcatattgcatttagagtcagtcctttcagatataagtgtgctgtgcaggaaaagttccgagtcagtaagaactccacagttgccaagatcagaagcccctaatattttaattccatatctccacacttcctgagctggctagtgagctgtcatggaatgcccattaaggaaaatgcatcccaccacattacatactgtgacttaaacatccagacccaggcctgaacttctgtgacggattacaaatgtgtttttctctatggagcggtgagccagttaagtaatttgtaaatagtgaacttgtcaaccaaatgtggcttgatgttatctctagttgatcaaaaaccctagctttttctccagttgattaatgacccttttattctttcactatggaacattctaagagttgatactaattgtattagttatggctgatttcctttggaagttctaaaacagtgcataaccctctagaatatgaactccttgaaggcacagccatcgtacatatcttagtattgccaccatttggccagtgtattgcagtaagagttttcataaatgtgcgctgactcaaattgaattgaattaacttcatttgccatggaagataaaaactattaagaatttcagcactgttaacattctcagttctgtgtaggggttgaagatttacagaaacagtgcattttattctgccagtaagtaaataactctacaagaaaactgctagcttttatagttccttcgttcagctacttttagaaaattagtgtcacggatcagccacagcagcaaattctagccagacaaagcacgtgttacaatcactgatataacttataactaaaagatatctttggttggaatttagatgttttccccaaatttaaaatttttcaaatctttatctttttctaccatttcaatttgcttgtttctacagaattctagaatcttcttgtagcagaaagatcttttcattaccaggaaagtcagataccattcaaaaaaaccaatgtaatgcagaaaagaaagtgtcataaatagttcttaaatatagattttatcagtaaacaagtctcttgttacatcaatgattcctggaatcaggatgaggtgctttaaaggtttagggacctgatgtaataccagaaataagacaagtcttggatagctcaagacaaattatacttctcagaaccctaacttccacagagatgccacatgggtcgcagaagggacaagcagaagccatgaagtgagtagtggatgggagatggactatcccaccacaaccagaacaccttccatcttattgcagattcctataaaacatctctcagggtttcactgtgtaaaatattttgactgctacagctctataacagtggcccaaatgtaatatgaaattacataggaagaatgtaagggttctgagtaatcacagtgcaaacatacagaatagaggctcagcagcaataggtgtgaaaatatcctgttgcacagtatcaaccaataccatgatgtggctgccccactaaacacacacaccaaaactaataagaactggagctgtattaaaagaaataaggaatttaaagcagtggaggtgagcactagtctgaactggtcaacttcacgtagccagaatagtcttcagaaagatgtacataaagctgtaattcccagctgtctgtaccgtatttggtgtttaacccaatctttcttcctgttgtgatagtgttgacatctatcacaatggtctgaataaagtcttccttaccattttaaaaagtgtcagaatattgttttcttcaacacaactactacctcacgatgcatctccagaaattttttatcttgtgactctgaaactctgtgtccactaaacagtaactccccattcctttctccccttgtgcctgagcaaccactcttccactttctgtctttataaatttgactactctatgtacctcgtacaagaacaatcatatagcatttatcctattgtgtctggcttacttcacttagcatatgtctttaaggtttatctctgtcatagcaggtgtcagaatttcctttctttttagggctaattactatgtctttgtatgtatataccgtattttgtttatccattgatctatccatggacacttgggttgcttccatcttttgtgaataatgctgctatgaacatttgtatgatgggcatagaaatgtctgttcaagttcctactttcaggggtttttttggaaatatactcaaaagtagaattcctggatcatctggtaattctatttttaattttttgaggaagtgccgtaccgtttacattcccactgtcaatgcacaagggttccaatttctccacatcctctccaacactgttattttctggatttttctggattgtagccatcttactgaatgtgaagtggtatctcattgtggttttgattgcattttttaatgaggaaccttttttaaaaaagttaacttttttatgtaagttaaaataaaacctttatttctaagttatttggggctgttcctcctaataaccctagaagcctcctgactatgctctaaggcagctctgtccaatggaaatacattgtgaactacatgtgtaatggtaagttttctagcagccacattaaaaaaggaacatgtaacattaattttaataacatctttatttaacccaatatttaacccaattaaaatattataattctacctgtaatcaatataaaattattgatgagatattttacatttttttcatactaagttgttagtgtgcattttatacttatagcacatctcatttctacctgtccacatttcaagtgtttaatagccacatgtagctagtgactaccgtattggacaagtccaagatcttgattctaattgaatactcactaatcttgtgacaaattagaaggcaaaaacaaccaatgatcatatgtgatttgcagaaatcctatgtccataggcagcttgtgcatggaggtaacgtttccacctcaccaacatccacacattgaccatgtgtatgcacactcacacatggaaggaaacctccttctggatagaagtagcaacagggtctcactattttgttatattactataaggtaatggcattgttttatactattttacattttaatttaaaactgagagtatttcagctaaactataagtttaaaaacattgtttagcaagtctgggaacctaaccccaaattatttgatttcccaggaatcaatatgtaaacaaagtgtagaatcacaacatttatgatttggtcaatttctgtgtggaggtgaccactgaatatttgatttagatctccaataagggcttttaattccactctagtatttcttctagtgggacctttttttaaaaaaaaaaaaatctttttttctctttttttttgttggcagcaggtgagccaccttagtagtactatttaaactctttgatcatctaaatgactctttaagttaaggcactacactacaaagtaaataaagcaacctgggtgtcaaatcagacattgtcacaagagaggtaagatcctctgagagctttgtcagctttaataaccatggtgtttcataagctgagagttgtcttcagggcccaactgtcactgaaaagcccatgatggtgtttcttgggctggcatatttatttcctctgtgcacagcctccacactcaagagttaaagagctttcaagtgataagataaggaactgttagataaggaacttcaaatgataagataagaaggaactgtttatcaatttaagcttaaatgttgactgtttagatagcagggtgattgttcatgaattaatgatgcagtaaagttcatttacatttaatggacaatattaactatctttccaagcttcctatagaattcaacaattttttactgctcaaagttttgaataccctttcttgtccactggaaatttttcccttcctctagggagtggatacctggagaccgaatccatgcctgctactagccttcagtaccccaagcacccaatttcacagcagtactttgtgacacttgctaattcattgactgatgaagaaaactttattcttgtcaccttgggcacataggttttatctgtgctgccaaaaataaatttaattaattaagataagatttattaataatgtgtgaatgcctaccaatcatcaactctgtgctagaggcatcacacttatttatcaatttatcacatatctgaggcacatgtagatggaacagccactttttctgttacatgtatgtaaaccaagtcccagagaagacacatcttgactgcatctgttaccagctctggcacactggctatatttaacctctctgggttccagtttcccatatctataaaatgggggtaataaaactaagtgttgctataagaaataaattgcatagttttattttaatagctttccttcttcactttgtaagaatggaataagtttgtgcagagcatttcacttcttactagaaggtggaaaaaatatcttcttactttgaataacaaagccagtctttgggttatgccaaattgctctgtatcagacaaacaactggaccaaaggaaaagaaaaccaagtgggcttatttaagcctacctttgaatattttataataatatgaccactgataaaattgttctagatccctgttgtaatctaagttaaaagttataatcctggcataattaatatctaaattctcaagcactgtgagagttctatcaattctagaatttcatagaattaggagaagtatggaatttattatagaattttcataagtctatgaacttttttttcagagccagcttccagctaggagcttataaaaacaaattaaacaaactactgttactacacacacacacacacacacacacacacacacacacagacacacacacccctacacttagagaaattcttgactagaaataaactgtcctaaattgaatatcagcatttcccagcattttcatagtaagtataattctctgtgtgtgtgtacacagctttaattaatataaaggattgaaaatatccatatctttaagatctcttttactttaaaataatttatataaagctataccgattctgttgcaactgacattaagagattttaaatgtctttgtacattgacagtttcttaacacattacatatttttattacagtttgataagatgtaaatgattactgaagagtgttccttaatatttcaaaactgatggcaattgtgttgtcaaaaccacccagacaatttatagatctctcaccaatttgagactgcattgttcttactggaagtgcctttgatcaacagctccaggtttcttgcttcagaatgcatggagtaagtgtactgcatggagtagtgtcatttatttgataagagctttttaaacccaaacaatatgccaggccctgggcataaaatgtggtggataaaaccggaactgcccttttggagcctggaatcttgtgatagaagtagatattaactaatgaattatagaaataaatacatattgatatggtttggctgtgtccccacccaaatctcatcttgaattgtagttcccataagcctgacttgttgtgggagggacatggtgggcagaaattggatcatggaggcagttacccccatgctgtaatcatgatagtgagttctcacaagatctgatagttttataaggagctttccccctttgcttggcacttctccttcctgccaccatgtgaagaaggacatgcttgcttccccttcctccatgattgtaagtttcctgaggcctccccagccctgtggaactgtgagtcaattaaacctgtttcttttatgaattacccagtcttggacagtttttgatagcagcatgagaacaaactaatacacataggtacaagttgtggtgatttgtattatggagaagtaaagagagataggaaaacactgaaaaggggagagacatggcatggtctggggagcctggttagagtttacctatctgactgatcaaccccatgaagaggttgatgaaaggaaagaactgggctttaaatggatatgagcttgggtttcaaatctgtctgctgttatcctgagggacgatgctaaacctctctgaaacctctgttttctcatttataaaatgaattattgtatttacctcgatagaatttttagagactttaaaatagatttcctggtggctgacacataatgtgcatttagtaaacaataatgttctttcttggacttctcttttgatgacaaacttttgcttcatgcctaataagattgtattctgcttcttaagtatgatttcaaatcctattcatgacaaagactgtcaagacaagtaattatgacataaaattgtatctgctgtggaaatacttatattcaatgtagggctttttatttcaggtcaaatatttggtaatataattaagggaatggattcattgactttaggaaaatagcattcatcctggatatcattagattggctaagcaaagctatgtgacttaatggaaaagctaccttaccaagatttaggagtacatgattgtcgttgaggctcttgaaaaggcatggtgcagctctgggcctcaggtgaaccctaagtcttttttaatcaccttggaaagctgaagaatgtggttggtgcacatttcacctgcatgattcttattctttctgagatttttagcttaagagtcacctcttctgagacacgtggcatgattacttaaggtttggcttatgtggcactgggcttcagaaaggaggttccattaagagaaccttgcaactctttacttaacgcctggatgtaggacggaatcctccaccacatgatgctctccacgaggagtggaatagtggccaccacactcctcaactcttggcacagtgacatttaaaaagtactgtttcatgagtatctgattcatgatctaagaaaaaaaattcagttatatgctcaacactataaaaatcttctgaaaaagtatatagaatggcctttcactgtgatattataatttcacaaggagagcaagccaaaacacaaacaaaaaaatcagagaatgtaaggggggcattataacatgaggtatactctgtatgttcatagcctccagaaattgtcatggaaaatttgggactttggagactggaagagaattcactaagtagaaaagcagacatggtatattgggagcactgtaggtgagatatggaacattatggtgataggcttgagaagagcaacagagtccatgatgattgtcagtggaaactaacactggatatgtggcctgaagtcagattatggaagcacttgaaaattcagaggagtgtagaaaggtggggtcagaaatatggagacattagtagcttttagcatgaaactaacatgcttagaataaaatatttagattagattacaacagatgaactaagtctaaacagaataagtctctgagtaaaatcattttaaagtaatactttatatgaaaatagtatttttaattcactctcattgcttttttctcattgatcatcatagcagttcaatcaggtaagatgatacttgtatctgttttacaaaggaagaagtacatgctcagagaggttaagttgtatattcagggtcatctagttaattaatggcagagccagaattatcagaaaaacatcctgaatttcaactttctatcattaaagttaaaatgtatctaatggtaataactatgtagtcctgattttcatgtatattgtctaaaaacataatcttggtaaagacatgtagagatttttgttggtgaagcttttcacttttttgttaaaaatatatacctgtttgtaaatctgcacaacagcattgaagagaatcaaacagattttgctggattaacccaaatttataatactcaagtaccataatgcttaaacagtagaatacattaattgtcttatgtatgagcaatcagtgacaattcttgccactaaaactacatacactacaatctaaagggggaaatgtttgaactataagaaataagaccagaaatatggatttgttgcaaagatgggtttttctgtagaagagacatgatataccttccataaacagaatcaatttaggatgtggcaagtaccatgtttaacttttaatttcatgagtgcagctatttgattcatactttgcgccacataaaaatacatttcataatttgttgcagaatgttttgagggaaagctgtatagtattgtgtttaaaaggacagattctaaagtcagctttgctgaggtacaaatcctagtcccagcatttactcaccctgtgatcttatgcaagtttgtaagccttattgtctttatctgtaaaatgaagagaataataattcagtaaattttatctatgattgtttttaaaataggaaaataaaaaagaagtgaattgatggtaatgagtaaaaaggttctcatgccagcaaaaccactattatgcgtgtatttcatacatagacacatacatctatatattttctatttgccatgagctactaatttgtattctagaacatgtctaacccattcagttttccaaccctttactatagaagtgtcagcattagatttgcaggaaaatggaaagcaagcttttatgacattttactgatttttagtgatccgtggtgattaatgaagctttatgggaagccagaaacaaataattcctggattcctggttttatgttttagagaaatccattaggcattggaaaagtgcctgaaggttgcatttaaagcctgttttaaaaaaaaccataggggtttttttttggaaagctatatatgtaaaacatggtatcagtcatagagcaagcactttataaatgattaagtctagattgttcttcctttcccttttctccactcaagctacaatctacatcttttacaattattcattcaaactgatgtgagtaaacatcaatcagacctactgtcatctagagcaattcctaaaaagtaataataataattgatgctgctgacgggagcagtattatgaagttaaacgtgtaagaaataagactgatcttttaaaacagtgtttgaaactcagtgtcttcggtatcttttatcctcttttgtgtgtaatattcctttgcagttggggaagcttatagaagaagctgtcttagtccatttgtgctgccataacaaaatacctgaggctaggcaattaataagaacaaaaatatttccttacagtcagggaggctgggacgttcaagatcaatgcactcacagtcttggtatccagtgagggctgctctctgcttccaagatggcatgttgttgctgtatcttccagagagcaagaaggctgtatcctcatgtagtagaaggagcagaagaactgaccctcttataagggatggattttataatccattcatgaggactatagcttcatgacttaatcacctcctaaaagtgaggtgattaatagtatgacattgttgactaagtttcaacaaattaatttgggagacacattcaggttctagcagtacctggtgacattggtcaggtaagaatgtcacagagctgctttgtggagagaaagagatctcaggagatgaacaggtgatcctgcttccagtgacccacgcccttcatccttcagggacatctttccaatagactgacaatctgactccatatttgcaaaggactaagtcatacagctgtgagaggaaaataaacaaatgatgtaccttctgatagagatgaggataaccaaccttgaaagagctccttgggggttagtgtgacggcatgcaatccattctcaaacacatattttcacattaaaatgcatatcatagtcagtagttcaaagtatcttggcattaattgaattagggaatgtagaatatttgggggaaaatgtataaatcaagtgctgatgaagaaaaatgtagcctaacagtgtttctttccattgcaaactgtagaacagagggagcagccatgaatgattaagaaccactgacctacatggggaaatgctgactgaatgtttaaagtagaaggaaaagcactattgatttctgattttaaggatcttacaggctttacgttagagctaaagctttcagaatcttgttttaaaatattttataagaagtatttttaaaggttcattaaagcagaatatttttaaaaacagaccttgaccctctccacaactgatgaattatttgagaagtttaacacaatgtcctgctttaaattaagataatgtgggtaaagatgaagaaaaagtaagtataatttggtggatttgaaactgattaaagattatacctaaaaatgttaataaataaatctatgtcagtctataaagtgatttctaaaggtttgcaggagtttttatctttagacctatcctgtttaactttttgttttaaataaattatataaatttgtattctggtcagatttacaaataaaacaaagctggaaggtataggtaatacactgcattatgaaattctaggccaaatcctttacacacacatacgcacatacacacacacacgaaaaagatggtggaaaataggcctgaaagtaacatgtgtaaaacattttaaaaatagtgcgtgtccatataaatgtgctattacaatggaaattaaggaatccaaggattaaaaaaaaatataaatgagaagcgtaaacatccatgagtgtaaaggaaattaaaggaataatttcaaaagtattttttaaatttcatgcagatatatttatacacacacatattcaaaaaccagcatcatacttagtggtgaaatattagaattatcaatatattttctttaaagttgggagcaagataataatgttttatcattagagtttttggcagacaacagaaaccaatctagctagtttaagtagaaagggccatgtggcaaaattcattttgaaattgttggaaaagtgggtggagcaagctctgggcatagcttccaggtatgtcttgtagaacagctgccaagagagctgctgcatcagctgtgattatgaagctacggaatcttgcagccactgcccaactattggctctatgaccacaccatctcagggaagacctacagtagcaaaatgactaccctacccactgcttctcaacacctacaaaactaggcattaaacactggtatctatgctgtggttaagaaaactccagaaactctctgaccatgttcttggtttgcctaatcaatagaacagaagcacagcccaatctgcttcatttctaccctccaaatttcatgggtaaacatctgcttgctagattgcaggtagaatccaagctcaaagaaatcctgggaaacgtggtttttcattttccagcttctagcagactaaagtcatactaaaagagaaatgacatggccctgattgcaatgatctacaacatccaccatattatattccctacacctgacatttatcagaagtagtagccaatggaattaaataagagatataaagcaggaagcaagatcatcatgcttgctgttaacatgatcctatactcagaaaaccaagagaatcagcacaaatattattagaaaaattaggtttcagaaaggtaatggttataacattaatatactatacagatatcacatagcttttctataatcagtaactaattagaaaatacaatgaaagatgttatctcatttataagcaatcaaaaaagatacaatagctggcataaagtttaaaaatatgtagattttattgtgaaaaagcccttaaaaatttctgctgaggtatataagaaaaaatgtataaaaagtactttgctttgaattggaggattcaatattatcaatacttttaattttccctaagttactcatatatgatttttatatataatatatccaatatacatatattaatatatccaaatcaagaagtgttttccgaacctgacaattctacatttaaagtgaagaaatatatatgcaaagttagctatggaaagtctgcaatgcactgccagatattaaaatattgtaatgaagccacagctaaaatagtttttgcattaaaaagaaatagagaagttaactggattaggatagagatttggaacataactacatatagaaataatttaatataaaatgaaggtggtattttacatcagtcagggaaaggtaaattattcagtaacctttgagacactggctaggcgtctgtgaaaaacaaatgttggatcacaacctgactccttacaccaaaggaataaagatgacgtaaatgaagtaaatgcatgaaggtaaaaagtgagtaaagactataaagagaaagttgattaatataaatggctaatacatttcccaagaaaggctcaacctcatttataattaaaggaaaaccaatcaaaacagggaagtacttacttcttacctatcaaatctaaaggccacaggattgcgtttataaacactgtgatttggctatgctttctactttcctgagaaagtttgccagcattaccacagttccgttctcagtaacatctgtggtgcctgcctgctcttttcagccagtctcgagctacagaggccctttcctcttaaaaatatatgaggcttggggaagaaacagctgagtctcccatgccaaaccatctaactacttagctatgcacgtcaagaatttatttactgaaagaatatctagtagttgcctttacaagaaggagatggagctggaggttgtggaggaggatagatcattgattttgtgttacaagcatctatatgcttacagggcatgtttgaatttctgatcatgtgaacattttttacattgtacacatatttttaatttgcatcaatttatagcatacaagtgcagtcctgctacatgcatagtgcaatggccaagtcagggcttctagggtacccatcacctgaataatgtacattgcatctattaagtaacttctcaccatccacccacctcccatctctcacccttccaagtcttcattgtctatcattccattttctgtgtccaagtgtacacatttttttagacaggattttactctgttactcaggctggagtgcagtggcatgatcacagctctttgcactctggacctattgggctcaagcaatcctcttacctcagcctcccaagtaactgggactacagatacacaccaccatgcccagctaattagaaaaaaaaaattttaaagtcagagtctcaccatgttgcctaggttggtcatgaactcctgggctcaagcaatgctcccacctcagcctcccaaattgctgagattacagacatgagccaccatgcccagcccaagtgtgcagtgcccagcccaagtgtacacattgtttagctccctcttatgggtaaggatctgtggtatttccctgcgtctaacttagttcacttaagataatgacctccagttccattcatgttgctgtaaaagacatgatttcattcttttctatggctgaatagtattccactgtgtatatatgctgcattctctttaatcatccattgatggactgttcagttgattctgtatctttgttattgtgaatagtgctgcaataaacatgggaatgtagggttggtgttagtcttgctctgctctgaggtggtcatcttggcctgtgactgtgtttgggtctctaaatcaactagaacatgttaggagagacaaccatggcatgggagaatttgcagtcacatccgatgacaaaggatccaagcatttgattgggttatatagctgggaaaggaataacggatagaaactatagcagtgttcatggatattgaatctagaagagtcagtaaacatattagccatgggctcagagaatatgttaaaggaaacagttttggattaatgaaacagaacgctaagcagtgaggcactccagcagaggctgacgtggcaagtgagttctctcatcatgaaaactgttcagagctaagcgtattgtcagatcgaataagggacagagatcaaaccctggaattcttagaggctaccatattcttacttgtacttcataggagttcccagatattttaaaagacaaaaaaaaagttccatataataaaacaaacgtaaagtatattgtaaaactacaagtcagctatctagcttctcaggaacaattccagtgtactggcgtttgaaagcagagctacagaaggtcgtttgtcatgtctaaaggccatagaatcacttttattaccttttcgatttagctttgctctctacttttttctgaagttagccagctttactacatctctgcttccaggaaaatctagggaatctgccctccctctttttagccagcttccagctgatggattctgggcaactgcttagagacagcaaaagtagacatgaccttgggagaaggtggtaaagcagctttggtctgacctttccttcctcacagaccaccaagtcctgaaagtgaatgtttaatacccctggcaagattgctggcctctgttccaaacaattactgaactaatctaaattatacaaacacagaccatttatcaaggtcagcctgcaacaatttgcatatgtaggcagagtgttcccagtacaaagggtgaactgaggagaggtaaaacagaaatgagttgctgattagtcaaaaaaaaaaaaaaaaagactcattaaatatctaacagtgggcaagtttgcaggtttggttacctaaattattgtcttattatcatgagacaaaaaggcatatttttcttctttagtaataacttttaaaaagaccatctggcaaatgtagattgagacatttgacctcaaaggtttttaacattcttcttgataaataagaataaaaggaaaaagagaatggtttgtttttgtttttgtttctgagacagtctcactctgttgcccagactggaatgaagtggcacaatctctgctcactgcaacctctgcccctcacctccttccccttcttcaagtgattctcgtgactcgggtatctcagcctcccgagtagctgggtttacaggtgcccaccaccatacccagctaatttttttttttgtatttttagtacaggtgcccaccaccatgcccagctatttttttttattttttattttttgtatttttagtacagatggggtttcgccatgttggccaggctggtttcaaactcctgacctcaagtgatctgcccaccttggcctcccaaagtgctgggattataggcatgagccaccacacccggccggaaaagagactttgcctaggggaagtggtgatgagaatatttccaacccagggaacagatccaactctccctttcagttgttatttcctatgggaataagcaaattccctaaaacttactggttgtctattgatgcccctaaagggacttgcttccagttctccacactcacctgaaaaatttacatcaaaagttaaataatgcagtcacaaaaagagaaatactgtatgattccacttttatgagatacctagagtagtcgaatttatagagacaaaaagtgaaatggtagttgccaggggcctgggggacaggggacatggggacttgtttaatgggtatgaagtttaagtttgagacaattaaaaaggttgtagagatagatggtaatcaggttgaccaaaatttaaatgtcctcaacactattaaattatacacttaaaaatgattaagatggtaaattgtatgttgtgtgtattttatcactgtttaaaataaaatgttaaaatcaattatattcatagacgaaggaatattacagtgactgaactttaaaaatccagttttacatcctcagtgtcagagtctccactggactatttcaagcctggggagcttggtaatgagctgatcatctttgactatgtttggctggcactgaagtggaccatgatgttgagtttatggtcttgctcatggcaaggagccagaagccggaagctggggtagatcagacaggtgggggcagctcatagcggttggttgcctggcttgttcagtgctgagcacaaaggtaatgggtggtaaatatcaaagctggtcttaaattgttgagaaataagtagggagagcaggcttgcatttaaaatcacaactactatgccagggaaatataggtaacctattaacatcacctgagaactgtaaggtatgatgaaaagcaaacatctgctgctttacatagttttgataatagagtcatcatatgtttttatatccctagaggagaagcaactaggagtatggttttcaccaagtaaagactgaacagacacccagggctagctttataagtatgccacttgtgcagttacactgcttcccatgctctgaagaactttgtacttggtttaatgacagttgttgcattcttcatatttgtaataccttttgaacaaggggctccatgttttcatttctgctaggcctctcaaatcatgtacctggtccagttggcaccaataagaatatcaaactactgtccaggtggtcacgcaaggaggtgatgcacaagcctaatttgggcagatatggagtgttaaagaaaggacctggggttggtctagatattatttgggaatctgggtggagatactatttgggaatcttggtggagtcgaagaaaaaacacagatggagaaatatgtagtattgcataaatttgtgactctaagctcatctgtcagtaaactgttggggacagagtcctgtgtccagtcagtatcattgtccagtcacatagttacatgtctgcagtgctcctctccttttctactcatgctgtcattgctacatagaggagatcctggataggaaaaggtcaaggttctgcccagtgagtaggattgcagggtctcttatgccttctgttgggacatctgattgtttgcattgcttctcctgcccttgctatcatctttcatctttatcccctcaacagagtgggcctaccgagagaaggtgcattaaaccagtcatcaagaatcacaacagggatttcaactatctggggactgggaagaagaatgagatttccaagctacaggctgggttggacttgggggctggtgtggaggagcagagattggcccagaagagaaggagtagggctcctttggtgggataacatggtggaaagggggttccatccatgccagtgggactcactgtcagaaggactgttgtccaggcaaagtcaccagagctgagttttctggcgggaatattgagggtattgtgttggctctgaatttctggttatttcaccagctcctatttcttcagggcatattcccctcagttcctttatcatgtggaatagcagcaccttgatttcagtctgacacagattcaatttctagaattgtcactgtatagatgggggagaccttaggtaggttactttacctctctgagatgagtgcatattttctcattttgtaaaacagataaaacacatattcatagtattgattaaatacatagtgatgattaaataagaaaatatgtaaaatgtggagcacaaaatagatcccaaatgatttggatctgttattactataatcagcattataggtgttattcaaacagggaagagctaaagatataccaaacagactaatacaaaaatccgtggagattaagttaaaaagaacgctaattgctattcatttacatagtcaacgtatcattgttatttatttacttatttcctggttgttattgttattttgtatgtacagatgtaattaattctacattttaaaattgaaaatatatatctgaatagtgagccctggagctattagattatctttcagggttctgtaaataggattataattaggcacagtgtaatctcttatcctccacaaaggctgcttattttacttctatagaaacagaatcttctggacctgcaagaaatcttacagatcatctactaaaattccctcttttaaaagatgaagaaattgtgatctgttaaactatatcttttaaagtattgaattattttcccctgaagttttatcagttcgatacaaataaaatcattttatttgtttaatttggttacctttaagtaagttaacttaaatcatttcagtctaagtcttagctgggaaacaagacttctattattgtatccactgctttcctttaattaagctcttgaaatgattattttgaacaaaatgcttggtactaaatttataaatggtgtgttgctttccactgcagtgttctacaaagttggattgaattattttacctatacaactttctgttcctgcataatgatgctttttctgtgtgagttgttcataaatcagataaatgtggtttttcatcctgcttcaaaatatacaatgtggttgctcataatctcctcctcaaaaatgcacaggaaacatgcagcacacacagtactcaatgaagagtctttctctctctcactcttgttcttgcactcattctcaccctctttttccttttcccaataggaaaagtactcattgggtctatttgtctttcagactcttgcacatactgtgcgatcccatggtataggcagcaggacatgctttgttccttgttccccagactgtgtcacttcagcatatgttgccaagttgtacctcgttgtgtcaaatgcggcttgaccaattcccttcagaacacaatttgagtcagcagagtgatttcagagttgagtgcttcctctgaatgtggattttaactgatgaattttccagcacaagggaaaagatgccataggccaaaatatcagtaaaatcttcagctcactgaagtggcaaaatggttgtctctttgcaagtggttgtattaggtaagcatattattgaaaataatgctcttctgagggatgcgctatgagaaaagctaatttttctaggccaatgaattagttttaaccactttttttcctgataaggacatttattttttattgtttagacaactgaatataattcatttgtaaatcttctcccctgtaatttctattccaatctgcctttacacacacacacacacacgtagagcaaattagttaaaagccttctttttcccattgtctaatcctccacttaaatcaatcctacctatattgtaaccttttattccatggtgaatagttttctagattaaaagtttggagtttttcccacaggtaacagattctggaaggacttcaaatgccatgcatttttaacctctacttagggtacatagatgtagaaataaatatgagtgccagaaaattcacaacctgtgatagaatcatacaaatctcaagtatgttcccaagaatgctctagggttgaagggtacttaagttttaagaattcacagaggacaaaggtattagtttctctgaatgattcctatctttcaacataacctcacagtttcaatggtatatatgtgttttgttatgtaggaaacttcctcacattataaaccccaaatctttcatacatgagcataggagctctctggagagacaatcatcaagatcatttatgaattttcttatatctgacactgttcccccaataatttaagatggtaacaatcttcagtgcagctgtcccttctctcttgggaagctttgtgttctgcttactaacagaggtgattttcttacaacagttagtaatcaaggggtcaaaatgagagggcagcatatttttaaaaactcagagaaatagtcaaacaccgctaactgtaccctgtcatcagaatttttcctctcttctttactcagctcttaagtttcaaatctggctgcatgttatcattttgggacttttaaaaaacttctacatcctggccttgctgtcgagcaattgaagcgactctgaaagtggaacccagtgagtcaggattgagcaccatgaccttataggctgaagtatgtgctgaagagggttaatcacaaatagtgaccaatggagtaatggaaactactgctagttagagtcctacatggacatcatcttaaaaagaagctgagggacctttaagggtagttgtgtttctcttcaagaggatgtgaaagttttatcacagagctcaacataaagtaggaacatcacgtaacataaagaacatctcagaaattaaccaaggttgactttaaaacagaacacattctggtttaagatataaaggaataatatctttgacaagggcaatactctttaagaatgaaaaaaaaaaaagagagagctatagagaaatatactctggtgggaaaagggacccattctaatgatcccaactcttcaccctcaaacttctaactatgtcttggggttttattattttgacccttcctgccatcatcaccctttaccccaaggtaccaatacccccttttcttaggtaccaataccccctagtccaaagacaagagccacaaatgaagcaatatgcccaaaacacattctgataatacgttcttagtgcctagcaggtgatggcataatttgctatctcagaactgtacattttaacaatttttaaaacattttgtgtttatagctcttgaattttttcttaaattttctttagaaagttaatgctagacctagttatattaaaaagaataatgggaagggcattttgtttcatttgtgggttttgtctttagactaagaaaaggggatattggtacctttgggtaatgggtagtgatggcaagtaggatcaaactaataaaacctcaagacatagaagtgtgagggtgaagagttgggaccattagaacgggccccttttcccaaaagagtttgtttttcttaacaggtcttattcttttttcattctgaaagagtattgattgaatgtcagtcagagaggtgattgtcagagagatgattcctttatagcttagcctgtatctccaggcttgaagttctacaccagtgagataattaaaacaacatgctttggttgaaagcctttcccaaccacagtgagtaccgaaactatatttgtattaatcaagcataaatttctaacaaagatccactgatacaggaattcaaacaaattgcatttttgcccctcttaaaatactatagactgttatcaatgataacattttcaaaggcatagattgtaaagtttgatggagtgtgcctcttcaacctttcagagatgtatgtttaattcttttctgtgaaaggtaacagctaatagacccatttaactcattctccagggcttctgtcatacaatgaatttctattgtttaaacaaacaatacgtcagtttctttataataaccacatgttgaaagaaagccacccattcaataaaatatgaatgaggtagttattttaacagctatgaaaacttgaatcaagttgtctgggtacttcagctgaattgataatggaggaaattaggcagtgcaagctgctcttttctgagtgcctgtactgtccctccattattaatcacaacatggccattgacattcctgtcagatccacttcagagtgctgattgctggtctgtgtcactccatgtgagaatacattctggaacctgcattttatgttcccagagaagtgctgagcattctgttggaagtagcatccttctttccctgagggcttaacctgtcaacttttcccagtttaggaaagtgcagctgccttatggaatagaaagtcattcattcatcattcactcacttattcattcctttgacaattttttacgcatttgctatgttccaaacactgtaccatgtactagaaacataaaagatgactgagacctagtccttgccttcaagttactccaatctagcagaagagaaagacaagtatcagccaatttgccacatgcaaagtatacctgatgtagccaggaaaggcaaaggtggctcatttgcaaatgtcagttcgaggaagtgaaatacagaatgggtcgtcagagaagtggccagttaatggactatgttttcaatggattctgttcttatccaaagcatatgcccatatcattgatattttcttaaattatcttccaattattttctctctttcagaagtaattaatttctgggaacagcctgtcttcactaggaaaagcttgtcttacatactctttaatttttaatttttgtgagtacatactaggtatatatctttatcacaatctagcagaggagaaagacaaaaatcacccaacttgccatatgcaaagtatatatatcatggggtacataagattttttgatacaggcatgaaatgcataataatcatatcatggaaattggattatctgtgcccccaagcatttatcctttgttttaaacacaatccaactatattttttagttatttcaaaaggtacaattaaattattattgactataattaccctgttttgctgtcaaactagttcttattcattgtttctaactattttttgttgtatccattatccttcccattctctggcaaccgttcttctactctctatctccatgagttcagctgttttgatttttagatcccacaaataattgagaacgtgcaatgtttgtcttactgtgcctggcttatttcacttaacataatgacccccagttccatccatgttgttgcagatggcaggatctcattgttttatggctgaagagtactctattgtgtatatgtgcccattttcttcatccattcatctgctaatggacacataagttgcttccaaatcttggctactgtgaacagtgctgcaacaaacatgagagtgcagatatctctttgatatactgatttcctttcttttgggtatataaccagcagtgggattcctggatcatatgttagctctattcttagattttgaggaacctccaaactgttctccatagtggttgtactactttacattcccaccaacagtgtacaagggttcccctagtctccacatcttctccagcatttgctatcacctgtcttttgaataaaaaccatttttaactggagtgagataatatctcattgtaattttgatttgcatttctctgatgatcagtgatgttttcatatgcctgtttgtcactcatatgtcttcttttgagaaatgtctatacaaatcttttgtctattttttattggattattaaattttttcctatagagttatttgagctctttatatattttggttattaatcccttgtcagaccggcattttgcaaatattttctcacattctgtgagttgtctcttcactttgttgattattccctttgctgtgcagaagctttttaaattgatgtgatcccgtctttctatttttgctttggtttcctgtgtttgcagggtattgctcaagaaaatttttctcagaccaatgtcttggtgattttccccaatgttttcttgtactagtttcatagtttgaggtcttagatttaaacctttaattcattttgatttgatttttgtatgtagtgagagatagggttctagtttcattcttctgcatatggacatccagttgtcccagcaccatttattgaatagactatcttttccccagtgtatgttcttggcacatactcttttattcattcaaggcctacatatatattctgattcatatagaaatccgatttgagttgcacagagaaaatttcattacattttgcttgtggatgtttgactaaaaaatgatttaaaaagccaaacctattgtgtttgtcaaaatccaagtgatttacaacaattataataaagttcagaatatttttgacaactcttcctgagtgatttttgaaaactgaaatgcttccgggatgaggttcccattctctacacagcattggcattagtagatatatcaccatgacgtaccttaaaaaaaagctgaaattgcatttcccagcaatcgccctcagtacagcctttatgcattagggtcagatataaggctggtgactaaatttatcttcctttatttttattcacttttcttgcctttttctcttttgtttcttctttaagacagacatatatgcatggtaagtaaaagctgtaaaaagctaaatacttgaggggatggacaccccatttttcattatgtgattattaggcattgcatgcctgtatcaaaacatctcatgtaccccataaatatatacacctactatgtacccacaaacatttttaaaaataattttgttttgttttgttttgtttttttgtttttttaaattttattattatactgtaattttagggtacatgtgcacaacgtgcaggtttgttacatacgtatacctgtgccatgttggtgtgctgcacctattaactcatcatttagcattaggtgtatctcctaatgctatccctccccactttccccaccccacaacagtccccggagtgtgatgttccccttcctgtgtccatgtgttctcattgttcaatttccacctatgagtgagaacatgcagtgtttggttttttgtccctgcgatagtttgctgtgaatgatggtttccagcttcatccatgtccctacaaaggacatgaactcatcattttttatggctgcttagtattccatggtgtatatgtgccacattttcttaattcagtctatcattgttggacatttgggttggttccaagtctttgctattatgaatagtgctgcaataaacatacgtgttcatgtgtctttatagcagcatgatttataatcctttgggtatatacctagtaatgggatggttgggtcaaatggtatttctaattctagatccctgaggaatcgccacactgtcttccacaatggttgaactagtttacagtcccaccaacagtgttaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgttttttggctgcataaatgtcttcttttgagcggtgtctgttcatatcctttgcccactttttgatggggttgtctgtttttttcttgtaaatttgtttgagttcattgtagattctggatattagccctttgtcagatgagtaggttgtgaaaattttctcccattctgtaggttgcctgttcactctgatggtagtttcttttgctgtgcagaagctcttgagtttaattagatcccatttgtcaattttgtctttggttgccattgcttttggtgttttagacatgaagtccttgcccatgcctatgtcctgaatggtattgcctaggttttcttgtagggtttttatggttttaggtctaacatgtaagtctttaatccatcttgaattaatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgtggcattatttctgagggctctgttctgttccattggtctatatgtctgttttggtaccagtaccatgctgttttggttactgtagccttgtagtatagtttgaagtcaggtagcgtgatgcctccagctttgttcttttggcttaggattgacttggcgatgtgggctcttttttggttccatatgaacttcaaagtagttttttccaactctgtgaagaaagtcattggtagcttgatggggatggcattgaatctataaattaccttgggcagtatgcccattttcacgatattgattcttcctacccatgagcatggaatgttcttctatttgtttgtatcctcttttatttcattgagcagtggtttgtagttctccttgaagaggtccttcacatcccttgtaagttggcttcctaggtattttattctctttgaagcaattgtgaatgagagttcactcattatttggctctctgtctgttattgatgtataagaatgcttgtgatttttgcacattgattttgtatcctgagactttgctgaagttgcttatcagctgaaggagattttgggctgagacgatgggttttctagatatacaatcatgtcatctgcaaacagggacaatttgacttcctcttttcctaattgaatgccctttatttccttcttctgcctgattgccctggccagaacttccggccagcatcatcctgataccaaagcctggcagaaacacaacaaaaaaagagaattttagaccaatatccttgatgaacattgatgcaaaaatcctcagtaaaatactggcaaaccaaatccagcagcacatcaaaaagcttatccaccatgatcaagtgagcttcatccctgggatgcaaggctggttcaacatacaaaaatcagtaaacataatccagcatataaacagaaccaaagacaaaaaccacatgattatctcaatagatgcagaaaaggcctttgacaaaattcaacaacccttcatgctaaaaactctcaataaattaggtattgatgggacgtatctcaaaataataagagctatctatgacaaacccacagccaatatcatactgaatggacaaaaactggaagcattccctttgaaaactggcacaagacagggatgtcctctctcaccactcctattcaacaaaaaataattttaaaaattaaaaaaaaaatcactgaaaacaaagtgcttttaattcggaaaacaatttttagtagtgttaaactataaagacattagtcacaggaagaaattttatatcttctaaattcttttgaaaattctatgcagaaccataatcactggggaaagcttacagttaaaattaatctgtccagcatactcataataaatacctttttattaatattaaaactaataaagttagcagacccaaagtaaatggatatatgatattctgtttttattattatttccaaaggctaaggtagctaaactttcatgcatgatgttgtaaaaattaaatgatgcacaatcatttgaaaaatggattttccttgtacaagttggccttttcagctctatatatttatttagaaatatatctgtcttctggctgatattgctttagactgatcaaatttgtgtttgaatataataatgggatagtgttttgagtttctcaaaataaatgtctgagagatagcattaattccttttgatttgacacttcctttccattgcctatttggaggttacatagtctttatcctggttattctacttgagatacacagcataacatatgatcactcaatcagtatttaccttgaatcaggtatgattagatacatctggagagtcttagaggatgggcctgccaggagcccatttgcatgacggactgaagagtcttttaggaagtagtccatcctatggcaatagagagttgacatagagaagcttgatataaattcaatgctttgagagtagaaggaaccaaaccatggaagttgcatggttcattctgccaccctccgaaatgtaggcttgagtgtgttgatgatcaaatcctaaagcatcctttaccaaatttttgaacaattttggaaacactgaagactcctgctttgtattctatatatagcaccagaataagcaggggtacatagaactaaaacagtgatggcagcaagaggctggagcagcctactacctgacccagtgaagaagcaggacaggagacatctttggcagtggttagctggaggcaaaaccagtcatgctagcactggagggagactgtttcataaagattggtggctaactcagtggctttccagcatcttccaagcaggttcatggacattgtcttctgcagtagatatctgtttagagtcaggaaaaaaaaagaaaaaaaggcagatgccacatggtaaaagagagaactgggtttatgtgcaattgtgagacccattggtcacttctcagaacttgtgtgtgtgaaggaccttattttaagaatacaaggtcctgaaatgccttaaagtacttttcctcaggaagatgtcttggggaagatagaaaaatctgatatgataagaatgacaaattacaatatgacatgtaaaacagataaatgaactgcatttgttgcaaactgcaaaactaagccaaattcagaattgtaaaggagcaaaccgttaagctcttttcatccattttgtttatattgctgtcttctgaatgagttcatagtgtcaacagcatctttggcaaaaataatggaattaacagaataagagaggtcagagtaatacctcactaggtattcaactgagttcctttgaactattttgttctgcttattttgtctggggtttttctttcagtttatttccaactttgacaagctgcagatccacgtttccagctgtcttctgtatattcccacctgaagatgttattaccttataattattccccaaatcttctgccctctgtattttgttgttgatgttgttgttaatgatgtcaccatccctttagtctctcaagtaaggaaaacagatttactttttccttctcccactcctttggttcccttatccaatatgttaacgtcggtgccattagtaacttctgaagtctcactcctatctttctaccactggagtataggtcttcaccatgtcttgtctggacttttgcaatagcttcttaacacaagactctccccactgtagtcaatactctaccttcgttgttatagtcatcttcctaaggacaaatctgatcatttaatttgctcttcataatccctgttagcttcattgcatggggcataaagccaaatttgtaagcactgaaaataaaacccttcacacactggctccttcagcttcatccctatcacccagattcagccatattggacttctcactgtcatttgcataaaactggcccattcacatttgttcgtatgcagaattctttcataaaatgtcttcagttggcaaaatcttagtcatcttttcaacagagaacaaaatcaccttctcttggattttgagctttcctgaatgctctcaggggcagaaatagtttctccctcttttctgttccttggcactttccttcctaaccacagcatggcacctgccacaattatgatcatttctctatcttgatgtctgtgtccccactaaactgtgtgatcctctagaacagaaaggtattagcaattctctttgtgtccccagagcctcacatgggactacaccatgggtatagaataagtgttgacagagtgaatgaataaagaagcacagcgaagtgactaagtcagaggagggacacttagatcagcttcagaaagtggaactacaagtggatagagtgtggctatacatagagtagaacattctaagtgtcagaacttttaaaaatggtagcgtttccatgttactaatcatcagagacatggaaatcaaaaccgcaacaagataccatcacaccagtcagaatggctattactaaaaagtaaaaaattaacagatactggcaagactgcagaggaaagagaatgcttatacactgttggtaggaatgcaaatgaatccagcccctgtggaaagtagtttggagatttctcaaggaactaaaaatagaactaccatttgacccagaaattccattactgggtgtgtatattcaaaataaagtaaattgttcttccagaaagacacatgcatccatatgttcatcacagcactattcacaatagcaaagacatggaatcaacctaggtgcccatcagtggtggataggataaagaaaatgtggtacatttacaccatggaatactatgcagccataacaaagaacaaaaccatgtccttttcagcaaatggatgccactggaggccattatcctaagtgaattaacacaggaacaggaaaccaaataccacatgttgtcacttataagtgggagctaaacagtggataaacagggacataaagcaacaaaagacactgtggattcctagaggcagggagggagggaggcagtcaaaggttgaaaaactaactattgggcactatgctcagtactatggtgacaggatcaatcataccacaaacctagcatcacacaatatatccaggtaatgaacctgtatatataacccatgaatataaaagttgaaattaattttaaaatgaaataaaataaaattgaaaaaaatgaaataaagaagtagcaagtattctttaattagaaattctcagaggatggttggccacttgtgaacaaatggataggtgatgtacatcaggtagttgttggctatgctaaatgacctctaattctactcagagattgtgttattcttcattaatacacaatccctcatgtcacctgataatttccagtagtcagtgatatctgcctttaaccctggctctgtaagtttatcttccataaatagattggaaatgtattcagttggaaccaagccagggaagggggagagaatgaaaatgagaatatcaagtaaacataaatgacatactatgatttttttaaagatggtacatgaaaactgaaatgttctgtttgtaacattgagaagagctgaggctttgcatttttggtacttcaagtgccaggagggagaagcagcaacctcctcccactcctgggagtttggtgtaaagggacatggcccagcctgcaactaactaggagttagtccaacccatctacttgtgctaaattgtagctgtaatatctctgtgggtttcgtaataacatatataattatgatgcattgtttttatatagcacctttctctaaggagcataaagtgctgtgtggacattatcccattaaatctcacagcactctggagacattgaaagaaggcaggtgatattatatcccctttgaacccagagctgaaaaggaatttctccaaccaaaagtaaataaaagcaagatggaatgaaagcaagatttataagaggatataaggttagagtttaaaggaagatattgactatgttggaattaaagggagatttaaggcaaaaaaaaaaagtaaaagaattgctgtgagaaaataacaaagtgtctagagtgtgtatatatatatatgtgtgcacaaaattaaaataatatacaaatactttcaaaatttgaaaagcaagattattttaaaaccatctataattttactacaataataaaactaatttgatatattaccttatgtctttttgttttgcttttactgtgcatctgtgattttccacataaaattataccatatattcaattttgtattatgtatttttcacttaattatatatcataaagtttgcatacttataattctgagtagccgtataattttccatggaattataaaccataatttgttttactcttttctaccaaaaggcagtttccacattttcaccataataaataacaatagattgaaaatctatctttatgcatatggatcttttatgtttttaattatttccttagcagagaaaatttccgggaatagaattaccagattaatatggatatgtaagtacatttaaacatgactgcataaacatactctcaaattaacatgtaagtgaaaaaaaggaataagaaaattactaaaaaccaactatatttacacgttacaaactatgtttacaagtttccaaggcagctattttaaaagtaaaaatgttagcaattatttttgtctgtgcacaaacaagtagtttgattttatttttatcacatcatcattcaattcaatttctttggtagtatgaaaccagattaaaaataaaaagttgaatctcaaagaaaacataaatttgtacctgttttttaaaagtagatttacttgactggaacatgtaatttctctgtattcttcttaattttaatttacatggtcaaatgttctatgaaaataattaggaaagtgtgtatgtgtgtatactaatacctaaagccccattttaagaaagtaaatataattgtaaatttttcttattaattatggaagcactggagaaaatgacatgtgtgtattactgtttttggtgacaggttgttacatggtatcatgtaccaaagtgattacctcaagagtcaaagattaggtcgggcgcagtggctcatgcctgtaatcccagaactttgggaggccgaggtggaaggatcacctgaagtcaggcattttagaccagccaacatagtgaagccccatctctgctaaaaatacaaaaattagccgggtgtggtggtgtagtcccagctactcgggaggctgaggcaggagaattgcctgaactccaggggtgaaggttgcagtgagtcgagatcacaccactgcactccagcctgggtgacaaagtgagactctgtctcaaaaaaaaaaaaaaagtcaaagattaaaaatactggcttttaaaaacatttaaaacacattaaaaacatattgatgtgtaaggtaaatactgaccaaggaaactgtcaggccagtgtttttccaaatggcaatcaatctaaatgatgtcgagaatatgaagtcaaaactagcttagatatgaatgaggcatacagccttaaccatggacttgagaatcttgttttaatcactgttctcaataatattcttgctgatctgaagtcacatacccctttttatctattgtatggttttaagtaatgttgcaaattgactgaagttaacatgggacaccaaaacatttctactagctgacagaaattttgcaaaccattctcatttttatggctttagcaatagtgttcaaagatatgaactgagcattgaagcagtgctagagattgcattttctatttcaccacacagtctaacaagcagggtctgtcttgggaaaaatggacttaaagtattataagaaagacattttttcacagactctaaaagacaattaatctaaagttagataaattaaagctacccactgagaaaagttcatttggtctctgtttaaaactaaaaactccacgctataatttgttttcaaattatagcaaagatgagcaatttatacagctacatcctactcctgtaatacagtgatgagctacatactctcaacaacctgtggtcaccaagaaaatggaagatagagaatgattggttaatttactcattctctcagagcttgaatgaggaatgtattccccaatgggtccatagggaacttctttcaagactctattactaatacaatgcttccatattatcctgtaagtattgtttaacttgtttgcctcttctactagaggatgagctttcttggaggcaagaattttgattgatgtctttggtattccaaggccttgcacagtttctggcacatggtaaacacttattaaatattggtgaataatcaaacaaccaaatggtttttacttcccaccgcgcatctactattgtgctaaggactgagagagacataaagaagtgtaccttcaaggagtgtataattaatacataaatgtgaagttaatgaacaccacacggtagtctgttgtgacgctgtaatagaagattctttggtgctggtactaggaaaatagtcaagaagagttacatacacaaaaaaaaattgtgccattgtgataggggagtgatagataggcatggccatacaggttaactgagaagtactaaggtctatttccatcattgtttgattagtgttcaactccctttctagactgtgctctaaaaagtcagagtgcacatgggttttcattcaccattgtatttctaagatctagcagagcactggcatgaagtaggtaattgagcacttgctttgctcaatattctctactttttcaagggctagatcattctcatcctcatcccccagcttaggtgtcctttcttccaagatgcctcgcagggtgccctctgttatttcttttctcaatccctagtttatttcctttgcaaaacatatcaccacgtatttggctctttactcattcttttacctgtcactcccaccagacctgatggtaaacctctgtccatctgttttggtcctggttgcaaccatagctcatatcacagcacctggtaccctttccctgcagaggctcttacctcatagaggtcttttcttaccctatctaacgtagcttctcccaatccttatcgtggtttattttctctctagcactaatattttctgaaattattctgtgtatgtagttatgccatattcaaactataaaccccatgaggacagagcctagagccatttctacctgattcattgctgtatcaaggcttagtagggggactgacacaaacagttcttgaatgtgcaaatatttagcaaataaaaggtgatggcacaaataaaagacaaaataattaaaaaaaaaaagcaaaggaaagagattagttgttaactaggatagcaaaacaagtgttagcttagaattgtgatggtaaaggcaagatctattttcaatgaaaaataatggttggaaatcaaagatagttagagtaaagagaagtgacaaggactaaaccagaagagcaatctgaagactttatctctacacaactgtgggcaaacatctctacacaatttggcagcttctttttctttttttctttccttttcttttttttttttatttttttggttggttgcttgttttgagatggagtctccctctgttacccaggctggagtgcagcggtgcgatctcggctcactacaacctctgcctcccaggttcaagtgattctccatcctcagcctcccgagtagctggaactacaggtgcatgccaccacacccagctgtggtttaatgagagacacaaacgaaacaatggttagaccaagacagtaatgtaaggtcatttagagccaggacaagctgaattacttgccatcatgcaaaaacactcatgggactggacagacctaggtttggcttttactcttctatttatagctgtattacagtgggtaaggcaggtgccttctgtgagccacagtgtctccaattgcaaaatgagaaaaataaaacctgccatgtagtatcatttttaaaatagaacaaagaaatatatgtaaaaggctgcacctagtacagaatctactacatgtgggagatcattgaatagtggtcattgttagaacagtgcatcaattacagtacccagctagaagggtggcaagcaaaatatttaatcatattagtaaaggaagatgtatttcctttcatttaagtaactttaaaggacatctctttattttagattattgcatgagcaaccaattgatcataatatataattgtcagggcatgattaatcataaactactgacttgaaaaagaaaaatcattaattatgataattattctttctcattgtatataattgaggcttaggaagtaaaattgaaaaaaatctttcactgattctgagttaattagcataccttgcaggtatttacattaaaacacccaaatgttcttcctatgttttgttctaaaagaagagatttgaagagctctccatttcaggctaaggctaattgaaaggcagatgataaatgattagttgaggtatttgttttgagtgtgtagttgttagagtgaatttttcatttgaagatatatatagtattaaaagtccaggaatctctgagttgggaattaggggcagagagcagtcaacaaatcatatatttgtaaaataatttggaaccttcttcagagaactgatttctgaatagtctgtcacctaaacaatttcataatgatgctgatttgccagcttctcctccagcaagaggcaataaatcaagtgtatctgggtttatatggggaaaaacatattaattgatttatgcatataacattgcagatatccataaagcaaagcctttggcaactggcaaatgtaataatttcacatttacctatggttcaccaagtacaatccattgcttgaaggcaaaactgtatgttttatgtttagtttttacgattgcttccatatagtctctctgtgcattaaaagtccattttcagaaccatgggtttaccaatttttatgagtaaaaattttatgagatattatactgaggtagcataaaattattttctgataatttttaccaccttcagaactccactgttactttgtttccacatatgcctaaggatataatttgtaatacttttaaatatgacacatttcattagaaatatgatatattgcagagatattatatgaagcttcaacctcacaataacattacagattagtttttaatgtaggttacattgacaattctatttaaaatcaaatataaagaaggatatttaataaaatgattaatgatttttatatttataggcaatgtgtcatcttctgatcataattatgagcaaaaagaattaatcctttaagtgaagggcttcttgtaacacagtaacttaaacactccattgatatacaaacaaggaagacttaagataaaatagtttgttaggtttctatgccaaaaaatgttattgttacccatatagatcttcttgtgtttttgcactgccttaagtcatatacgtaacataaaagttttaccatttaatgatatgcacagccgcagtatgttgggagtacaaatcttaaccatcacataagttcctaagaaacataaaagctgtgtctttttagcaagctgtgaagtgatagccatcactagtgggctctaaatcatctcaaaagccattctgtttttccatgcagtgatataggaatctgatatcagagtacctacacatgatgaaaaatctcctcaggtgagaaaagcgaagtgcaaagaagttagggagatagtattcattactagaaatatgataagtttagagccaaatctatgcattggcagtaaaaattctaagatggccataaaccatctacagttaaatgcatatctcagcctgcatattttgtaggctttgtcaatgacttgcaggataaacataggaccacttccattccttcactttgcaatgtgtgttagacaggattccctccccaggtgctccaggtagcaaaaaatcctaagaaaatattatttcaagatcagctgcaacataccactgaaagtcaacctttcattacagatataatttagcatcaaacagaagggcatatcggcatgatagttgggcttaaagtgggtagataattgcaatattaggcctgatgggggaaaatgtcatgaaaaatcttactatggtaaacaaaagaagtcttttcaatcagactgtcctgggtacaaatccttttggtatcaattgtgcagcattggacaagctatttaactgctctgtgagcctcagtttacttccatgtaaattaagaaaaatcctacctaccatatatatttgcgtgtggtttacaatagactaaatatatcaaatgcctggcacagagaaaattcatgacaaatgtttgtttgcttagtctgaattgaatatgaaaatacagtcaatctcctataaaggattttcttttattattattattattattatactttaagttctagggtacatgtgcagaacgtgcaggtttgttacatatgtatacatgtgccatgttggtgtgctgtgaagagtcctcagtaatgtggagggaaatgtattggaatatagttcaggggctactgattgaatttcatctggtctctaccagtaatcttttggatgatatgggaggattcctgtaacctcactgactgtcattgtctgtaactataaaaggaagagtttaatttgattctttatttatcaatgttattttatattctttgagaatagatgtttttcatctagtgagcattgagtaactgttgaattagttcaataatagtgtgatgccctcctatggggaacttgagtgtatcattgggaacttctgtgagaaatgtagacgtcacattcactctattcatgctatgtggaatctataaaacatatttgctgtagccacctcaggctttgaatggattgtgtcggtataaagataggcaactgctaacaaacatgtaaggttctttaccccagcatgtggacttgttttccaaaaagaccctgaggatgatagaatctctctcccataggtgtccaacaaggaaagtaatgtattttagacttttcttggccattgacctctggactaacaatagtttcagaaaatttttcaattcactgaggaaataattctccaacagcaaaatgtattttattctttccttccctctaacctgctccagtgtatcttgttttcctagtctttcctctcttacatgaggatggataatttttctctagagctcagaggatgaatgctcttgacctaaccctcattgaagaaaggcatggaaagcctgccagttcaaatccattgctctaaaggttttactttctgttacatattatcattgggtggtccaaaggggtcagagatggaggttgtttcagaacctgaagtctttactaaaaaagatgaaaccagaaagaaaccacactgggtacaaagcagtgaggatccagcctattgtttccaaaagcctgctacattcaagacacagtgaacttaacccagttttgttttgttttttagaagaacagccatcttgacttcacaaagagtgttggtcagaatatttaactactggtacagcagtggtactgaccaaagagaatagatactgcccaatcagaatggacaccagctgtaaacaaccagtgtatccatattggtgcacactggcttttaacatttgcccttgcaaaaactactgaaaatattaaaagggaatctcacatgtcagagtcctctgttctaccaaaattcaacttattttatgctaacaaaattatttgaaactaatctaatcatagtctctctccagttactgcctcttcaccctacttcaactaacagcaaagctcctcattagagttctgtatttatttcctctacttctcacctcccattttctcttgaaccaactctaatcaggcctttgtccccaatgtcggcttcctcaggagctcaaaggtcttatcaatatcaacaacccccatattgccaaatctgatggttaatattcagtctttttattacttaaaccttcaggggcattagacacaagttgatcatgccttcccttgtgaaacacttttttacctggcttctaggacaccactttctcttgttcttcttctattgcatgccatttcttttcagtcttctttatgggattctcttccagcttataaatgagggagtgcctcagtcagtccctggcctcttttcttggctttctatgctccctttctaaatgattttatccgattctgtggccttagatcaatagactggtgagtccacatctgtatctccagccttgtgctctccccaaagattcccaactgcctacataatatacctccacttggatatctaataagccctgccatattagcatatactgagctctctggatttcttacccacttctctattttctgcaagtgtattggttccccaatgtctcccttctcagcaaatgctattaccatttaccagttgctccagccattcagaaattcagttggtgatgccttcaaaatacaccttgatccgaccacctggccacccttatttaaatggctgtcatttcacacctaaactactgcaacagtctcctaatagatttttacccctcctacagtcagtttataactgtccacatctctcacgctcccgtgaccattgttaccttgctgtttcttcaatacaatcatctcatttcctcctcagggcctttgtacttgctctttcctctagctgatatgatcctcctccagagcttctcagggcttcctctttcatatcaatcagtactccacacaaaggtcatcttcagagaagttttctttttaataattaaaatagaagccacacccaactcactattctccatcccccttctctgctttatttgcttcagagcacttatcactatttgacttcacattatcttgctattttctgtttggtctgtctccccaaatagaatatatcctccataagacattccagaaaaaacatataatcatagaactgaaaccattgtgaagaactctggaggtcattcacctctacccaccatctaatatttagatcaaccttgtactctctccattatttgtaaagtgaatatttttatactgaatcacattttcccactgatctccatcatcattattttttcatggagaaaaatgacctcaatattaaataaaaatgttaccaaggacaataatacctacttttgacagtatgcaattaattttcctatatagcccataggagaaattagtcattcagacaattgaatgtgaccattcctggcagcatgtgcggagccagaacagatactggagcagtgacattttgtaccaaatatgcaaatataataaagcaccaaataagtaggagctatgtgctattgaactgtagccagagcctgaacaagaacacaaatatgttgtctaataactttgttccactagatttcattcattccttattggaggaacatgcatttgagtaagaaatatgccaatttatatagttaactttcattcttcttaagaactgcccactagatcaagttgtttgataactgatgaagatgatctaagatgacttatcattgagtgtgtttctttagactttgcactaactttagttatcagcaactcttcagagctagttatttgtaccctctttccccttttattggtgtctttaagatgttaagcactctttcctgtgtactggttaactatatttgcctagtgaaggagtactgattttccattattcctagatgccacatgatgcatttctattcgttgtaaacacttataagactgacttatattttgtccttcatcacatcagtctgccagggcaagatgtctttaaatgaggcccagtgcgtttcatcagacacatttctaccttgacacttaaaggaatgatgttttcaaggtgtctaggtgtaatgaagtttgttttaaaaacccgctgctatcttgccaaagcctcaaggcaaggcctctgaaaagtaacagactatatacttacttttcaggcctcttctgggcttgacttatttgctttttctataggcactaaactattacttatatttcatttatatatgttgacttcagaattttccaggaaaattcatattggcctttgcaagtaagaaaaatgattgatgaataaaagatattaaacaatcctataaaatagatccttaggataattaaattgcttgagcaacaacaattttgagagttcattgctgtattagaatacacaaaagcacataaaaaagtgaagtttttaacaacatttcaaataagggtttacagtttgacttggatctgttttagtgatgaatgaggtatgccatctttactacttgttgaaaaaagcctacttgaaccagaaagtctagatttttctccacagattttaaattctttaaatagcataagttcctcctgagagaaaactccaaagagttatagaattaatttgcccttgaagggaaaaacaacagtgaatattaagagaaagtgagaatacaacataagagaaaaggggagttgtcaaaggacatctaggaagtaacctcctgcaatgtctctattgttcatccttcaaatttatggcagggcatctcttaacattcaaccttgccttaatgctcctcctgctgtcatccgctatgtgaaatgatcccccaacctttaaaatcacatgttggtttacattctctttccttgttctctcacttggttagacatgtctcatgaacttctttgtatttacatgatgactaaaagggtgacttggttcaacccaacaaacatttttaatcaactctccaaacatttactgcctcttctcacaatatttacaatgacttccactctctctaattgtccactcctttcctctgtgatcaatgacaaatggctcaatctttgtttcactctctgtataattccagtacacctagtttatagggaaaaaaataagacaaccaatttttaataataattaatgtaagatgatgtataacgtttatttacaaaaacaagtatttattgtgttgtttctgtttacttatatccatcctgtgtttccatttatgtgaaaccacagagattctttttttttttttttttttttgagacggagtctcactgtgtcgcccaggctggacaggctggaatgcagtagtgcaatctcggctgactgcaacctccgcctcctgggttcaagtgattcttctacctccgcctccccagtagctgggactacaggcatgagccaccatgcctggctaatttttgtatttttagtagagacggatttctgtcacattggccagggtggtctcgaactcctgaactcaagtgatccgcccgccttggcctcccaaagtgctgggattacaggtggggattgttatatatctttaaccttcagagagctccattcatcaattcaacaaatatttgagttcttactatatactgagcattatttcagccatagaaaattcagcagtgaacaaaacagaaagaaattcctctaagctccctggagcttacattaataaacaaataaataagcaaaatctactgtatgtcaaggtttccaaggatttattcggccaagtgatactaggacaactttgccaattagaagaagtacagtgttgctgaaagaaatcaggcactcaggtttcttaataagaaacaaaaatatcacccaaagcctgagtacaattcttcaggccaccactgctcactgtcatctgaaattcggttgctaggacactgctaagcatagcaaagctaaggacactttacaagctggggaagtttttggtagaatgatgttatgatattcatagatctaaattcagttatgaaatacggggcatagagattaacatagaaagaaataaatatatctgtaaagttgacttttgatatcattcaagcttaataatctaatgcctataaaaagaagatatacaaattattacattgaaaaactgttggtattttatagtaacatttaagaatttatagcttttcactaaaatctaatctaatctatctcttaatttcctcataaatcaggtggctaatttttagcctagaaaatgcaacttttgttctgatactatggctttagtttcgcagggtagggtaatcagtatcattacatttttatcctctaacacttctctaaatagaagtgaggtctcttcatttaatttgggaaattgaatgccagtcagggaattcaaaacagtgttggtttcaagtttgagtttccctgaatagtaccaaattattttccttgaccctgaggcatgggtctcaatgagaaaacatagggaaattatgaatccaagatatcctgagacgatcttgcctacatatttaacagtgaactgaaattttgtgtctattgtggctcatgaataatagggatcagtaactgattttcattgcataggcaaaagtaaaccatccatatatgtaaaaaataagattagatatatgtcatgacactgtccttttatttttatatgggaaatacacccatatgaataaaaattaactgtttgtcatatatgaagcaagatgcaaagttgggagtctgttcacactgtgaacattaccttgaactgatgagaattggagtagcgtaataccttgtgcctaagtaattctcacatcactgaaccacaaatctgatagacctctgcagttattgtaagatttaatagcagagaacgataagaaagctttgaattactaaacactgataacacttcttaaagaacaaaataaatgaatatttcataatatacaatcccaggattagcctctctaccatgggctttgtagctgaacacctcttgcctcgtcattcccttaattcaacatttttatcttgtgttcaaaatatatattttacatttatgtagaaggaaagaaagccatgactctcataacacttctatacaatctgtatataaaactggctatacatccatagttatgatgccaggagaatctcagtgtttgctatgaatcacccattagtcaaatctctccactcatcagagtctgattagaagccaactatccctggggcagttgttttttgaagaaaatgttaaagttggtcttcttgtttacatccggatagtatgaatcaaatgacatccctgtgatgaaaaaaaaaaaaacaaaagaaagaaagaaaatagtttaaagcctctcatggaactggcttttggtgatgactgccttcagtgattctcaattagaaaacatagagcaggtaaaaataattccagttcttaattaaaagcaggaaatgatgtcactttccatagttaaaggcagcatgacctagcagaaagtatgtattctttggagccagataaaacctcagctctgctgcatggcacctatgtcactttggacaagtgacaactttcctgaggcagatgttcacatctgcaggtggacgtgttaattagcttgattgtggttatcattttataatgtatgcatatatcaagacatcacattgtgatcttaaatatatgtaatttttatttgtcaattatacttcagtaaaaaatgggctaataatagcaactaggatggttttgtatataagtatatacaggaatatacagcctaggattataatagaacgttgcaggtgctccataatttataacccaaatgtccacagatttcctctgccatcagttacacatgttgctgactctccctcccacctgcatagcagcagtgtctccctcacacttaaagtctttcacacacagtgtgacccacattgcacaagaaaccagtaagctcctgttcttctgtcttcatgaaactaatggttacatgtctctgagggaggtgcccttctcaacagccctgttccaggtgccctctgggaggactgtgctctggcccaagtcctgggcaaaggccccagggggccagtgctctgcaatggataagggcagaaaggagaacacgactttcttcctttttctcctggaccttgaaacagccaatgtgtgaccctcctggaaacatacctatccacttcctttgcttcactgtcaggataaacttgaccttgaaattatgccaggaaataaaccatttttgttggacattcacctgtctttcacctctgtctccagtaatgtgctaatgttatctcatcctcccagggagcttgtgaggctgacatatttaacaccaatttatagatgaagagactggaacctagatagattcagaataccgtcccaaatctctctgctttctacctcctttaaatacctgaggtttcaccagcctaggatgtccatttccttttttttttttttttttttttttttttgagatggagtctcgctctgtcacccaggctggagtacagtggtgcgatctcggctcactacaacctccgtctcccgggttcaagcaattctcctgcctcagcctccagagtagctgggattttaggcacatgcctccacacctggctaatttttgtatttttggtagagatggggtttcaccatgttagccaggctggtctcaaactcctgatctcaggtaatctgcccacctctgtctcccaaagtgctgggattaccagggtgagccaacacgcctggccaggatgtccattttctattaaatgagcaccacatgttctgcaaaacattagcaattatcattattacttttctgctccaagtcaaattaggccagagtttacactcactcgagaatgatgagtctgaagaggtatctagagtaggaattgaaatgtaaaaatcagagtagtagagagagagaatggaggcaaggctttaagagattaagtaaaagaggtttggaaaaacaaaatcttgattataaaaagtaaaatagaaaggatggatatgaaagactttatgaatgagtcatcatctattttatttatcttcttttaaaaaattcttacatggcaccacctgcttctgtcacacttcacacccccaggcccaaactaccttctctgagccctttctttaaaaaaatacaaaaaagtaaagtaatcttccagataaaaactaagacttgttcttccccctctttcctttacccttcatttccgtaacttatctttctctgtgaaagtacaggtgggaaataatcaaggaactatttgtgtgtgtgtgtgtgtgtgtgtgtgtgtgtgtgtgtgtatgtgtgtgtatgagatttttatcatagtctacaagaaatctctagagattgctttcaaactaaaaccaatttcatacccaatagaaaactttagtttcattgaaggaaaagctaaatgggagcattcaaaagtgtcgttctaaaaagaagccggttctgaatacacttgcccaattactaccaagaaatcttctcctccttaaacccagaaataaaaagagaagtgcgctattgataatgcttcgtgtcatttatgcagggcaagtgaaaggtattctggttatcagtcattttctttgtcaagcataatttttcatgagttatattttagcaaaatactaaattcaatgtctattattattatcattattattattattattgcaaacgtcttccaagcaacatagaaagaacaaaggtggcattagtggaaaataaaaggcaaatgcacgttaacctcagcaatagttcacatgtgttatcaccgatgcatcttctgcatcttctacctcctttaatgcatcttaagtcataatattttagatcaaaatgtgccaaattaattcagctctagtgcgttgggttttatgaacctcccaaattacctgtctatttgctgctgatgtctgaaagacaagtggaggtgagaccaacaagagatttacatgtaccctgatagaaagggataatgttgcatcgttctgttttacttcttgtatatttatttctttttagcagcttgaaatgatccatagatccggaaactggtagacattgcaggctttcctcgttattgccactcacatattgtcttcttcaaggcccattctctcttaaccagagctcccaacagagaggacagtggaatagacatggaaacctctaaaaagtttaggcactatattactagcacatccctctcagctgcatatataaaaatctcaaatagacttaatttctttatattgatgtaatagatcaaaatctcaaattaatattttgtttctgactttttcatattcaaattctttaaagaatattaactaaatataggactgattatttggtgattatttaggtgttacaagtgaaaatgtgtatactaatgtctatggatctatctcaaatgtttcttcaagttttgtgtattctttcttcacatgctagttttgaactttactttggtgcctctatctgaaaaccaagaggaggtgagacacctaaaaatatcctcatttgcatctgtttcccttccttcagagaaggagggttggcccacccagttttgccttgacaaccaggaaatatctaatgacatggaattaattcactgttgatccctcatgctaccatgtcaggtcttccattatttggctcaaactgatgctgaattgcaagagagcaggacaggagcctgtcatttttacattccggatggttgccagtagacatgattaataaaagtcacttgatacaaatcaaagaacttggttaagtgaatcagatcctctttactttgtcttcttacagaaaacatgctataaggttcatactttttaaaagtcatgaaacaaaatataacaaatttaccccatatttattaaatagggatcacttccttcctaaaaacatttaagtgcagttctccagaatgaaagagataaacatgtgtagatgcaaatcaattctgtattggtttcttattaccacattaaaaagaaaatctgaagatataagttatgacttaattttgattttgaatgcatactgctacctaatgtacataaaataaccatcacagaatgaaactgatatatccaacagctggctgcatttaaatgattttaaaataagtgcttataaaaagtcaatttttggtgttttgctgcttaggaatgaaacgaatcacaaatgtttttatttgattttctctgacaggactgggaattcccacatttcatgggagatgttgatgtaaatctccctggtttgcacacccctcacatgcagttcaagattcctttcttccagaaaatcttcaaggaggaatatcgtattcacataacaggtgtgttatatctttgaacacaatttgattatcttcgtacattagttagggtaatgctagttgctgtaaaaagcaagccataatatttgagaggcataaatacaatgttatttctcattcacttaacagtgcaaggtggttttcagatcaacaaggggctctgtactatcattctgggacctaagttactggtggctttgacaatttcagtgttagcatccagcaggcagatggaaatacagagaatggggaaagtgattaagaaggcttgtctgttccgtaatctcttgggcttggaaaagaaatatgtcacctttcctcatgttccattgatgataactggtacatagccctacttagagtcagggagagcaaggaaatgtagtccttagctgagcagccacttctggtgtcagatctggtattctagtataggattatcaaagagggaagacaaatctttgctgtggagagtcatttctgccatactccatatgccactctaccttgatcttgttcattggatgggtttttcaccacatagaactcagtatctattttcaatgttatattctttatgctcttgttcttcatttgttgctgaaattaaaacaatggtatcctagagccccaatcagaacatatgtctttagggagttaggccacttctcatttgattttctgaaaacctacttctgtggcaaagctcaggtttgtcttaagtgattctcttgtggatcttcagattattttattttcagatattttctgcttttgaaatggctaaaatatgatttattgtaatatcctttcatgacatatcagtcattctcatctaaaaagggcttcccggagctacgttttatatctgtctttctttatgacaagaagcagacagctgaatgatcacagataaaggatggcattagttccaaagctgttcaaatgcaggtaatgagtgtgtgtctgttttaaggacaatggcctaggatcccacacctgctataataaaatctgctgaagaaatctgtgcttacactaccgtctgtgctgccaaataaaaatagtctgagcccagaaaacattaacatctgagtactgcaataaacctttgcttcccagctaggaggctgttttttgctttaagcatgaggcgaccttcctaaattggagaatgagctcatgaatagggaagatgcagcaggtttcttttcctattcaaaatgaatgaggcccatctattaaattcactgggtaaatcaatcaatttgagttcaggtcacatagtctggtttcagagtccccacttaatctctgcagcatgctaccctcttggacttctaaaacagctatcacacacatggcatcatcatatccctttggggggggcttttgcgtagaccatctgttcttgctaccagctcttgtcccaggccatcattacactaatattgtctctgactataagaatgccttgtcaaaaatatcctgcttaagtacagaacttcaggttaaaaaaggaaaaaaaaatggagagcccattggtaagaaaaaaaatgagctgctaaaaatatttaatttaggattattttgtataactttatcatttacattgtcatttatagatggtacagatttcagatttgtggtgtccagagtttacacaatgtggaatactctgtttaagaagatgaatataaaattacatctcaaaattatattcagtgcctcggaagggggctatgcatgcagagtccctaaagcttcagtgttattaactttgaggtaaagcctactgtgcatttagatagaagcagatacatgacttccatttgaactaaaaccctcttcccaccaagaattattttctgaaaacctaaaaggatgaaagactagttcaacttttatagcagagactacatattaatctggtttgcccgaaggtggtaatgtattgtaattaaggctttggtgcagtgtttgccatatgatgctgatggccaagtcatcagggaactttataaatacacagattgttgggtttcattactaatgttttgatccagtaggtctgggtgagggccagagaatcgaactttgggaaagctcccccaagtgatgttgataattggggatgtctcctttctgattgagagatgacagatgagatcagagcatctccctgaaatgtgccatgcaaacaattgggtgtctggacttgccaaaaaggcttttgaggattctggagcttaaattcaaaatattaataaaataaggggctgaacgtggtggctcacacctatagtcctggcactttgggaggccaaggcaggagggtcacttgaactcaggggtttgagacaccctgggcaacatagggaaactcatctctaaaaaaaaatagaaagaaaggaagaaagaggagggagggaagaaaggaaggagggagggaaggaaggaagaaaggaaggaaggaaggaaggaagtttggcatgatggcacacacctgtggtcctagccacttgggaggctgaggtgggaggatttcttgagcccaggaggtcaaggctgcagtgagccatgatggcaccactgcactccagcctgggcaacagagccagatcctgtctcaaaaaataagctaaaatagggtaggtgaggactttggagtgaagggttccaccataaacaaattaaatccaatttgtgataaacccagtttgttcacatgcatccacatagccatgataaaaataactgggaaaatggcacaggtttggaggttgaagcagtctgagcttttctctcttgcttttgttctgtttcttttactctctctgttttgttaattggctgaagagattgctgaggccaccccagagtagcatctagtcttctgtgaagggctttttactttacctgactacatttgtaagacaattgtttctgtggaaaactaggtaaaatttccaaaatactgtgctacatgctgcatttcaatattctcaatagttagcagcctacaaatttccatgtgaactacaaattctagcttgctgatcagctcctccgagccctggtactttttttatggagacttcagtgcttttcttgataactaaatacagtgtcaccactggggttattaagcataaaaccctctagatccgtcaggggatgacaaacgttaatgtgtattggaatcacctggagaacttatttaaaagacagctgcattagccacacctccagaatctgatgcctgaggtatgcagcagacttggaatccacccttctgtcaagcatggcaagtgatacgtctgctggctggcagaggactgctctttgagacatgctgctgctgagagacattttctatagttagaattcctcttatctcagctttaatttgttttcatatgcaactgttaaaatcaaaagccaaggggtagaatgcaaattcaatagcagtgggatgaccagggagaaaggcacatggtagaatcctcctaggagctgaaattttagagctggggccagcagaggagactatgattggggaaaggtgctggtctgagtgaccacagaggaagctggagccagggatgggaagggaacctgtagaaccccagacggctccctcttttgctttatctgctttgtttgttctgcactagaagagcctggacaaggactgtgaaaggtctcctgagtcaaaagttgactccacttggccccaatctaccatgtccctatgatttagaaaagacatccagcatacactgaagcaatggagcaaagaggttggatacatgggctctagctttgctacttactggtggtctggtcctcatcgagttccttagcccttcagagactcagtttctcgtctatttaatgggcacagtaataatacttatcccatagggttgttgtgagaattaaattaatatatgtaaggcacttatgacgctgcctgccatgtagtaagcattcagtaagctttcactgtttttttacttaaagcttttcctttcatctggccagagattgtctttcctatttaattcagaaatgttgggtagcttgagagggtgccctcttgccacttacccactattctgagttttctactgttatctgctgtcctgagtccttaaaaaggagaaagctaagaatgcaaaattctctctcccaatgaaatattctgtatgtagagggttatgacactgatgagttcccactgacattttaaaagcatataggatttgagtatttttttaatcctgattccaagctagttttatttatgcatgtcagaaataacttgaattgttgcatctgtttagctcatctggatcccccttgacagatggcttgctgcagtatgtatgagctttcattttataagctgggctacagcttataaaaataaatcatttctatccaagagtgttttaaaatatattttttcttagaatatgggcttcagtaacaaagggaataaatggttagtgattaagtcacactggtacttttagcccaagttcattgttctcctcctaaaagtaaaccctaaaagcaactgtataatgatcttctctgccctcttcccctttacctgtaaggtaagtgcatagatggattgaaaatgcgatgtactaaatctctggaggtgagagaggaatggcctctcaattcagtctcggaagctcctctgagtcctattaatgccaatcccggtggaagctctgccatctgtcatcgcagccaaaggaagtgtcccattggtggccatcatctgagtaaattaggagggggttgggcaaaaggccagaaggaaggcctgtgcagccttgagaaaagaattcacactgttggcacgatgatgcccacgggaacccttttggcaaaaatggaacatgtagaagtaaacaagcctgtatagtgtctgttctatttcagtttcctgtgttgtgtgagggtacaggtgttttacaatggtgagaatgtggaaaataatgagtaaaaatgaaggattttattttcataggtgcatgatttctagcaaatgagttcccagagactgtttttttttaaagagctctcctgtatgaatcaggccatgagaaggctggggaggggacagccagtggttcctccagcagaatgttctgtctggcaaaattagcaagggactcgttataaggaaatgtgttgcatcctgtatacaaagaaagtccccgaagatcatgaatttatccaaagtacacaaagacctcttgctcctctctcagttgtgaatttttccaaacctttcctcaagcaattttcattttcagctcttaagagttaactatgtttacttctatataaagcagcaattccttttatttgtccaaaactcatcttcttcagggccatcattttgcccatggcctgtcagttcttgctggccctgagtttctgccctgcccaccctgaggtatcctgtcttcatttgtacatacatgagcacctttgtaataaaacttacatgccctttaggaattgacttcagagccagaggaaggactcgaaatatataattattcataatccttgaaacatgaacattttgcttttcacagtttttcagattatgtccaattttagctatgtcgtggaattcatcagataattatgatacatgcattttatttgaaatgctaaaacttctcttttcgtatttttctgggcacattgtctcagagtttacaagttggttaacagatatttttctgagttaatatgtgtcaaaaactagttggtatctggagaacacagaaatgaacacgacacagttcccaatctcaagaaagtcatagtttaatggtcatctaattcagtataaccacttttcttctttctatgcttatgatcacatgttcctacctgtactcgtcacattggattgcttcctaagaaatagtctcccacttaggaagtaacaatgacaagagaggcactttgagaagttgtatcagtttgtttttaagtcttaagaaggtactttgataactcaaataattatgactacttcataaattaataagtaaatattttcagtttacgaaatggcctcctcatgacccaagcacttaatgtggtttctagatatccctaaattgcctagggagagacatgaagagatgctaactcgtgagccctgtttttactgctcacatctggaatgaggggagattaggatggatggccaagaagactgatacagcaaattgcatatttcttttacttatccaaaattcatcttcttcaaggccatggttttgtgctgtcccatgatggttgctgaatgactttggggagcgtaaccacatccatacacctgcactagatgtcaaagtctggccaagtaatcgcacccatgtggtagagaggggcccacagcacagctcatccacagtgctaactggcacctctgcagagtaaaagattaaaaatattatatttgcatatttcagtcatgaaaagttcattatatggtggaattatcagtaccttatagtctttttccttagttgaaaaaaataacactttccctcaaattgttgtcatttgctatttgagggtgatatttaatgaagaatccttttaaaatgatctatcctcagattctgtaaactcccacaaagtaaaaagataaaattttcattataatatcatctctgacaaccagtaggattcattaaaagcccaaaaaccaaaaaagaggtaatcccaccaacaccacgcagtgatttctcattagaggagatagtgaagtatttcaacaaggagattaatagaaagaatgtatggattcttaccctacctccttgctgatttacattgtgctaggtagttgaaacaacaggggaaaatgcaaaagctctcatatgattaatgctgaaataccaaccctctggttactgtcgattgtatattcacaacaacacacttgggaaaatggctatagaagcactttctattctgttcttttttgtcttaaatcctttctatctgggtcatttcagggactcaaatttattttttatggtaaacactgtttctcagaagatacaattttttttcagaaaacctttctccttctaaaattgtatattccatcttctttgctctaatgttgagattttctggcccagcataaaacactaagatttaggcaatgtttatttcacagactcatcaaagaaacttttagggctgggaagaaatcttaaggattatctagctcaactccctcactttatagacaagaacacaggggttgggttgccctgcctgacttcaccttctgctttgccacatctgatagggcaaaaggaattttttaaggaggagaaagcattaccaaggtaacgacacagtgtgtgggaaaaatggaaagatggatgacagagaaagatgaacatccttcctctgtaaacagataaatgaactagaggtcatgtcagatgggcagaaacaaacaaacaaaaataataaaaagggccattttttctaccattttagcagcttcaagtttcagctgagtgagagaaggacactgctgcatgcgcaggagggagaagaagggaaatgtgatatgaataggcagcctggctcactgcatcccttcccctctgcacttccccacccccacatggcctctcttctgtgggggagaggtagggacacgatcccctgttttttagtctcaaaattcatagatataaaaggtctttcctcagggccaatactactgcaagcagtagacaaactactaattgctaaggatttttaacatgttaaatatgctgatttagaaagcatatttacatagagccacacactgagtcctcttggataactggtcccatgtcatcttcctattattgttggtatttagtaatgcatactgttttattccaacagaaaaattagataatgtaatcacttttaggatatatctttgttacaatccttatgtgtccttctctccctctattccgtcaccaagatcctatattgtctggattgaagaagtagagaaataaattggagaaataataccaccctacatttttggcaaacaatatatttcagagaatgttctaacacaacatctcattttatcctcacaaataatcctttgaggtagttacactggtattattctccatttcacagaataaaaaattggattctatacacgaccaataagtagacagatttggggtagaagggcagaattatggaactggaaggcatctagttcagttttctcaatttgaaaatagaataaccgtggtctagagaggttaaacaggttacccaaggtcatatgctttaagttcagtgttgggatgagatgcccatctgctcatttccagcctgcagctttgttgccatggtgctcccttttacaaaccagtaaagatgtgttggagtaggtgatgatatccgttaactgatgttaggccatacagttttaatttgctccttctccaccccatctaaatgttcagacatcaggacacatgagaaataataaaaagtgatccttgggtgtgcaagtttagtggtcaaactgacccagcactattcacttggtagaaaaataattaaatagtgctggaaaagttctttgggagaaagaaacctttgggagtcaagaaagtagtgggagccaggtatggtgacttgagcttgtagttctagctacttgggaggctgaggcaggaggattgttttgtctaggagttcaaggctgcagtgagctataattgcaccactgtgctccagccttgcaacagagtgagacactgtctcaaaaggaaaataaaaattttataaggagacggtgatcagtcatacaagcacaaggacctcttcccccaccatctggtctggctttgtaacatgtacagtttacagcaagagaataaatataaagctccgacaacagaggagaacccaaagcccctccttcaacttgctttctgtcatggaatctacagattagtgtctccttaatactggataagaatctctgaactttttcatttctcctgtttctcatccctttcctgcctttttctacaataatctccattcttttccttttctctcccctcagcctctttcttccatgttatctcatcttttatatatgctgttctatctacaacatactgaaagcataaacgaaaataaacacaaaattttccaaactattttctgtcctgcttgttcttcaaggaccacatgaattgttccgtcctcaaaatctttcctgcagaaagtatccttcagtttttttccatttcctcaatatttacagcatttatggtttgtatcactcatttggcacctccagatgtagcctctcactatttatctgttgatctctgtcctgttcccctaacaagatgatgaaatcctttctgaaaggcagagacatatgttttcagcatctaccagtgtgttctacacggagtctgttatggttgatctttaatatgaacctggtttagttttgaagatctcatgagtggtttgaacttaacagcaccagacgctatagatattttatcatatctgagacaacattcccaatgttcaaaattactttccagttgggtatgcccaaaaaaatcattcaggcaagagttttcatttcaaatattataaactctatatagctgaacaatgtcaggacaagcagttactattccccttcatatagtttaggtaagctctcttcatagaggagcaagttgcaccttctcatgcaaataaaaaaattatcatggtttaggcaaggctttcgtgatgataattatagcaattactgggcccctattatgtaccaggcactgtccttagcatctagtaatcgcatgaaattctgacaactttaataaatactattattttctgcatgtaaagaaactgggctttggagtgtttaacaactggctcaagatcacacagctagtaattttggagccaggattaaaagtatttagccttacatataataggagctttaataaaatatgtaattatgatgataaaatattttcctaaactcctcgcagttatgtcttttatatttttatgtagctagatattttgttagactgtatattgccaaatacataatcatatgaagcagtaacaataacgttaaataatgttacttcaaatacaaaagaaaaaagttttggcataatacataaaattattataactaaagcttctggaacctggtacatacgtcccctaacttgctacagcaaacctatgaggtaggtattactgtattattataatatacatgatacttgcaataatttataataaaaaattataatagaatctagtatcactcgaaagttttttcaccttttgtccatttgtagaaatcataataaaaattataatggactctagtatacctgaaaagttttctagtatacctgaaaagtttttccacattctttccatttgcaaatgtaaaaatatcatttgataaaagatcattaaatattgtatttatataagattttaaatattaaaaaaagaaataatagttgcaatctcttcaaatatatcttttcaagcagttcataaggtatggttacatttatgtctgataaatgcattttgttcaatgagaatttgatgtaattatttttaaagtcttgaatgctcaaggattattgatctgaatcacatcaactaatggtttaatcaacaggtcacctacaaacagcaatatgaattaatttgatatactgctgtgcttgcattgcaaaatgatttatttcttgcccagacataattataaaactgtaagagatgttcaatcatacattgaacttttctaagaatttcattagactttgttttttcacattaattgaaatgttctagaggataacctacatggaaccaaatttgagtatagctgtggtgcctataaaacaaggagacttaatcttgttagtataaatgccataaattactggctcagggacctacagttgtgttttcatatgcccagaatccatttagtaaattccctttgccaattcacttaatggcagcacagcactctcaaaatattaattgttaaccagtctgaaacattaacaattgatgttattataccattatcctcattttattgtagaaaaccttattgcaattttatggccctttgattaatgcagtatttcttttttaatgcaggcaaatggtttaactatggaattatcttcctcgtcttgattttggatcttaatatgtggaagaaccaaatattttataaacctcatgaatatgggcaatatatcggcccggggcagaagatatatacagtgaaagactcagaaagtttaaaagatttgaacagaaccaagctatcctgggaatggaggtccaatcacactaaccctcggactaataaaacatatgttgagggagacatgttcttacacagcaggttcataggagccagtcttgatgtcaagtgtctggcctttgttccaagcctgatagcctttgtgtggtttggattctttatttggttctttggacgatttttgaaaaatgagccacgcatggagaatcaagacaaaacttacactcgcatgaaaagaaaatctccatcagaacatagcaaagacatgggaatcactcgagaaaacacccaggcttcagtagaagaccccttgaatgacccttctttggtttgcatcaggtctgacttcaatgagatcgtctacaagtcttcccacctaacctcggaaaacttgagctcacagttgaacgaatctactagtgcaacagaagctgatcaagacccaacgacttctaaaagtacacctacgaactagactcggagatagacttggagataacacaaaaagcaaccttgagtgtaactttaaaaatttagtctttccttttgtatatgtaaggtttacgtagtgttaggtaaaaatatgaacaatgccacaacggtgctcaacatgctttttctaggattcattgttttctatttgtattataatacacgtgcctactgtatactcaacagtcctctagagattgcttttcacaattgcacaagctattactgactttacagcatagtggaagattagctgatgacccatgtatctgatgttcaaccatagtggtgccttgagacattaaactgtttttaactgtaccagaaatgaagtgtggaacagttacctaacctatttcacatgggcgttttgtatacaactattttgatctacacttgatgtctgagcagaaaacagaaatagctaaatgtgactcaggaagtatctcttggtttcttattcagcagcagagttggtgactttgacaactggactgcagagaaacatggtgatcaccttttaatttttattggctgtctgccaaatataaatacagatgcaaaattcagtaataggagatccataacccaacatgggtcactactcgtgaaatgtgactttctcccaccagtaattgaaatgaggtgatgatacctaattatgttttcctaattaaagataaattgctacttgattaaaaatcctgcccttcacctttgggaacaaaggttaagagacacagttgggcgaactctcaaatttattggcatttacacaaagtcccagacaaccaaggaactgaagttttcatcatatgagagcagcacatcccaccatttacaatattcgtatatctttctgcaaatatggctctggatagtgaaaattgaaaaacatatgccaaccctgagcaagggaactcctcaaaaaatcatgcagcggaaccttgtcaggtagagaagccgtgcatgaaagaatttgtttaatgtcttgttttgcgtatgtgttttttgtttttgttttttaagaactaaatattgcacattaataaataagaattatacagca

SEQ ID NO: 2461 - DNA, 580797 bp, Homo sapiens
gatggcttcactgagaagagtcaaagtgctgttggtgttgaacttgatcgcggtagccggcttcgtgctcttcctggccaagtgccggcccatcgcggtgcgcagcggagacgccttccacgagatccggccgcgcgccgaggtggccaacctcagcgcgcacagcgccagccccatccaggatgcggtcctgaagcgcctgtcgctgctggaggacatcgtgtaccggcagctgaatggtaaggacgcacgccggcgcctccggggctcgacgcgggcgggccgggcacagggtgagccccagggtccttgcgcgctgcgccctgtgcctgggagccggcacaccctggctcccgcgcgctccttcttacccttcctgccccgtttcgggcagatggccggggctgctggaaagaacaacttgcctgattcttttctgtgccccacctgcaaatttggttttatcctggaaacatgtcagtacagttggctcccggtccccgcgtgcggactggaaatcattccctggcgactccagcccgagcgcagaaactagtggaggggccacatgggactggaggcgcgcgggcagacgtgtaggaggaaatagtcttagagcccagcgtttggtggggtaccagtagggaacctgggagattggagggcttggatgtctgcagacaaagtcaaggccccaggtcgcggagctaatgcgcttaggtagtatatgggaggaatatgtcatctgtctatgaggcgagctgctcagctaagaatgaggactcctcccttcctgccgcctgtgtttctccttgggggctgcggaggggcgattgttaaagctcagggtgggcctgcgaagtttccagaatgtagcacagagagatgtggcatcccattagtgacagttgtctgaatctgtcccatctaaaatgttgtgctcagtacttcaggagaagagggagactttttatgtgctcttgtcacacctgggccaggtcattggacactagctgtccccaacgtcagagtgagtgttacctacctgagtacaggcaggtttccaggatgcgtggggttatccaaggcagatacgtacttaggtacagactacctcctccctttctgagcttgtaactcatgttctcaaacgaactgcagataatcacgaagatcgtgataataataactgatggaattcttgctctgtgccagatgcgtgcaaagacattacaagtacattatctcactgtatgttcacatctgtccagcgaggctccacccatccacagaggggaaatgagaagactaagcgaggggaggttaactaagttgccctgtgttaaataagatataactgcgccccaaacctctgtaatcggaataataatagagtctggagtcagaaccctgtgtctggttgaccacagagcctgtgcgcttgacctcttaggctcaaacttctatccatggttttcccctaagtgaaaggagtattaggtttgttgaaaacagaaatatgtggaattgcaaatacagacatataccttctcacattggaggatctcaactgtcttcactgtggtggcaaggggcagggagaaggaggatggcaaatggttcttttcaggctcaccaaaggtccctgctgggtactgggggagggatgggatggagggagaggggtggtcagatctctgagcaggtgaaaggacgctgcggtcttctcgaagccatttgacagatatccaggggatgccttgaacttgcagggtatatggcctgactgtcagggtagcccacggaagttatgcagaagctcttctctcaggtgtcagaaatatggcacagaatgcgacaaaaacccatagttcatttctggaggaatcagaaacttacggggtggccttataatttgggatagattcctgctgtagacatacccataggaacttcaaaggttaacctggtttccctcatcaggcttttctcagggacacaggttagtttagtatcagtttctttgttttatggtttttttttttttttttttttttttttttttgagacagggtcttctcgctctgtccccctggctggagtgcagtggtgcaatcatagctcactgaagcttcaaactcctgggctcaagtcattctctggccttagcctcccaagtagctgggtctacaagtgtgcatcaccatgcccttctaattttttaattttttgtagacacagggtcttgctaggttgtccaggctggtctcgaattcctggcttcaagcaatcctcctgcctgggcctcccaaagtgttgggatgacaggcgtgagccaccatgcctggccccagtattagtttcaattaggagcattaaatattatatagctgtaccctaacttccctcataggaataataaaattctataataataactgatggaattcttgctgtgtgccagatgtgtgcagagacattacaagtgcattatctcactgtatgttcacatctgtccagagaggctccacccatccccagttgagaaatgagaaaactaggtgaagggaggttaggaggctactttctacttgccacagacatacatgaacccactgaatctttacaatgacttgcgagatgggtgctctgacacccgcctgaacaacttgctcacagtcacccagctagtgagtgtcagagctgggaatcgaacctggaatgtcaggctccagaatggaggttcttagctcctgcaccagtgtcttgatcttcagcatgtgcatcagaatcactgaagagccctttaagacagatttctgggcctcccgcccaggtctcaggtgaagcctgagaatttgcctctctaacaaacttgggacagggccctcgacccactgcccaacagtctgctgcctacatcaagcagagtaaaggtagaaaacccatccaacctccaaagccagctcattttggggacttaagctgagagcttgcttcagatcaactggcgtctggcttccttctctgtggccttctgccctgtaaacagttcccggactggtggagtcaggtgctgtggggtgggaaggctgagttttcctgacttgcaagttggcagcaaggccaagttgagagcttttcctgggcaagctaagaatgcaagctgcgactaggcagatgttaccatcctgactgcctagtgtcatttgcagtgacatgaagcctgcagaaaaagagcagggaaaaattgtgaaatatagggggctcttcctctctctccacctggcccctcaagcaccttcatcctctgccggtgcttgttttgggtaatgcgtgtcccatctgttgatgccctccgcctgctgcagtgggaggctgctccgagaaggcaaagggctcctagtgcctggggagacacgtgctctcttgctctgcagccggtcttcattcattgctcccgagggtggagaaggaaaccttgaccttaatgttctttattcccttggaattaatggagaggctgctagagccagtgcactgtgcatgtaagagggccaaagccacttggtacagagtgggagccaggcattttaaaggttgctcaagtttcttaaatctttcccgtggactcctgtgaagtccaagcaggtgggatttatggagggctctacctcctcctggcttcctcttctttttttttgagatggagtctcgctgtgtcgccaggctggagtgcagtggtgcgatctccgctcgctgcagtctccgcttcctgggttcaagtgactttcctgcctcagctcccgagtagctgggactacaggcacccgccaccatgcccggctaatttttgtgtttttagtagagacgggttttcgccatgttggtcaggctggtgttgagttcctgacctcaagtgatcctcctgtttcggcctcccaaagtgctgggattacaggtgtaagccactgtgccctgcctgtaggcttcttttttttttgagtcagagtctcactctgtcactcaggctggagtgcagtgatgcaattatagctcattgcaacctctacttccccggctcaagtgatcctcccacctcagcctccctagtagcagggactacaagtacatgctaccatgcccagctagtttttgtattttttgtagagatggggttctgccatgttgccagggctggtttcaagtgatccccacccccacccccttttcaccccacaccccacctcaggccttggcctcccaaagtgctgggattagaggtgtgagccacagcgccttgataggccttttaagggctggaatcatatttttgacttttttttttttttttttgagacagagtcttgctctgtcacccaggctggagcgcagtggcgcgatctcggctcactgcaagctccgcctcccgggttcacgccattctcctgcctcagcctcccgagtagctgggactacaggcgtccgccaccacgcccggctaattttttgtatttttagtagagacggggtttcaccgtgttcgccaggatggtctcgatctcctgacctcgtgatccacccgcctcggcctcccaaggtgctgggattacaggcgtgagccaccgcgcccggccattttggacttttaataccacccccatccctcagcacaccacagccccttgcacttaatggggcacttaaggtttattggttgatcaagttgttgggagctagtttgaggaggtaaatgatggccagataggaaataacctcaaggctgtaaagtctgggttgtgttggatggatgtggagaggggtgggggctgggaggactcagctagagagacagtgtgaggaagccatcttgcctccgccatcttgaggctcgtctagtcttcaccttcctgactgaagggaacgagatccttcgaggccctcggaagtgagccaggttaggaataggcaagtttcagcgtgttttcgttaaatgtatgatttcataacatgaatatggctttatagttaagccttgaaacaatgcagagattagggatgccaacacttgcacagtcaaaaatccaagtataatttttgactcccccaaaacttaactgttaatagcctgctcttgaccagaaggcttactggtaacataagcagttgattaacacttattttctatcttgtgtgtattatacactatattcttataaaaagtaagctaaagaaaaggaaatgttattaagaaaattgtatgggctgggcacattggctcatgcctgtaatccctgtactatgggaagctgaggtgagaagatcagttgaggccaggaattttagaccaacctgggcaacacagcaagacctcatctttacaaaaatcagctgggcatggtggtgcacacctgtggtcccagctcttcaggaggctgaggtgggaggatgttttgagcctaggagttcgaggctacagtgagctatggttgtgccactgctccccagccttctggctcaaaagaaaaaaaaatcatgtggaagagaaaatatatttactattaattgagtagaagtggattgttgtaaaggtcttcatcctggtcatcttcacattgagtaggtgaggaggaggaggaagggttggtcttgctgtctcaggggtggcagaggaagaaaaaaatctatgtacaggtggacccacgcagttcagacccttgttgttcaaggggtcaacagcatattctttttttgtatataaaattaattcatctttattgtagaaaatatggaaaatctaaaacaattatacaggatacaataccatgttaaaaaaatttaacatgattgcgtgtaggctttgtacaagcattaggaaagtggacctagtggtcgggcacagtggctcacgcctgtaatcccagcattttgggaggccgaggtgggtggatcacttgggcccaggagttccagaccagtctggccaacatggcgaaaccctgtctctacaaaaaaatacaaaaagtagcagggcgtggtggctggtgcctgtaatcccagctactctggaggctgagtcaggagaatcacttgaacctgggaggcggaggttgcagtgagctgagattgcaccactgcactccagtctgggcgacggaacaagatttggtctcaaataaataaataaaataaaaaagaaagtggacctagagacagacggatttcttgttagaattcttctttatgtgatttttggctttctatcatgtttctgtcactttctgaggaagttacttatttctctcattttagaggtgagaaaggtgagaaacagagatactatgtgacttttccagggtgacacagctagggaagggcagagccaggttcaggaataccagggtacttcctcccaggagtccagcactttcctaataagtaaggggaaagagatggaggggtctggagcttcacttgcccctcgcaggctcaaagccttagagacaccctctcctctcctcagagtccacacgcaggacgcacagcagagctgtatccctgtgagcccagggcagctctgtcataagaagaaatgcaatcgattcaacttagttaccaaatttagatttcagaaggatagtgaatagaagtggagttgcttaaagaaattgaaaatctttgtagaaatggagagaagtcaaaattacctcttccagtcctgcccccaagccactcaggcacttgaagttggagtctgagtgataggaaaccaagacgctcctatatagccccagcacaccacaacccacccaacagaactccctaggcaaggagagtgatttggcacagagagaggaagagatttgctctcacaggtctccaaggtggagtcagaaagagaggaatggtggccgggcacggtggctcaagcctgtaatcccagcactttgggaggccgtggtgggcagatcacttgaggtcaggagttccagaccagcctggccaacatggtgaaaccccgtctctactaaaaatacaaaaataagccaggcgtggtgacgggcatctgtaatcccagctactcaagaggttgaggcaagataatttgcttgaacctggaaggcagaggctgcagtgagcagagatcgcgcccctgcactccagccagggagacagagcgagactctgtcttaaaaataaacaaacaaacacacaccaaaaccaaaaacaaaaagagagggatggcatttggaaagcatctccgttcattaatgccagaggtggtctggtgttatatttcttctttcttgcagcccacagatgctggacggtaccaccatttcctgcaggaaggagcgaagggagagggcacatgtgcatattaaaatcagttgctgcagggaacatcagaaggaaaccagggcagttcaagccttcatttgctgcacgcagacattccacagggattgaggacaggcgcgggccctgggttatggaaggcttggtcctaggaccagggccagggtgctggaggacacccactccctttacctccaaggactcatggtgtctggttgcagttggcccctcctgaagaaatagggagtcctgttcttggacagccctcagatgcaggcacatctgtgttggcaggtgagtgtggtgggcaccctgccagtgggggcagctgccacctgcccagcccagaggtagcaggagaggcagccagtgtcattcttgctgaagaaacccaacccccctgacctttgctagttgccaaatctggagcgtcctttgtggaaaggaagaaagctcggtaattacttagagctaagagtgaccacaggaagttggaacatgagcacacccaagcccaaggccagcgaagaaacaacctacgattagatgacctgcgagtctttaagaatatataagaagaaccaggcacagtggctcacgcctgtaatcccagcactttgggaggctgaggtggaaggatggcttgagaccaggagtttgagactagcttgggcaacatagcaagaccttctctctacaaaaaataaaaaattagccagacattgtggtgcatgcccatggtcccagctactcgagaggctgaggtgggaggaacgcttgagcctaagagttcgaggcttcagtgagccatgattgcatcactgcactccatccatcctgggtgacagagcaagacccaaactctaaaaaaaaacccccaaaccagtgtattaaaaggacactcagggccaggcatggtgactcagggccaggcgtggtgactcacgcctgtaatcccagcactttgggaggccggggcaggtggatcatgagatcaggagttcaagaccagcctggccaacatggcgaaaccccatctctactaaaaatacaaaaaatagccaggcatggtggcaagcgcctgtaatcccagctactcggggggctgaggcaggagaatcacttgaacctgagaggcggaggttgcagtgaaccgagattgtgccattgcaccgtagcctgggagtctgggcgacagagcaagactgtctcaaaaaaaaaaagaaaagaaaaaaaaaagacagactgggtttgatttccactgtcacttattacctctgtgaccttgggcaagtcccttcactttttaagtgtaaaatgggactgtcatatgtcaggatgacttgaaattcaaaatgtatagcataagcatgaaacccaacacacggcagttgtaagaatacaaactacttatgggaagggccatgagtgctgtttcccatcatattcccgagacacttagagcagccctgggccatggtaggtactcaggagatgtttctttttctttctttctttctttttttttttttttgaaacagagtctcgctctgttacccaggctggagtacagtggcatgatctcggctcactgcaaactctgcctcatgggttcaagtgatcctcctgcctcagcctgcttggtagctgggattacaggtatgcgccaccacgtctggctgtgtgtgtgtgtgtgtgtgtgtgtgtgtgtgtgtgtgtatgtgtgtatttttagtagagacagggtttcaccatattgaccagcctggtcttgaactcctgacctcaagtgatcctcctgcctcagtctcccaaagtgctgggatttcaggcatgagccaccacatttggctgtgtgtgtgtgtgtgtgtgtgtgtgtgtgtgtgtttagtagagatggggtttcaccatgttggccagccctgtcttgaactcctgacctcaagtgatcctcttgcctcagcctcccagagtgctgggattataggaatgagccactatgcggggccctcaggagatatttcttgaatggatgcatggacagctagcaatgcttcatagtagagtatggtcattgttatttgctttgtgaatgtcagacgaggtgagagggggtccttttccttataactttcttggactcttcagactacttttggatccttctctcttccatgtgtttatctgagccagactccatttccttcttccttctcctgccatcccctgctcctcctcttacttataatgatggtgcctttggctgatggcttttaatgcctaggagaagaaatggcagcctgtctgacaaacccaattacagaacacaatggtcattcatatccgttagtgagcacttccttgccgcgaggcgtagactagatgctaagagtacaatgaggtgcagagatcatgcttacttaggcattgtggaatagtgggaagatatctttgtggctttaccagggatgtgccaggtccctaaagaatattagactggctgggtgcggtggctcacgcctgtaatcccagcactttgggaggcctaagcgggtggatcacttgaggtcaggagttcaagactagcctggccaacatggtgaaattttttctctactaaaaatacaaaaattagctgggcttggtggcacatacctgtaatcccagctacttgggaggctgaggcaggagaatcacttgaacttgggagacggaggttgccatgggccgagattgtgccactgcattgtagcctgggcgacagggcgagactcttgtctcaaaaaaaaaaaaaaaaaggaatgttacactgagcctggaagtagggaggcttgaactggtgcacggtaggtgcttagccggtgagtgctgaatttaaacaagaacacttagaaattttcatgcatgcacgataggtgcgaggtagtgagatcaccttgtggaaggtgtgaaagcaagtcagaagaaatggatgctcttggccgagtgcagtggctcacgcctgtaatcccagcactttgggaggccgaggtgggtggatcctttgaggtcaggagttcaagaccagcctggccaacacagcgaaaccctgtctctactaaaagtacaaaaattagccgggtgtggtggcgggcacccgtcatcccagttacttgggaggctgaggcaggagaatcacttgaactcaggaggtggaggttgcagtgagatgagatcccaccactgcactccagagcgagactgtctcaaaaaaaaaaaaaaaaaagaaagaaaagaaatggatgcccttgagaggtggtcagagccagaactacgaatctgcgggattcctggcaagggaatggcatgagcagaagagtgtgtggggacatgtaagtgaggaggtgtgggagctccttggtgaaggggagtttgttaggaggactgggtggaggctggactgggccaggttttggatcctaggttggtttggacttaattgcataggcttggggagccattatgtgaccaggtcactatgttgacttaatgtgatgtcatgttgcggcttattgcatctggggatgattgggagagtgggttggaatgcagcagtagggcagggcacggtggctcacgcctgtaatcccaacacttcgtgaggctaaggtgggaggatcacttgagcctgggagttcgagaccagcctgggcaacatagtgagaccccatctctatttaaaaaaaaaaaaagagtgcagcagtgggtatagagagctggtgttgctggcgtggctggccctgccattcctctgagttcaggactcagcccaccctctgaacctcagagtgattttagttgcatgtcatttgctccctctgtgactccacgatcacatccagaactaagagtcaacatctggaattgctgcatttggaaaatctggtacagctttggggatctctgacctgagccctctctcaggctcccacttctcttacaccttgttgaggtccagcccccaaccctaccactgtttctagctccctgtgctcctgtccttccatatctggcctggggagtccgtcagaaatccccttgtcagctcctcgagtatccttacctcctcgtcatctgtggcatccaccagcaacccccgagggtggatgagcttattcctggggaacgtcccaccttggcaggcgttggtgccataggatgcaagctcaggtcttagctgggccctcagcatgtccagaacctgataatcatcattattattggctgttcacatccattagtgagctcttccttgctgcaagaggcagcttagatgctaagagtacaagaggtcacacctatctagacattgtcatctaattggaaggatacatttgtaatgttaccaggtatacatcaagtcccaaaagtgttacaggaccaataggttcatatgcccactgctcagtaactgaccagttacaccgagacagtaggttttgtggcagagaaagagtttaatgattgcagggcacagagtgaggagatgggaggagaccctcaaatccgtctcctgaaggagttctgggctggggttttgttttgtttttgatggagtctctctctctttcacaggctggagtgcagtggcacatttcatttcactgcaacctctgcctcctggactcaagcaattctcctgcctcagcctcccaagtagctgggactacaggtgcatgccaccatgccaggctaattttttgtatttttagtagagatggggtttcaccatgttagccaggatggtcttgatctcctgacttcgtgatttgcccaccttggcctcccaaaatgctgggaatacaggtgtgagccactgtgcccatcttgggctggggtttttaaggggatcatggaggacaaggggctggagaattggggtcatggattggtcagcataagagggatgaaattgtcaggatgtggaaactgcattctttggtgagtcagcttcttgggttcttcaggccagccgatgtcagcagtttcgctggtgtgcaggacctgaaagagtgtctcaaagggaaaactgaacgcttcatgtttaccttgttatccatggagcagttaaggggaattataatcttgtaataggatcgcagcctggcaacaaagcgagactccattgctacaacataactaaaaacctagctgggcatggtggtgcacacctggagtcccagctactcaggaggctgaggtgggaggatctcttttgagcccgggagtttgagactacagtgagctatgattgtgccactgctttccagcctgggtgacagagtgagaccctgtttctaaaatttataatcatcacaataaatagataaaaaatagggtctacatgattctaggacaattggtagcaaacaaccatgagcaagcaggtcagagaacaagctgacctagtgatgaacgcagaatgtgctgcaagcttggtttattttcatttctcccctctcttcttccctgattaattttataaagttcatacgggtttcttaatttttttatttttattttttgagaaggagtctcactcgttgcccaggccggagtgcagtggcacaatctcggctcactataaccttcacctcctgggttcaaatgattctcctgcctcagcctgctgagtagctgggattacaggcggccgccaccacaccccgctaatttttgtatttttagtagacactggttttcaccatcttggccagggtggtctcaaactcctgacctcaagtgctccgtcagtcttggcctcccaaagtgctgggattacaggcgcgagccaccgtacggggcccgtatgggtttttttttaaaggaatatttctatccctttccattttctatacctccctgagccaaagaggaggtgggctgtgctgggctggagggatccttcgggaggcggtggagacgggtggatggagtggcctgactccagattcagtctcctctcagctccccacgccctgagtgactgctgatctcaaatgacacagagatttgttcctccccgggtgccaccaccgcagcccacttcttactgggattgtcacagctgtgactgctgcaacaactgagtccgctgggatatgctgaggccagtgccagtctcgggtcctctcactccttctggattcagagatcatgttgcaggggcaagacctgacttcctagcagctccttaagggacaagagatggaatccagaattacagggaagccaactctccatgggtggcttttggcctgaaggatgaagggggaggggaccacaaagaagcagataaattatctcccgcttagcagtgcagtctggagatatggtgcccatgtggcccctgggaagaagtccagggagagggagtgctcactgccttccctcccttctccctccctccctcgccgccatcctcccttccacagcacttagaataaatgcaggactcacaggggctgaaagatcttcctctcccctagtgattgctgctcaccggtctttagactgctctgacatgtggatgacaatcggctgagccactgatagagaagttttcccttttaatcatgtccctgtcattgctaactgcagagtctcagctttgccatgcatgagtaataaactgctgccgtaatcacaggcgaccacgttcagacaccaacacacgagcgtgctgacagttaatggggaacagggttccagaaggacttcttccatcctagcctcggacacaagggaggctaattgtgtgattagtgtttactgaggaatgtcctgtagttacatacagcttgttaggtgctgtacttccctggtgaaagagcatgaatttgggttcaggagaccagggttctaggtttactttatttctagggaccaaagtttatgcatgtgtaaaatgagaccggtatgattgtagggtcctttaactctcagattatgaataacatctctttccctcattgtatttagtcagggttctttagagggacagatatatatgagtttgttaagtattaacttacacaatcacaaggtcccacagtaggcttttctgcaagtttcaggagcaaggagagcctgtccaagtccccaaactgaagaacttggagtccgatgtttgagggcaggaagcatccagcacgggagaaagaagtaggctgggaagctaggccagtctaacttttcatgtttttctgcctgctttatattcagctggcagctgattagatggtgcccatccaaattaagggtggatctgccttccccagcccactgactcgaatgttaatctcttttgacaacaccctcacagacacacccaggattaatattttgcatccttcaatccaatcagattgacactcagtattaaccatcacattcatcctattaaaatctcatgcattctccaaggaccatttcttttttcttttttttttagacggagtctcactctgtcgtccaggctggagtgcagtggcatgatctcagctcaccacaacctccacctcccaggttccatcgattctcctgcctcagcctcccgggtagctgggactacaagagtgcaccaccacacccggctaattttttgtatttttagtagagatgaggtttcactatgttggccaggctggtctcaaactcctgacttcatgatccactgccttggcctcccaaagtgctgagattacatgcatgagccactgcaccaggcctctccaaggaccatttcaaaagcccttcattctctgtaacctcccctgaccaccttgtcagaattaaatgtcctttcttctcacctcttatggtactttcagtggatcttcttttagcccttgttcatctctgtctttcctcaaaatgatttgttgtcatggccagcccagtagtttccaagagaatgggtttcattcattttttaaaaacccctctctgtgtcatttaggaattaatttgtcagcaagtaatttgttctcacttcacaagtccagaagtagtggtagctagcactgttttggcatcatagtgtcatagctcatgtcactatatttcttttggtcttttcctcatgattacaagatggctgccacagttccagccattgcatctttgtaccaggtagggattcctgtagcagtggccacatctgctcttattgtttactcaggaaagaaaatgttttccagaagtctacctggtaggctcctacatgtgagccaggacatagtctgatgaccaactttgcttcaagagaatagttgctttccagagaaaataagtacagtggtagcaaaagagaaggagaacgggaacagcatttgcattgtgaatccgcagtgtctaccatgccctctctacccctaatacattccattgaatattaaaatttagcaagattcttggccaactagaaattcaattaactagaatactgaaggctgtgggcattcaaacatacatacataattgtattttgtctgttaagacatttttacatctctgaaattgggagttatcttatgatcagtgacatgtcatcatttaattggtagcgtactttttccccctcagggtacataaaaatggagtatcttatagttgaaggcatcttagatttgatgaaatacagtagtattatggtatttttatatatatatatatatatatatatatatatatgtataccatagttaaccatacacaactatttgattttgttgttttgttgttgttttgagacacagtcttgctctgtcgcctaggctggagtgcagtggcaccatcatagctcactgcagcctcgaactcctgggctcaagcctcccaagtggctggaactccaggtacgtgccaacatgccctgctaattttataaactatctttttctggagacggagtcttgctgtgttgcccgggacgctctcaaactcagagctcaagcagtcctcctgcctcagcctcctgagtagctgggacaacaagcatgcaccaccacgcctggctaatacacagctatttctattgaacatcaaccacatatcaagtattttgtgttaacttaattcgacatcacacctatttatactattatatctgttttacatgtgaggaagatgaaactaagggaaataaacaaattgtccagaggcacctaccagctgctccattctgagtctcctttgcgaagttggtactcactgcctcctgggtgtgggattgagtcttgctcggttggtggctgggtccaggactgtagggggggcgaaacgtgtgctggggtgagcacaaggatgctgtcaactaggatcaggatggttgcagggaaccctccttcacccaggttagtagtcactcgtgtgaaaagttgtaaagctgttaattccaggactctaaattatgctgtgcgagctgtaaatccagcccataattagaacaaaatgtgagaaaagtgaaattgatattaagttaattaaaaggctttgcttatatttgcaaggaaattagcacaacaaaacaggaatgctgacaagtgcacgttgtcaatttcttcttcatttgggcgactgtcagcaagcctcaggcaagttttgttccttgacttctgccccgtgtccttcctatgattgcacatccattgtgtttgtatcatggtggctttaattgggcaagatctagtgtaatcttgggacagtcatttttgaatggatgctaagccttgcatgggagcttcaccttccagctgaggtcccaggccctgaaagtgtgtcgggggctggaggaggggccctcagaggttgtgtgtcattgcttaggcacacgcttctcggaagctgatacaaatggctgatgcagttctcttgcgtcgagaaggtaactcctttgattccagggcacccttctcattcctgttcaccatcctgatctgtgccacagacctaggtttgagtgtgcagtgtagaattttagtttggagttcctggaagggaaagaacatgtttttttcttatggtacctattatactagggtctggatgagacaggtcaatatcaagcggcatagaactaccgtggtctctagttagggtggcagaggcaatgctgtgttcaccagggaattttttttttcctcttgggcacagagctaatcttcaggctcccctgcagttagatagggccatgtgattgagttcagggcaatgagaggtagacggaagtgatgtttgctatgaccaggcttggcccaccaaaactcctacggggtccttcatgccttctctctcttttttttcgttttctttttcttttttttttttttgagatggagtcttgctgtgtcccaggctggagtgcagtggtgcgacctcggctcactgcaagctccgcctcccaggtgcatgccattctcctgcctcagcctcccgagcagctgggactacaggtgcctgccaccatgcccggctaattttttgtatttttagtagagacggggtttcaccatgttagccaggatggtctcgatctcctgacctcgtgatccgcccacctcggcctcccaaagtgctgggattacagccttctctctttacctttcaatgatggccttggagttcacctcttggtggcatataagatggtaggatcctagccaggcccggtagtgtgtgcctgtagtcccagctacgtgggaggttgaagtgggagcagtgtgccatgatcacaccactgcactccagcctggggaacacagtgagaccctgacttcaaaaaaaaaaaaaaaaaaaagaagcatcctggtccctgagtgactaagtggagcagagtactgtgctgtccagccatctcctgctatctcctgtgtgggaccattgtgttcagccattgagattttggagcttatctgttatagcagctagtgttatttatggactaattcagttaggtaactacctaagtgacaggccaggctgtctactctccttttctgcccttgattcatgtgatcagcaaatattgattgatcttaaacaataagtggggggatggtgagatggttggattggatgccacctatttctaggtcagcttctgtgcttgacctgctattggatttaagaaaatagccttggctgggcgtggtggctcacgcctgtagtcccagcactttgggaggccgaggcgggcagatcacgaggtcaggagatcgagaccatcctggctaacatggtgaaaccctgtctctactaaaaatacaaaaaattagtcaggcgtggtggcaggtgcctgtagtcccagctactcgggaggctgaggcaggagaatggcgtgaacccaggaggcagagcttgcagtgagccgagatcgcgccactcactccagcctgggcgacacagcaagactccatctcaaaaaaaagaaaagaaaaaaaaaaaaaagaaaatagccttgtttctcagtgttactagtactctatttacaggatgatggaatgattataatcatcccctacttaacgctgcttcttggagctgagggataagtattgaaatatggctaagttgtttgtaattataaacaactaaataatatatgcattgtctttgttacagtttctgctgaaaggaactggcatttttcaagatgagacaaactgaaaaggttagtttaagcattagcaattaaaaaaatcatgatttttgctgccaccgaattttaaatcatgcaaacatttatatttgtgccaaagttccacaatttcctttagagcaattactgaaatgcattcacaagataaaaatggagttcggggaagaatatttaagagctctttaatgatgttaaaaactttgctaatttgccgtgtcgttctaaaatccactttaattttttttttctgcgtgcctacccgtcttcctgcaattgaactgattccaggagacttgaataaaggggataaaatgactaataaaatacacaaatctcacgaaatatcttttcaagagctttttcttttttttcattagctgtaggtgaacactcgggaagataaaagcatccttgggctgcgtttacttgcagaaagcagtttggaaggaaaacaaaagccaaaaagtagttacaaatgggtggcttgaattaaacgctttttcttttacagtaaaagaaagggtcttgtatatgcagacccaaggggcggagtagactggtctaatgtcttcatcctcatcctctttacaagatctcagcttagcaaaactgcagttagtcactgatctgtagtccctctcccctagttagcatcattgcttggtgctccagccctttcttcagggccttctgaaaatccgcagccccgggggatcctgatccacttttcttcttccccatgagataggctctaatgttaatggttcacattttctttcttttttttttctgagatagagtttcgctcttgttgcccaggctggggtgcagtggtgcaatctctgctcagggcaacctctgcctcccaggttcaagtgattctcctgcctcagcctcctgagtagctaggattacaggtgcctgccaccatgcccagctaatttttgtatttttagtagagacggggtctcaccatgttggtcaggctggtctcgaactcctgacctcaggtgatccacctgcctcagcctcccaaagtgctaggattacaggtgtgagccacgccccagttcacgttttcattagagagtaagttcacaggtatttctcagggataattctgttggaaagctaaccttccatagagaaagtttgacagcattgacttccagacgagccagagatacagccctggccctgccagcaaccttcctagtcagctgatctccaggggtttcagacaatggacgaagcaagggctttggagttagacagaaggaatctcaaacttcctttggctactttacaaagccaagccaaagctggggctttggaaaaaatcacctaacatcaatgagcctcagtttactcatctggaaaacagtagctactcctataaatatgataaggacggtgtaaggtgatatttgtagcatacctggaagaacgcctgtaataggagaatgttgatgaatgatgttattgacatcgccgtggtggcagttactaccaatactgctctttggaacaagacatttggcctttccgggcctcagttttctgccctgtaaaatctagacaagataggaagggtgttcaggttctgtaattttatggatcagaaaggtagagtcgatgatggaaagtctgttttcatgtaaacagtggctggtgaggactggtcagagttgcattttgggaagccatgaaaaattcaatctagaggaataggaaacaattgtcctaggtgtggtggtttaaaaatgtatctacaggccaggagtcgtaatccctggcacggtaattccagcactgtgggaggccgaggccggtggatcatttgaggtcaggagtttgagaccagcctggccaacatggtgaaacccagtctctactaaaaatacaaaaattagccagtcgtggtggcgggcgcctgtagtcccagctactcaggaggctgaggcaggagaacccaggaggcggaacttgcagtaaaccaagatggtgccactgcattccagcctgggtgacaaagggagactctgtctcaaaaaataatagtaataaaataaaataaaaataaaaaataaaaaaataaaaatgtatctgcaaatttgacactttccccatcaaacggtagagtttaattcccctcttgttgatgatgcgctggcctccgtgacttgcttctagtgatcgaattcagtggaaataatgttccatgacttcagaggctggatcaaaaagggtgagggagcctctgcctgagggtgctcttcagggacatggatctttgaagccgtgtgccaccataccggcttcgctgaagcccccatactggagggaccatgtggagagagagagagaaagagagagagatgcccagggacccctggctgttccggcttccagctgtttgtgtctgttcagcgcaggagccagacacatgagtgagcaagcctcactccatctttccagcctccccagctgataccaagttgggcagagacgggctgttcccaccccaagcctcgctcaaatcgcagatccatgaggaaaataagtacagtcattgttttaagccactttttgggtggtttgttgtacagcaataaccagttggaacatgaggtcagtatccttgtgcttgataagctgtttttgatgatgatagtcatgctaaccgtaataaatgtaacaatagccaacatttatttatttatttatgtatttttggagacggagtctcactctgtcgcccaggctggagtgcggtggcacgatctcggctcactgcaagctccgcctccctggttcacgccattctcctgcctcagcctcctgagtagctgggactacaggcgcccgccaccatgcccggctaattttttgtatttttagtagagatggggtttcactgtcttagccaggatggtctcaatctcctgacctcatgatccacccgccttggcctcccaaagtgctgggattacaggcgtgagccaccgcgcccggccacaatagctaacatttattaagctctttcttaaagtatccagcaccgtaatgaagattttatatataaaagtgggtaatgaattttttcgggaaagtcttggatttatatgccatgggtagactgtgataacagcctgactattgcagtgggggttaggttggctaagaatttcagttgtctttcattcaagtttctgacagttgtcctaaaccaccgagcgttgagtttatttggaaatgcaagagtggctgttgtgtaatggctccctccccgtggacgacggttatctgacattgctcatcatacccagtctctgaaccctagcaccacagttccttatattgtgctgttccaggtcttttagcagcagagacaagaacacatttaatagagcctgttcttatttttcttttggagacagggtctcactccgttgcccaggctggagtgcagtggcatgatctcggctcactgcacccccaacctcccgggctcaagcaattcttgtgccttagccgccacagtagctgggaccacggatgtgcaccaccatgcctggctaatttttgtatttttattagagagagggtttcgccatgttgcccgggctggtctccaactcctgggctcaagcagttagcccgcctcagcctcccaaagtgctggattacaggtgtgagccactgcgcccagcttcttctttttttaaaattcttttttcttctatttatttatttttttccttttttgttgcctactattgctacctctgaagacagcctgtttccataagagactactgattttctactttttgtagaacctggagaatttggtgtttctataaataacacatcctggaaacctatagagtacatcattctctggagatttaaataagtactgcagacttcttttattctaattaagtagagtaggaagtaggtggcttgtctgaattatggccttataacagaggacacaattcaatattcctcacttttcctggagtgagaacttttaaaaatttcattcttggctgggctcagtggctcatgcctgtaatcccagcactttgggaggctgaggcaggcagatcacctgaagttgggagttcaagaccagcttgtccaacatggagaaaccctgtgtctactaaaaatacaaaattagccaggcgtggtggtgtatgcctgtaatcccagctactggggaggctgaggcagcagaatcccttgaacctgggaggcagaggttgcggtgagctgagatcgtgccattgcactccagcctgggcaccgagagtgaaactccgtctcaaaaaaaaaaaaaaattcattcttaacttggacacacatcgtgcctgtagcttgaacacctaccaaagataagggcatagagcaggctagggcttcccatgcctgatggagctacatatttacttggggaactttggaaaaagtactaatttccagattcctcaagctggaggttcacattttgtagatatgaggtgggatgtgacttgggaatatacacatttttcttttcaaaagctgaatgggtgagtctaatgagccattgagatggttgatgccctgccctgcctttcctttcccttccttcaagcaatacatctgtaaaaatgttgagttgtcataaggctgttgtgacaattaaattcatttattcacatgagatgtccttccttccttccttccttccttccttccttccttcctccattctttgccttccttcccttcccctccctgcctcccttccttcttccctccctccctcccttccttcctctctgtctctctgtctctctctctctcttttccttcttttctttcctcttgctctgttgcccaggctcactgcccaggagtgcagtggtgcaatcatagctcactgcagactccaatccctgggctcaagtgatcctcctgcctcagcctcccaaagcgctgggattacaggtgtaaaccactgttcccagactccttttcattttcttaatgatatattttcattttaattttcttaatatattttatttatgtatttattttgtttatttatttatttatagagatgaggtcttgttctgttgcccaggctggagtgccctggcacagtcatagctcagtgtagctttggactcttaggctcaagtgatcctcccacctcagcctcccaaatagctgggactacaggtgtgagccactgtgcatggttcaacacccttgttttgaagtacttttctagtcattttctcatgacaaaagctttaaagtcttcatatctgtgaaccatttcttggagatcttggcagatatcacccctagttcccatatctgcatctgtaaaaatgttgagttgtcataaggctgttgtgacgattaaattagtttattcaatgagatgtctgataaattcctggcctctagtagatttctttaaaaactttaaaaaaattgaggtaatgcattggctgggcgcggtggctcatgcctgtaatcccagcacttcgggaggctgaggcgggtggatcacctgaggtcgggagttcgagaccagcctggccaacatggtgaaaccctgtctcttcagagaatacaaaaattagcagggcatggtggcacgtccctataatcccagctactcaagagactgaggcaagagaattgcttgaactggggaggcagaggttgcagcgagccgagattgcgccactgctttccggcctgggtgacggagtgagactccatctcagaaagaaaaaaatattgaggtaatgaatacatatataatttactgtctttaccattttaagtgtacagctcggtagtaacaaatacatttatattctttttttctccaccattcctccctccctttttcccttcctggcacctggtaatcactagtctactctctgtcttcatgaggttcacgtttttaactcccaaatatgagtgagaccaggcagtatttgcctttttgtgcttggttgatttcacttaaaataatgtatgtcagttccatccgtgttgctgcaaatgacacgatttcatcatttttcagggctgaataatattccactgtatgtatatgacatattttcattatccattcatccattaatgagtacttaggttgattccataccttggcaattgtgaatagtgctgcaataaacaagggagtgcaaatatctctttgatatattgattccccctttttttttttggatccatactcagtggaattgctatatcctatggtagttagttctatttttatttttccgagggacctccatatggttctccatagtggctgggctcatttctcaatcaatgggtgctgctgtgttctgtggtttcgtggccaaggtagttggcactccctttgggggttgactgccttctttgagattgtagtgtcactggctgtgccgcctgccccaagccttcatctttctccatctgagatgtttcttttctttcttttttttttgttttttgagatagtgtctcaatttgttgcccaggctggagtgcagtggcgtgatcttggctcactgcatcctcctcctcctggattcaagtgattctcctgtctcagcttcccgagtagctgggattacaggtgcctgccaccacgcctggctaatttttctgtttttatttatttatttttttgtttgagatggaatctcgctctgttgcccaggctggagtgcagtggcacaatcttggctaactgcaagctccacctcccgggttcacaccattctcctacctcagactcccgagtagctccgactacaggcgcctgccaccacacctggctaatttttgtatttttagtagagatggggtttcaccgtgttagccaggatggtctcaatctcctgacctcgtggtccacccacctcggcctcccaaagtgctgggattacaggcgtgagccaccacgcccggcaatttttgtatttttagtagagacgtgaaatgtttctttggtaaactggattctagatgaatatgtttcattctgtttgctggtagtacaatttttatatttcttaaagtgtaaaatctgctcctcgtctggtgtttcctatatcagcttattataatattgatctcatgcttttacaagctaataccctctgtcttttttctcacatccaatagctgtccgtagctgactcccataaacccccatctcctacagaagtttcttctgtcccttctaagcatagcccctcatgtctggcctagcactttggaatagactctgaaattatttccatctcatctcttacaatacttgtcattttttaactcaaatgtgccttttcttaggaaagtgatgtgtcgtttcgcagttcctaaaaacgttgagaggttccttggacattgtatcctagacttggagaaggcaaagttgtggtatgataagccgaagctttctatattttatgaattttgccagatcttttcttttcccaaatcttgcccacatctgtctaccttcctttttttctagcattttaagtctttacaaaacattcaacttggtttttactgaaacattagtaactggctttcttttctcactcacaatgtcatcaatttatgtaatttaatataattatgcaattatataacaagcacagctggcatgaagaggtttgggaacaaaacaataactgttgacaggtatacaattcaactggcgggagcagaaacgggcagacctactagataaagggtgcttaccacttgtgagcccccaacatgcctggggcatctgctgtcactgtgtgttacagagatggagactgtcagtcgctggtgtcagttaagagagcctctgttttattattattttgggttttttttgagatggagtctcactctgtcacccagtctggggtgcagtggtgcgatcttggctcactgcaacctccactttctgggttcaagcaattcttctgcctcagcctcctgagtagctgggattacaggtgtgcaccaccactcagatctaatttttaaaatatttttagtagagatgggtcttcatcatgttggccaggctgatctcgaactcctgacctcaggtgatctgcccaccttggcctcccaaagtgttgtgattacaggtgtgagccaccgtacccaaccacctctgttgtatgtaattagcatgttaattgtgataaattggggaaacagggaaaaatggaaatgagaaaataaatttatcgtaattctaaagcatgaggataacattttgcttctttttatcctgtcaacatttttatatctttaagatcatactcatgtataaacacttgtgtcctatatgttcccttaacattttaataggaacattttcccatattattaaacaccttataaacaattttagttgttgtatattcattcagtgattcgttgagttccttcaatgattttgccataagtcacattctcatgttgctataggcagatacatagtaggctgctttcaaatttttattataaacaatggtgtgatgaacattttttttttgagactgagtttcgctcttgttgcctaggctggagtgcaatggcacgatctcagctcacagcaaactctgcctcctgggttcaagagattgtcctgcctcagcctcccaagtagctgggattacaggtgcctgctaccatgcctggctaatttttgtatttttagtagtgacggggtttttccatgttggtcaggctggtctcaaactcccaacctcaggtgatctgcctgcctcggccccccaaagtgttgggattacaggcgtgagccaccgcgcacggccacgaacatctttatatatcagacaaaaatagtcctatgtggaacttttaggccaaaaggtacggccttttcaaggactttttattttgttgttttttacagataagtctcactccgttgcccaggctgtgatgcagtggtgtgatgactcgtagctcattgtaaccttgaactcaagcggcccttctgcctcagcttcctgagtagctgggactacaggtgcatgccactatgcctggctaattaaaacaattttttttttccgtagagatagggtcttgctatgttgcccaggttgttctcgaactcctgggctcaagtgctccccaagcattgggattacaggtgtgagccactacacttggccttaaaggacttttgatatattttgtcaaactgctttccattaagtttatactttcaccagcaatgtataaaatctttgtgtcaccttatcctctcccacagtgaatagatattataatttaaaaaccttgttaatttgatagattacaatcacaccctgttttagtttttattttcttgattggtaatgagatcgaatatttttccaaatatcatttatttgcatttgcatttttgtaaaatttgaggtcctgtttatctgttaaaaaccatttatcagttgattaattcaattgttgatttgcatacatttttaatgtcgcgaaggaattatctttgtctttaatatttattacgaatatgctttccacagactcatttcttacctttcagtgttgatcaattttttggatgggatgggcagggcaggttttacatttttttatggagtatttaaacttacaaagttttctgtcattcagtgtctgaaaaaatattcagatttttttctggttttatttaaaaattaatttcaatttttttgcatgtaactttttttatacttgggaattgagtttctaacttgatcatttccacttgctttagatagttcaccaccattggttggataatgctgcctttccacctgatttgtaatcgtcttttattgggccctcaactgttacatgcacaaagaaggataattcttctgaggtgtctattctgtttcaacgttgtatctgtaccgaatcattgccgctttatgttaattataagatgatattggtccccccatttatcgtcttcccttctcttcccctcccctccccttttctttttctgtcttcccttctgcccttcctcttctttccttcttcccttcttcctccttccttccttctttctctttccctccctccctcccttcctccctttccttccttccttccttccttctttccttcctccctccctcccttccttcctccctccctccctcccttccttccttccttccttccttccttccttccttccttccttcctgttgctatgcctctttttggtcacaccttccatttattggaattcttactttcgttattctttcaaagatcagtaacattcctaaaggaaaggtaaataaataatgtattttcagagatcttgttttatatttttcctttgcctttatatatttggctaactatggaaggcctttgttagaatctttcccctgaatgctatgggcatttgatattgctgtgtatgaattgagttcatccatccatccatccatccatccatccattcatccatccatccagaatgagctacacaatatgtcgggtccaaagaaaaatgagaatgtgagctccttgctcaacaattattaataatttcaatatgataaacgaggttcattaaactaaaggcaggactcttctgaatatagggctccatgtgactgcatgaagtcacccgtgaagtcagccttgcatccatccatccattcatccatggatacccatcctgtggatgcttactgaacacccagtatgtgttgtgtgctttgagggaaagaaacctcagtctagtggaggacacagttagtgatgatgcaagtgtgcacaggatgcacagaggagagagaactccaccagacccagctgccagagacagctttctggaggaggtgatatttacactgatgtgtccaaagcttttgctctgattgatgtggagaggcttaggagggttttgaactcaaaaggagtgacatgctccaattcaagtgctttgtaaggatgactctactgcatggaagacgcactgtggaggacaagtgtagaagcagttaggaagctattgcaatgatccaggcaagggaagatggaaatggcaacttggatatgtttggaggtagtgagaagtggtcagatcctgaatatattttgaagaaagcactgttaagatgtgttgatgaaatggatatgaggtataagagaaagagagtagttaagaatgacttccagattttccaatctgatcaattagaaaaatgatgccattcactgagacagggaagacttgcaggggaacagtttgggagagatgaaacattcaattttggatgcactgtttctgatgcttattaaacaaccaagtggagatgttgtccagagagttggatgtactattctagatctaggtttggtttacatgggggaagagtagggagggaagaggctttgcctatgaggttgctacagaagagtagagaggaaagacctttttgataaaatgttcttggtgactgattggatgtgaagaataaggaagcagattcagaaaatgaaactgaccagtctttaaggccccttttccctaatcacgagccaaacagggggattggattttggagtcatagttacttcttttggaaagagcttgtcttggaaccgtttcttctagtttagattcctgtggcagatggtgaaagtaatttcttgatatttgtttgcgatgaagagagaatgtgctgtcaccgaaatgttgaattattaatgattgaggaggaaatgacttctttcagaaacaccaattctgaaggcctcttagatagaggccagatagtaaattacctctttcagtgacagaactaaagagttgatgcagatcgaaaagggatgtagtgattgccatctgtgggtccggaatcaatgtaatatttatgggattcagcacattttagaatctcatctttgctcatagtatccattactgctattaccttttagtagctgttttacaagaatcagaaagtactgtagagactgtctgccatttatggaagaaggctgggtactctagaaccaatggatttagagtggaaacagagcatttctgttatcgaggaaagagctaaacgggtcccaggtcactctgatccaaccttgggagacagtgctgcctgtgtctggctatcttgtcctaggagtgttggtgaattatgcatggaaaaagtcatgtagttgtctggattagtcaattttcacactgctataaagatactacccgagactgcattatttataaagaaaggaggtttaattgactcacagttctgcatggctgggaggcctcaggaaacttacattcatggtggaagctgaaggggaagcaaggcacgtcttacatggaagcaggagacagagagaagcagggaagtgcctgacatttatcagacaaccagatcttgtgagaactcactcactatcatgagaacagcaagggagaagtccacccccatgatcgaatcacctcccactaggatcctccctcgactcgtggggatcacaatttgagatgagatttgggtggggacacagagccaaactatatcattgtcccctttcaaaattaagagaaatttttgcagagaagggaaatagtgaggaagtgcacttaagtgggacttgcaacatgtggttctgtcttcaacacgaaattcaataagggggaagcgaccacagaaccaacacattttcaaacagtgtggtaacctggtgagtgtgtgtgtgtgcatgtgacaaggtacttattttatcctgctgtcagtcattcattcacttttaaagatgaggttatctaaagacgattgctgagctctgaaatgaattaaaacccgtcttatttccagccagtgatttaaatattgtatagctcatttataattgaataaaattgtggtggctctttgtggatttttgaagtcatcttctctaagaagcctgttttgttttctctttttgaaataaacatgaatttgcataagaagcaaggagtctctgaaagaaatcaataaaattaactggaatttgatttcacattttgaatgcattacatctttctattaggggagatataagagaagctgaggctcataaaaaagtgacctacttgaagaagatgaatatttaaaataagagctttaaaaataatttgcttcgcattggtggaccatagctcaaaataacagaaagcctaacagaaagacaggtttttcagggattgggaagggcagctggcactgtcttgagggcaatacttgaagtacccagggtggtttggagtctgaaaatccgagttcaagttctggcactgctacttagtttatttgagatatgtattagtctgttttcacactgccgataaagtcatacctgggactgggtaatttacaaaagaaagaagtttaatggactcatagttccacgtggctagggaggcctcacaaacatggcagaaggtgaaaggcacgtttcacatggcgacagacaagagaagagagagaagagagtttgtgcagggagactcccctttataaaatcaccagatcttgtgagatttactcactgtcacgacaatagcaccggaaagatctgcccccatgattcagttatctcccaccgggtccctcatgggacacatgggaattatggaagctacaattcaagatgagttttgggtggggacacagccaaaccatgtcaagatacatgttttcgttttgacccttaaaacgattttcctttgtattgcaaatgaaatttgctttacttgacgttaatgttgaaattaaacctgtttaatttctataggtgcagaattgaaccgagactttaggagttcaggtcaagctagttccttaggtttgaagggctgagtaggtggagtatgtgactatgtaaataaacctccctgactgggtgaggcagcgccctctctggagtcagtgtgcaaggatgttagtgaaagctgctcttttttttttcctccttaaactctcttcacctcttgtttgcaagggccctctgtaaatgggtcatgtaccacgcaatgcataagtattcagaaaggtgcttcctgcatgtccttctgaagagctgtgctttgcagagtttttgtgacttcatcgttcaaatgcaatgtgcacatctgttgatttttctttgcaaatggacgttggcgctcaatgtagagcagccttgtagcgctaaaggaaagttctctgttcagctaaatactgcgtgtgcttgggcaagtagttctgaatttcctcatgaataacatggagaaaatgcctatcagatttgttcagaaatccacctctctttattatttacttgggctttaagttttattttaaaagagttttattgaggtataattgacatactaaaaactgcacgtttaaagggtacaatttgataagctttgacatatgcatgcaccagtgaaatcatccgcatgatcaagatagtgacgcatccatcacccccaaaagactgtgcctcgactcatccgtcgtgtcttcctgtccctgccatccctctttactgaggcaaccactgatctgcctcctgcctctacagataagtttgcctctttctagagtttaacatacatggaataatatagcacatattcttttttgtctgacttctttcactctgcataattgcagtgtatccatcgtttatttacttttattactaactatattccattatatggctataccacagtttgtttacccattctcttgttgagggccatgtgtattgtctccagattgtagctatttccagtgaaactgtcatgtactaaataatctttgcatagatatatgctttttttttcccctaggtaaacacctagatacctaggagtggaatggctagatcttttagtaagtgtgtatttaactgttttttttaaaagacaaagttttgttatgtcactcaggctggagtacagtggcgtgaccatagctcactgcagctcaagtgatccttccacctcagcctccccagtagctgggactacagttacacacaaccatgcctggctaagtacttttttttttttttttttttttggagagacagggtctctctgtgttgcccaggctgttctcaaactcctggcctcaagtgattacctctccttggcttcccaaagtgctgggattacagacatgaaccactgtgcctggccttttcttacttttgaagaactgttttttccgttttatattcccaccagccatataggcaagttccagttcctccgaatccttgtctagacttttacattttagcattttaatgtgtgtagtgatagcactttgttcaaatttcatgtcccaggtgactaatgatgttgatcgtatttttatgtgtttatttgtcatttgtatagcttcttcaggaaatttccgttcaaatcattgcccattttctttttctagtttttctttttttgttactgagttttgagagttctttatgtattctaggaggaagtaccttatcagatagatgactcacaaatattttctcctaatgtgtgccttgtcttcttattctcttaatagtgcccttcagagagctcaagtgttaaatttttctattcattcttttatggatcatacttttggtatcatatctaaaaatctgtctaaaacgccttgtcatggaggtgttattttatgttttgttttattattttttttgagatggagtctcactcactgtgtcgctcaggctggagtgccgtggcgtgatcttggctcactgcaacctccacctcctgggttcaagcgattcttgtgcctcagcctccaaggaagttgggattacaggcgtgcgccacgatgctcagctaatttttgtttttccgtgttggccaggctggtcttgagctactgacctcaggggattcaccctttccggcctcctaaagtgatgggatttcaggcgtgagtcacctcacccggcttccttttataagtgttatagttttaggttttacatttataactgtgatctattttcgtatatgatgcaagctatggctcgaaatgtatttttaagtttttacatatagatatccagttgttccagcacaaatttcttgtgcctttgtcaaaaatttattgtccatgtatgtctaggtagggttttggactctgtattctgtccattgctgtgtttgtctgtatttgcagtgataccacactgccttgattagttttataagaagtcttgtaatcaggtaatgctggtcctccaactttgtattttaacattttctatatttgggccgggcgcggtggctcatgcctgtaatcccaccactttgggaggccgagatgggtggatcacgaggtcaggatttcaagaccaggctggccaacatggtgaagccccgtctctactaaaaatacaaaaattagctgggtgtggtggcgggcggctgtaaccccagctactcaggaggctgaggcaggagaatcttttgaaccccggaggcggatgttgcagtgaaccgagatcgcaccattgcactccagcctgggcaacagggtgagactctatatcaaaaaaaaaagaaaattctatatttaaggtgtaccgtaacatgacgtttttatatactcatatatagtgaattaaatatttaatactatagtcaagcaaattaacacatccatcagctcacatagttacgtgtatgtgtgtgtgtgtgtgtgtgtgtgtgtgtggtaagagcacctaaaatctactctcttagcaagtttcaaatatacagtattaataacttttttaaaaagttgttttgattgctttaggtcctttgcatttctgtgtgaattttgggaccagttaatttctgcaggtggggataaactctacctgtccatcttttaaatgtattgttgaatttgattgctgacattttgtttagaatgactgtgtctgtgtgtcctctggctggtagcgacagaggctgtccctggccctgtgagagtccaggcactgtcacctctaatcctttggggtgggtcctttctcccagcctggggtcttgtttttcgttctgatgatgtgatcagtatccagctcactgactgaatgggaaccactacagatctctggagttctccctctgtgcagctttctcctccaaactccttagtcctacagattctattaggttgttgcaaaagtaattacgatttttgcacccacctaatagctgcctcgatctccttgcaatcctcatctctatctgctcagctcagggagtccgccagcatcccccctaggctctcttttcctaccgtgcatcctgggaaccctctcaaggtagtggcctcacatcatttctttctgtctcttggggataactgtgctttgtggcctaatagccagtgtcttcagaagtgttcttttgagtattttgtctgttacttcagtggtttcagcgggaaaagccagtgtggtctctgtttctccgtcttggttcgatgtggaagtcactgaattgaatttttacataatgggtttttatatagtttgctgcactatatttatttatttgagacagggtctcacactgttgctcaggctagagtacagtggcgtgatcatggctcactgcagccttgacatcttgggctcaagtgatcctcccacctcagcctccagagtagctggaactacaggtgcatgccatcacgcctggctaattttgctattatttgtagagacggggtttcaccatgttgtccaggctggtctcaaactcctgggctcaagtgataagcccaccttggccttctgaagtgctgagattacaggcatgagccattgcccccagccttggtgtacttttagattggattgttgccctacactttttgtatgtgagtgcaagttgtgtcctaccagagtccctttcttagtattaaattgataacactttatcttaccttcatcatttttttttttttagatggggtcttgctatgctgtcaaggctggtctcaaactcctgggatcaagtgatcctttcacctcatcctccacatagctgggactacagatgccagccactgtgtctggatctattgtttgtctctgtcatttgactgtcttgtccttgaggattgtggctgagtcttatttacatcttgccttgatagtgaatgttgtgtaatgaatgaatgaatgaaagtgaatgaatattttcacttccataagaatatccaggatgctgtttttttcctcccccttcaaagatgtagatcgagaagggatatgttcagtttaaaagttgaagctttattttttattatttatttatttatttatttatttgagacagagtctcactctgtcacccaggctgtagagcagtggtgccatctcggctcaccgcaacctctgcctcccgggttcgagcgattctcctgcttcagcttcctgagtagctgtgattacaggcacatgcgatcacccctggctaatttttgtatttttagtagagacggggtttcactatgttggctaggctggttttgaactcctgacctcaggagatcctcccacctcggcctcccaaagtgctgggattacaggcatgagtcactgcacctggcctgaagctttatttaaaaagtagcttattttgaattttgagtgtgtgtgtacatgtgtgtttgtcctgataagggatgcttgatattttaacactggcaaagggatggctgattgggagttaaattgccccccaaataattcaaggtgtattatacatttctcccaaggagatacagatctggggtcatatgatttcgaactttgctttttaatgaaagttgattaaacaaatgccattttactttatagctattttaaataacctgtgctgtttagttcttttttttccctgtttttcatctttattgctaggtaggtcagaggcagaatttcccaaacatgtgattagtaggacacctctctgggaatttttttttcccttaaggtgacttaaaatgagtttgaggaagaaacaggacaagggtaaaaatttaaaagaagccgtatatctctgaataattcttttagaaagataatttaagtctcgttagaaatctttgatttccaattactcaaaagtggatgtgctcaatatcagtgttgttcagttttctgtgctttgtgaagttagctattatagaatgtaaaacgtaaaatgcttgggcatgttggcccacacctgtaatcccagtgctctgggaggccaaggcgagggaattgcttgaggccaggagttcaagaccagcctgagcaacatagtgagacactcccccataaaaaaattaaaaataaaaattagccaggagtagctgttactggggacgatgaggcgggaagatggcttgagcctggcagttcagtgttgcagtcagctatgattgcaccactgcactctagcctgggcaacagagcaagaccctgtctccaaaaaccaaaacaaaacaaaagaagaatatgaaacgtaaaacaaatgtagacaaatgtgtatcccaccgtaatggaatttgttgtgtagtgccaaaggatttttatattctgaagtttctgtgctatttacttttgctttatttacagaagattctgggatgttgccaaggataactaggaattgcttgtaactatattggaaatacacacgatgaggttgaatgtggaaatgcagctgcatgtgttgtaaatcagtcctagagctgctgctgggcttggtgatagcttttctttaactaacttcggtgatcacatttgtaaagagatgggcaatatcatgaagaatggagggttacaaatttctgaacaacttgagtgaaagtttctagagtgttttccttgactatttttgactttccgtcgtttgagatttactttccagaaaggatgcaccctcccacccccagcccacctatccaatcttcaggattaattcttttcagctcttgggttacctgggggtggtaatgtgagagggattttatggaagggaattaaggaataggtggaagaaaaccacataggacagatgggaaacagaatatatgaagaatatgagaggagggcgaagaagtgagaaggagaagttaaggtgtgtgtgttcatcataactatggatgaggctgggtgcagtggctcacgcttgtaatcccagcactttgagaggccaaggtgggaggattgcttgagctcaggagttggagactagctggggcaacatagtgagaccccatctctacaaaaaatgaaccaggcatggtatgtgcacctgcggacccagctactcaggagactgagacaggaggattgcttgagcccagaagttcaaggctgcagtgagttatgatctcaccaccactgtattgcagcccgggtgacagacactctgtcttaaaaaaaaaaagaaaaaaaaaaaagaactatggatgaagctagctagacttaggaacagactctaagaaccctgaaataaaccttttctgtctctaatgtgatctgtgatgtttggttatccccagagcaatggatagaggccatcacaactgctcagtccagaagacaccgtaaggaccactcctgtggagtgggagctaccagggcaagagtttatcaccaacagtgccttggacctaatagtaacttcataaatgtttactggatagatataagtcccctagccttggaattgctctgaaacccaggatttcttaataaatgaagtaatctgataactgagataagcagttttgggtggctttgaaatgtcctcatactcctgtttgctttgaaatgggacttttgaaatgaggtgttgttctgtcccaaaggagagaagagagactgtggaagaactgatgacaggaacagcaaaactgagagaaggaaaatggggccaggagaggagcagatgctagaatggggtttgggttttcttggcactccaaagctcctgtatatttattgctatcctgattatgattgctcggttttaagaaggtagaagtcttttctggctgtaagcctacctgtctcaacacaatgtagctgctggacgctggccctggacactgacatgcctgttccaggagaacctggaggggtgttatatattgatttggttgtttctttgagtctcagatgcggaagtgcactggggaccctcagggaccgtcagggtttggcagaatggttctacatgtgcaccctggtatctccagccatgtcagtgtgaatgaagacagagattttgtactcttggggtcatagcgtgactggaggctgcatctcttgggctgtgcatattgtgataaggtgatgggtattgttgcttactgggaggagaaagtattagtttacttatgacttttaatattagtttagtggtgatttctaatattactgtctttcttattaaaagcaagccactcaatggtcgggtgtggttcatgtctgtattcccagcactttgggaggctgaggcaggcagatcatttgaagtcaggaattcgagaccagcctggccaacatggcaaaaacccatctctactaaaaatacaaaaattagctgggcatggcggtgcacacttgtaatcccagctactcaggaggctgaggcaggaggatcgcttgaacctgggaggcggaggttgcagtgagctgagattgtgccactgcactccagcttgtgcgatagggcgagactctgtctcaaaaataaataaataaataaataataaatagaagtaagccactcaagctcagggtattttttttccctattttgttcacattatgtccttaatatcagagcagtacttggcacagagtaagcattcaataaatgcagttgaatgcatgagtctgttgaatatatgagtgcactgaatgggaggtcaggagagaaaactgggaagaggaggactaaatacacttgtgtctgaaccaacttcttctgtttccactgttttcttggaggcgactcaagagattcttcagttccctggcacagtgccaggcatggagttgacaaggacgggtaaagcccttgaggggctcatagacaggagagggtttgggatacgtaacccatagcctctcagagtgctactgtgggctctgctccaggtgcccggggagtcctggcagatctccagggtcagggaggcctcagaggaagggacatctgagctgagtgttgataccttcataggttagcggagaaagaagccggggggagttcctctaagcagaggccatgaccgcacattggcactggggtgtgagatgtcaggggtctgcacatggttaggccggcctggggctctggggacctgtggggaaggtggttctgacagcagaagccaaatgaagaagaggctggtgtgtgtctcacgtgtccgtgtgaagagaccactaaacaggctttgtgtgagcaacatggctgtttatttcatctgggtgcaggccggctgagtcccaaaagagagtcagcaaagcgtggtgggttatcattaattcttataggtttcgggatgggcggtggagttaggagcaatgttttgcgggcaggggatggatctcacaaagtacattctcaagggtggggagaattacaaagaaccttcttaagggtgggggagattacaaagtgcattgatcagttagggtggggcagaaacaaatcacaatggtggaatgtcatcagttaaggctattttcacttttgtggatcttcagttgcttcaggcgatctggatgtagacgtgtaggtcacaggggatatgatggcttagcgtgggctcagaggcctgacattgtgtcttgcttaggaatttgggtttctgtctttggggagcgatggaaggtttatttccacttttgaaaactttttaaatgaaaaatttcaaacatgcatacaagtaggaaggaccatattgatatcaatgagctcaacccctagattctacaattaatgttttgccatgtttgcttatccttctttctattctatctatatctatctatctatccatcagtctgtctgtccgtccattcatccatccatcagtctatctgtccatccattcttctttctttcttcctttcttcctttccatctatccatccgtctatctatccctccatccatccatccctccatcactgtctgtccacacttccatccatctgtccatccatcagtctatctgtctatccattcatctatctattatctatctgtctcaattatctatcatctgtccctatcatttatctatttgtctgtctttgtcatctacctatatctatttatttctatcatctgtcaatctgttatctattctctatctgtatcatctatctatcttatctatctatcatctatctgtctgtctatcaaatatcttatctactatctgtaagagtttatgcaggggagtgacttgtgtcttagagggtccctctgggaggaacatggaggatgaaataaagaaggaagggaatggagtttgggaagactcactgagagtctcttgaaattgttgggatgagaggcggtggtggcctgaactaaaatttggcaactgggctggagaatggagggctcagagatatttgtgggggtattctagtgattatgtctctgtaacagattgtccaaaaacttaataacttaaaataatgacaacaggctaggcatggtggtgcacgcctgtagtcccagctactcagaaggctaaggcaggaggaatgcttgagtccaggggttcaaggctgcaatgagccatgtttgtgccactaccctccagcctggacaacagagtgagacactatctcaaaaaaagagacaatgtttatttttcttacaaatcttcaatttggacagagcttggcaagatgactctgtttctggtctactggatatcacttgtaatggctcaaatgtggaggtctgtagtcatttgaagcctgtcactcccatctggctggttaatgctggctttcagcaaggatcttatttggagcacctacgtgtggcctcgacatgtggcctgggatccttcacaacatggtgtctggattatgagggcgagtggggaggaggagagagagaatgagaacaccaagcagaacaatactgaattttaggatgtagcctctgaagtccccatataccgccgctgtcgccccgttctgttcatcaagccaggcacaagttcaggaggaggaaagattatctcctcctcttgacggggtgtggcaagatctcaaaatattgctgtggccatttttggaaaaccctgcccgtccaggggctaaagtggcaggatttaattgttggatgtgagcaatgagaaagagcaaaaaatctgacctgacactcagtttggattcgtgtctccatggcggggaggcattcacagagagggcagtgtgagtggcaggacaggaaaagggaatgaggaggatggagttagatttggggtcccattgatttgttgggaaatactgcatcaggatgggttcatgaactacaaacccacagaggtagcttcttcttggaacagacaaccatgtttcctagtttttggacaactttgagccgaatagggtttgctagcctccctgggtccctataggaggctgttgtgtactctgaacctgagtggaggtggcaggtgtttgatgtgtccccaagcctgctggggataatgtggccttcagtatttgcttccctccgtggagctggagcagctagggaggatgcaacattcgttgatttcatctagcaggcatttatttgagcacttacggtatgctggaacctaaaagaatttgaatgtgcattaaatgccatgcctgccctaaagagctttgtctctagaagcggagaggatgcttgaggttgcatgctcatgctaagctgtgaatgtagttactaaaaggacagagcttcgagcaggggcagatgtaatatgcacttgctgggctttttccttgcctctgggttctccatggagtgcgctgttgctggtgtctcttctggagcatgtaggggcctgtcggagagcggggccaagctactgtcctcatatgttcgaggacatttacagacactgatctctcttggtatccaaatcaaactcagcattaacaggctagtttccctccctaacctccccttccaccttggggaataggacagagccatatgtccttgatcaatatctctgtctccagtcactcagggtcttagaaagcctgctccccgggaaccccatcccactctatccctcactcttcgcttcccatgtctggactctgatttagtaccattttccctgggtggtcctgatactcagtttatttgaaaaccatggctgaaaatctgattccttgtagcttgtactcaaacaacaattcaagttagaaagcattgaaataccgagacagtttcagagaggctcaaggaagcccttctgcctggggagaagggggaaagtatcagggcattagagctgcactctgaatgttaggtagagttggacatacagagatgatggagatgatggaaaagacgttccagttagagggccagcatggaaaaaaagcaagggacatgacagagttgtttttttaaaattaattttaccaacgagttgctcatatgagcatgcatatagcttgtgtcacgttatttacttttatgtcttaaaattattttgttatttcagcctgcatatatgaagacatttacttttatcaagaaactggagtatagctatccaaaatcaatctagagactataatctatatatatttatgttaaaaggaaggtaggggttgcttgcctgatgatttaggtaaccttctaaatgtgtatatttttcctgtggccctgtctttaattcagagaccactgtatacattttatgtccattggtattcactccctcctgtatacctgagataccatctagagtcatttcctttctggctgaagaaattcctttagaattccttgtagtgtgggtctgcttataataaattctctaattttctttatttgaaaatgtttatgtttcattttcatttttgaagaaagttttgctatatacagaattctgggttgacagtttttaaaaattctccactttaaagatatcattctgtagtcttttggtctccatggcttctgataagttcattatcatttgtattattgttcccctgcatgtgatttgtcatttttttctggctgttttcaagattttaactttgtattttagcagttttcctagaggtagttttctttctatttatccctgcttgggttttggtgattttcttgaatctatatttttgtctttcactaaatctgtaagttgtaggcctatttcttcacgtcttttctgccttattctctctctcctttcctctgagactctaaatataagtgtattgaatggactgatattgtcccacaggtctgggaggctctgttctattttttaagtctttttttcttcactgcttttcagattggatggtttctgttgatctgtcttgaagttcccagatgcttctgctatctttgatatgctgttaatctcattccagttagtgtatattttacttctagatgattctgttttcacagtttctgatttgggggttagattccccatctgttcattcattgtgtatatatttttcatttaaaattcttggacgtatgtataatagctgccttatagttcttatctactcatttcaacatctggatcatccttgggttgattttttttaaatgaattttttccttgagttcagattatattttttcatttcatcacctgtctagtgatttttgatcaattcctggacactattaagtatatgttgtggagactctggatcctgctatattcctttcaatggatttttatctaacagagagttaacttggctgggctcagacttcaaacttgatcctttgggctagctaatgtgaaaggaaaataccctgggtccccaaaatccctaagggaaagggaaacgtcaagctgggaactgcttagagcaagcctgcctcccatttattcaaagtcacccctctgctcattgagataaatgcatatctgatcgcctcctttggaaaggtgaatcagaaactcaaaagaatgcaaccatttgtgtcttatctacctatgacctggtagcctcctccatgctttgagttgtcctgcctttccggactgaaccaatgttcatcttacatatgttgattgatgtctcatgtctccctaaaatgtataaaaccaaactgtgctctgaccaccttgggcacatgtcatcaggacctcctgaggctgtgtcacaggcatgcatcctcaactttggcagaataaactttctaaataaactgagacctgtctcaaatttttgaggttcacaccaggcagcagctgacatctccactctttctttcagcttccagctgctgctttttcaccatactcctgtggtttctcacatcctaggctcttggtgagccaaggatttgcatggatttcatacacagattttgtgggcttgcaccatctgcagaggcctgcctaccagggttccacctctgactttctggctgttcttctagcccccaagtttttttctgatacatcaagccagttacagttctggatctcaggcaaaagactgctacacactcagaaatcttaacttcctcagttgtctttcaaggatactcctgtctactttctgcctgcttttcatcactctctggacccttaaataagttcattaaagaaaatattttgttcaaatttgataattgttacttgcaggaggtttggtatatacaagctactctgacaatactggacaccagagccaaatatgagattttgttgtttaaatagctttattgaggtataattgatataaaaaactgtacttatttaaagcatacaatttgttgttttaatgtatgtttacaccttgaagcctttgctataatcaagacaacaatgagtattttttttcttactttttttttgagatggagtgtcgctctgtcgcccaggctggagtgtaatggtgtgatctcagctcagtgcaacctctgcctcccgggttcagtcgattctcctgcctcagcctccgtagtagctgggactactggtgcatgccgccacacctggctaattttttgtattttagtagagacggggtttcactcccacccaggctgttctcaaactcctgagctcaggaaatccaaggcctgactcagcctcccaaagtgctaggattacaggcgtgaaccaccgcacccagctaatgagtttttgagttttattaagaagtcacgtgcagatgaatggtgggaaagaaggctccttcacgttgacctcctgctttctatttcacagattgctctcaaatgcagtctctcattttgatcttcaagatgcccttgggaatgtggtcattcttaatatcacccttctgcagatgaaaaactgaggtggacgtattaaatggcttgcccttttcatgttaccttacaccactagacacctggggagatggatacgctgtcatccacagctttaggagttgtatttcagctgggagacaaaagttctcagagctggggcaaatcagtttggggtggagaagttcaagctcatgaaagctgagtgatggcatttggatggtgtgcatgagaagggaagggcttggggaagaacagaggccaagaactcagtttgggaagcaggtgtgacaagctaggtattatataatgtgatgaacacggtcattgtggaaatattaggttggtgcacaagtaattgcagttttgacaataaaagtcatggccaggccaggtgcggtggctcactcctgtaatcccggcactttgggaggccgaggcaggcggatcacttgaggccaggagttcgagaccagcctggccaatatggcaaaacctgtctctactaaaaacacaaaaaattaaccgagtgtggtggtggacacctatagtcccagctacttgggaggttgaggcaggagaatagcttgaacccaggaggcataggttacagtgagccgagatcacaccactacactccagcctgggcgacagagcaagactcgtcttaaaaaaaaaaaaaaagtaatggcttaaaaccgcaattatttgtgcaccaacctaatattaatagacaggaaaacagatactggagccctttcaaaagaggaactgagaggaaataggagtctggatataggacagaaaagaaaagggagggtcaagggtaacctttcttttcattcttgaccccagggcctttcactgatcctgatacatagtagtttgtaaatgttagctgaaacaaattagctggtgatgagaaggatgaaggggtgatatttgcttatggaccattaagttgacactacttgagtatgcatcagaatcaccttgatgggggctgggcacggtggctcatgcctgtaattctagcactttgggaggccaaggaaggaggatgactggaggccaggagttcaaaaccagccctaggtaacttagcaagatcccatccctataaaaaagtaaaaataaaaaaaattagccagacatggtggcacacacctatagtcccagctactcaggaggctgaggcaggaggatcgcttgaacccaggagttgaaggctacagtgatctgtgatggcaccattgcactccagcctgggtgacagaatgagaccctgactcttaaaaggaaaaaaaaaaggctggcgcggtggctcatgcctgtagtcccagcactttgggaggccaaggcgggcggatcaccggaggttgggcgttcaagaccagcctgaccaatatggagaaactccgtctctactaaaaatacaaaattagctgggcgtggtggcgcatgcctgtagtctcagctactcgggaggctgaggcagaagaatcacttgaaccccagaggaggaggttgcagtgagccaagatagcactattgcactccagcctgggcatcaagagcgaaactccatctaaaaaaaataaataaataagagagagaatcactagttggcactttgtgggtgctatctgagtttctggttcagtaagaggtggagacgtgagacatcaatcagtcatctcagacttccagtttccaggactgtgagaagaagatacatttatacatttctgttgttgcatcttgattaagagcaaacactgacatgtcctgtggacgctgctggcccagggctggacttggagatccagttgcacaaagtcatgagaacctttttgaattctgctgcttcacctttatgctccaggccgtgtaggagtatttttctcctagtcttgtctactggagctgacagttagagaggtgtccttgggatcattaatcagcatttaacatttgtaggcaatctagtttattactttgcttaaactctggagctcagagtcttgtttctgaagtctctcaggtaacattttgagaacactgcatgttctgccacaaattcttcacaagcagacgaggaggctttccaaatgttacagcagatcttgtgtcctggggagggcagagctggccggctccagcagctgacagactggggaggacttctgggattacgttatgctcatttgctaacctgcaaaattatgactgcatgtatgatggggtagggcactctggtcatcttgcccatttgtcagagtcttcccaggctgctgtttggactcaaaagaaaagaatctttctctgttcatgaaccacttaaagttttcaggctttgcaagctggccctttggatgcagagggcaattgtttcttagaacagaccgtgtacatttcatgccagagcactgcagggctgctggggcattgtggaccttgcggagttttgtgattctttgatgatttcatgacccagatgtgcagagtgaaaggggctttttcaatggagcatcagtacaaggcggaaactgtgccagagatgagagtgacccggttgcctttttttttcttaagtaatcgagcctagtgcttgggggcacattcactgtctagctgggcatttcacgatttcacccacctggtactaggcagctgatggctttgctgtcttcatacatttcttcccagtgtagctcttgaagacagaaggaatcactcctgagcagagcccactgatcttggcctggtgtgctatttggacacacaattgctgtcttcccccagttccttccactccattcaaaggctcccactctcgcatttttgaggtcaagggacttcctgggggtattgaattcctcccacgtcaaagagtgttcctgttaagatggttcccccaggtaagagttgattccagatattgctcgccaagaccctgaggtcagacgccttggagaattccccatggagatcccccgagccagaaatccagtgtctgttccctttctgtaaaaaccaacacacattgcgcctgtaatcccagcactttggtaggccaagatgggtggatcacctgaggtcaggagttcaagaccagcctgggcaacatggtgaaacccccactgtacgaaaaataacaaaaattagctgggcgtgatggcgggtgcctgtaatcccagctacttgaggcaggagaatcgcgtgaacccggtaggcagaggttggagtgagccaagattgtgccattgcactccagcctgggcaacaagagcaagactccatctcaaaaaaaaaaaatcaacacacaaagcagcagcagggacaaccacatcttcactaagagctactgtgagttacagaccgaattgtctccccacaaattcatatgaagtcctaacctccagcacctccctcaaaatacaaccctattgggagatacggtcgttaacgaggtaattaaatgaaaatgaaggtgtccttataaaaagaggagattaggacacagacacacacagaagattatgaaaggcaatggaagaaggcggccatctacaaaccaagagagactgacctcaaaagaaatcaaccccgctgacaccttcatctcggacttccagtttccaggactgtgagaagatacatttctgttgttcaagccacacagctttgtggcattactccacggcagccctagtggagtaatgcacagtgtcatggtgatggagtaacctaaatactccaaccactcgatgatttgatctctgctagcttgagtgctggggccaaattacactggcctctccagctctgctctcctgacctttctagaaagcttatcatcagagcccatctgctggctgatgtcttcaccaacacacactttactgcaggtaaatcctccccatcttgagctcaggcatctaagagccttatcctcttaagataggctctgttgagttagaaactgccccgctgactgaaatcgccagctccctggcccagctcttagacttcccttcctctctcccaaggtgggaaatagcttgttacttggaatgggccgtgcactttttgcccttcttgggtttactgtatgacaggtattattaaagacccatgttacattagcccctgtgtaaccatacctgcaagtgctgtgtcagttgcattagctggaattctaaattgactgttagaacagcactaaaaataatgtggtaaatgatggagttttagggcagtgtataagacttctggatgtggaggcagcctgctgcacaagccctgtgagctgggggcattctctaacccaccctccctccctcccttcctcacttccttccttccttccttccttccttccttccttccttccttccttccttccttccttcttccttccctccctccctccttccttccttcctcttctcttcctccccctcctcctcctccttctgcttctttttctcctcctccttccttcttctcccttcttcctcccctgccctcgcctcccttcccctctcctcccctcccgtcccctccccttccttcctctctgtcccctccttcctctctctgtctctctctgtctgtctgtctctctctctttcttcagacagggtctctctctgcctcccaggctggagtacaatggtctcatcacggctcactgcagccttgacttctcgggctcaggtgatccccccacctcagcctcccaagtagctgggactacaggcacatgccaccatgccttgctaattttttttttatagagacaaggcctctgttggtcaggcaggtcttgaactcctgggtccaagaaatcctcctgccttggcctcccaaagtgctgcgattacaggcatgagcccccatacctgccccattctctaattttcgtttcttttcttttttttttttttttttgagacggagtctggctctgtcgcccaggctggagttggctcactgcaagctccgcctcctgggttcacgccattctcctgcctcagcctcccgagtagctgggactacaggtgcccaccaccacgcctagctaattttttgtatttttagtggagacggggtttcaccgtgttagccaggatggtctcaatctcctgacctcgtgatccgcccacctcggcctaccaaagtgctgggattacaggcgtgagccactgcgcccggcccccattctgtaattttctacaactccatttccctatctgcaaaatgcagctaataatcatagtcagtcgtagagtcattgtgaagtttagagagaaaatatatgaagcacaagctgtgtctcacacaacactcaggaaatgttggtaagctgttagtaaaggtcacagtaaagacctcccagatcattcaagattcctttatgccctctgaatcaacagagatgcattaaatcttggtggttaagatttgtataacagttgtaaattactccatttaggttttccaaaaatggtaatccatgtaaagaaactgtgtatgcaacccacatttttgaacaaggaggattctgctctttatgggtcttttagcccttaaattaatattttctggctaatttccttatattatttcaagccagaagctaaaattgcatccctctctactcccctttcccctttatcctctccaagaggagggggaactcttatctacttggttcagaagctaggaatcagatgaggccagtttatgggggtttggactgctgctactgaaaacttagtgtacaagagagtgtggtctctgcttcctctcacccctgccgcaggcctaagctgagcggggcctctgcctcctggggcaggcccaactgtcttactatctttgctcttctttggacacttcatggccttcaagtcctagctggagagtgtaagagcttacatttcaggcttggacttagcaggtgggagaggctcctagaagctgatcctgagtccctcctcccagatttcacttccagtttgccattgcccttcataagctgatcaactctggaggtgacagaaaggagggccaactggctcactattatgaaaactgtaaactcacttccctaacaaaggagtttatagctgttatttctgcagccagtaccaaaacgaaagcgagactttggcctgtacaaaccaactcagctatctggtcatgtacatccagactggtgctctactgggaaaatgaatattttccctaaggcgagaaaggctgggcctgctgtagcctggcaactccttctctgcagacagagcttgcgtttctctttatttttccttttacttccccaaggtaaacattcaagtagatggcttcccttactttcatctcccaggtcccttttcctgttttctctggattttgtatttaaaagcaaagcttaagtctctgacagatgcacccagctgcagtgtgagaaggcactcaaactgcaacaaagagaagacgactacaacttttagtagatacttaattttttgttgttttgtttttagagacaaggtgttgctctgtcacccaggctagagtgccgtggcaggatcataagtcactgcagcctcgaactcctgatccttctgcttcagcctcctgagtagctgggactacaggcacatgccaccatgcttggctaatttttctttctttttttttttttttgtagaggtgggcgtattgctgtgttgcccaggctggtctcaaattcctggcctcaagcgatcctccctctttaaaagtccagcctctttaaaactgtgaatgcaataagatctggcataaagactgagaaacttgagaggaaccggtggaaatttcttctgagttacgctcacttctctctgcttcgtttgttcgtatcattgttacttttgctcaccagtcatgtttttgaagtagccacaaaaataaatggtttcctaatattatttccacctcccccctcatccacttttcatcgtggaattcttttcagagtacactttgtgcttcaaaattcagaggtactgacgtgcacataggttgcagttgtcctggtctgtgtgggggaatggctgaggagggtgtttcctgttgaagacccaattactttttttagaaaaaaattttttatttccatagacttttggggaacaggtggtatttggttccatgagtaaattccttagtggtgatttgtgaaattttggcgcacctatcacccgagcagtatacactgcactcaatttgtagtcttcccaccctttccacctgagtctccaaagtccattgtatcattcttatgcctttgcagctgtagagcttagctcccacatatgcgtgagaacatacaatgtttggtttttccattcctgagttacttcacttagaataatattatagtctccaatccctttcaagttgctgcgaatgccattaattcattcatttttatgactgagtagtattccatagtatatatataccacagtctctttatccattacccatgtgatgggcatttgggctgattctgtgtttttgcagttgcgaaatgtgctgccataaacgtgtgtgcaagtatctttttcgtataatgacttcttttcctctgggtagatgcccagtagtgggattgctggatcaaatggcagttctacttttagttctttaaggaatctccacaccgttttccatggtggttgtatgattttacattttcaccagcagtgtagaagtgttaccttttcactgtaaccacgccagcatctattattttgttactttttttgattatggcgattcttgcgggagtcaggtggtatcacattgtggttttgatttgcattttcctgatcattagtgatgctgagcattttttcatatgtctgttggccatttgtatatcttcttttgagaattgcctattcatgtccttagcccactttttgatgggattgtttgcttttttcttgataatttgtttgagttcattgtagattctggatattaatcctttgtcggttgtgtagattgtgaagattttctcccagtctgagttgtctgtttactctgctgactgttacttttgctgtgcaaaagctctttagtttaattaagtcccacctatttatctttgttcttattgcatttgcttttgggttcccaagtcactttttgaaatatccccagcacagctttggatgtgtcactgggccactggacacaggcatatctcacaaaaaatagagtcggggagagtgagagaataggagagagcttttctggagaggcagcccagtttaaatgtgaaatacaccttggtatattgattgctgctctacagttcttgaagaagaaaaaatgaggtttcaaaacaagaaggaggggaagactagacaaaagagcttgttgctttttatggttaggctgtgttcccacccaagtctcatcttgaattgtagctcccataattcccatgtattgtgggatggactcagagataattgaatcatggggcagtgtcccccatactatcctcgtggtagtgaataaatctcatgagatctgatggttttataaggagtttccttttttcttggttctcattctttcttgcctgccgccatgtaagatgtgcctttcaccttctgccatgattgtgaagcctccccagccacatggaattgtgagtccattaaacctctttttctttataaattaccctgtctcgggtatgtgaaaatggaataatacattgcttcttggaagacagcttttccgggggtccttcagtcagaacttgttctgccaacagaggtggtgggggtggcatgtttgatgtgtaggcgtcagagggattgataagacctggtgactagctggtgtgcaggtctcagtctctggagagaaggggcagttggagggaggaaggcaggaatgatcttggctgggaggatgtgttgcagtggttggtgcagggaacaatcaaggctttgtgatcatggatgctgtgggtgtggttggaggaggtcctttaagggctgtcttcggtggaggtttgggagaagagttggcctggctacaactctgcttcaaccaaagcatctttagtttgagcttttaatatcttgggcctgtcctgcaggcttgtttgaacaaagactatacataaaataagcaagaaccatttcttttttttttttttttgagacagagtttcattcttgttgcccaggctggagtgcaatggcgtgatctcagctcactgcaacctctgcctcccgggttcaattgattatcctgcatcagcctcccgagtagctgggactacaggtgcctgccaccacgcctggctaatttttttgtacttttagtagaagcagggtttcactgtgttagccaggatggtctcgatcacctgaccttgtgatctgcccaccttggcctcccaaagtgctgggattacaggcatgagccatagcacctggctgcaagaaccatttcttctgaggaatccctagagacccggggcttggtctttaggaacagctgatctttaagaaaaaagttgcacaagatgggctttgatatagtttgaatatctattcttgccaaagtctgattttgaaatgtaataccaatgctggagttggggcctggagggagctgtttggatcatggtagcggatccctcatggcttggtgctgtcttcctgatagcaagtgagttcttgcaagatctggtcatttaaaagtatatggcacctcccccactgtctctcttgctcttgcttttgccatgtgaagtgcctgctcctgcttcaccttcatccatgattgaaagcttcctgaggctttaccagaagtcaggcagatgacagcactgtgcttcctgtatggcctccagaaatgtgagccaattcaatctcttttcttcataaattacccagtctcgggtatttgtttatagcagtgcaagaatggtctaatacagatttgaacttgaattttaaaattaaaaaattttttgagacggggtcttgctttgtcacccaggctggagtgcagtggtgtgatcatggttctctgcagccttaaactcctgggctcaagtgatcctcccacctcagcctaccgagtatcagggactacaggtgtgcaccaccatgcccacctgtattttgtattttttgtagagacagggttcaccgtgttgcccaggctggtctcaaactcctgggctcaaatgatctgcctgccccagcctcccaaagtgctgggattttacaggcatgagccactgtgcctggcttgaacctgaattttaaatgctaagaatgcacagattccaaagacacaagatagggggcccggttcagaggtaagatcctgcccttgtgtttcttggaatttttttcattttttgggggttttaaaattgagatgtaatttacatacagagtgaaatccacagaccttaagtgtagtttgattcgttttgagaaacacatacatttatgtaacccacagtctaccaatacataatacaatttcatcatctcagaaattctcttgtatcgcttcctagtcagtcttccacattcaccagaaacaagcactattttgatatttttagccctagattagttttgcctgctctagaactttatggaaatgaaatcatgcatatatattcttttgtctctgtgttttgttttgtttttcactcagcattttttttttttgcatttttctcaagaggtctgcagtcttttaaaaaaagaagcggaaaataaatatggtagacttgccaggcaccagatctctgtagcaactactcaactctgctgttgcagcaggaaagcagtgtagacaatatgtaaataactgcatgtggctatgtttcaataaaactttatttacagaaaacagatggctggtttgcagggataattagctgaccccaatacatgttgtttatcaggagtttcgttgctttttattgctgcgtcgtcttctatgtgtggatctgtcacagtttatttatctgttttcctgttgatggacacccagaccatttcagtttttggctattatgaaaagagcaactgtgtctgcttttatataggacttttgtgtgcctgcattttcatttcttttatataagtacctacgagtggaattactatgtcataggatatgtattactcagggttctctagagggacagaactaataggatagatgtatatatgaaagggggcttataaggagaattgactcacaggatcgcaaggtgaagtcccatgataggccatctgctagttgaggagcaaggaagccagtattggctcattcccaaaaacctcaaaagtagagaagcagctgacagtgtatccttcagtctgtggccaaaggcccaagagcccctggcaaatcactggggtaagtccaagagtccaaaagccgaagaacttggaatctgatgttcgaggtcaggaagcatccagcacgagagaaagatgaaggccggaagactcagcaagtcagcctctcccaccttcttctgcctgtttcattctagccacactggcagctgatttgttggtgcccacccccattgagggtgggtctgtctctcccagtccactgactcaaatgttaatctcctttggcaacaccctcacagacacacccagggacaatactttgcatccttcaatccaattaagttgacactcaatactaaccatcacagggcaagtgtatatttaattcttttttttttttttggaggtggagtcttactctgtaacccaggctagaatgcagtgatgcaatctcagctcactgcagcctctgcctcccaggttcaagtgatcctcccgcctcagcctcccaagtagccgggattacaagtatgtgccactatgcctggctaatttttgtatttttaatagagttggggttttgccatgttggccaggctggtcttgaactcctgacctcatgtgagccacccaccttggcctcccaaagtgctggtattacaggcatgaaccactgcacccagccctatatttaactcttaactgccaaataaatttagaaaatcattgtaacatttttcacttttgcctgcaacatatgagagttccggtggtgcctcatccttgccaacatttggtgttgtcagtctttttcctgttagccatggtagtggctgtggagtggtagcccacatgcttccttgaatacttcttgactgatgtggttccgtcacatgtgttgcctttatttctgcggtacctggagaggtgatcctctgcgatcaacctctcaggcacttaatagcctctctttacacaggctctgcatgagtaagtggcatgtgtgcacccagagtctttgagagaatgcatcttggtctttaaccatcatctaccatttatttatttatttatttatttatttatttatttatttatttatttttgagacagggtcttgctctgttgcccaggctggagtgcagtggtgccatcattgctcactgcagccttgacctcccgggctcaagctatcctcctacctgagcctcctgagcatctgggactacaggtgcacaccactatgcccagctaatttttaaattgttttgtagaggtggggtcttgctgtattgccctgtctgatctcaggctcctggcctcaagccatcttcctgccttggcctcccaaagtgctgggattacaggtgtaagccaccacacttgcccctcatctattgcaattgtccacatgcatcagattttacactgatacgcttttgtcttttttttttttttttttttggtgtaaacatctcctttcccggctttgactcggtggaggagagctgggagaaggtgtcagcagtgacatcatttctggttttacaaatgccagggtccttcctccttcagagcctggagacaaagctgggccccatttatcacaacacccggccaactccttcctgccatatggctgattctctcctggggggaagattgagaaaatagacccatatgctactgtgattctgtttgtgtttggatgtggagtttaatttgtgtcagaaaatagcagtattcttatttcattgatttcctttttgcttcttttataaaaggaaagaatgaaagctggggaattagctacagaaatagcaagtgaataataaaataatgtgttgtggtccacgtgcagttaaaaacgggaatgatgttttactctctttcggggcgtattgacaaagagctatactggtttcttgtatcgatgtgatattttagaggtatcaagcattcttgtattcactgtcttatccagttataaaagtaaccttgtgaagtaggtggtctctaaccaatcatctgctttatttatttatttatttttgagacagggtcttgttctgtcacccaggctggagtgcaatgatgcaatcagaggtcactgcagccttgacctcctgggctcaaacgatcctcccacctcagcctcctgagtagctgggactacaggtacacaccatcatgcaccaccatatcaagcagatatgatgtccatgtcataaatgaggaatttgacactcacagaggtttaggaacttgccccaggccactgagcttagactgtggtcctcatcgaatagttatttgaaattcttaatgtcttggtttgtcaccaggcatttcactgcacacatttttttccctacctgggaaaagggtatatgggatcttaagaaaagggtaggggagttagagcatcatggtcaaataatgctgttccctggcagatacagtattggaactggaggagggagaaggaataggtaggtttttgggaagataactttatatagagattcacccatgcaacgagacagagcctgacacttgtgttggtgctgatgagtgaggacatggggtcagcagggtgacagcctgggccctgagcacctgtgtgtccctggctaagccactcaatccctctgtacctcagtttctcatctgcaaaattgggttcttggatatgatcttctttctcccttccagctccaaactttatttattaccaaaagcaacttcagtttttcccctttggttactccctttaattaaagcatgctaccttggtggagttacatcagagcccttcagcatcacggtgctgtctcagatttgtacagccctgttggagcaaagtctttaaggaaatggggggactgccccggtgtctggaggcaccatctgaccacagcttctcatcattgcactcatctttaggttcttggatgtaagttgatgtagaaatacgtctgcctagcacctagctttggccaggggttgatggcataaatggggaggcaatagtagctaatatgtatatgcatgtatattctgtgtctgccacctgctgataactttacagacattaccttcttatatcctcaaaacaactctaaagagtgagtagaatgattaaccccattttatggatgaagcttcctactgaagctgttgtctaattctggagactgtgattttatttatttatttttttcagatgaagcctctctctgttgcccacgctggagtgcattggcatgatcataacttagtgccacctcgacctcctggcctcaggagatctttccgcctcagtctcctatagctgggaccacaggcacgtgccaccatgcttggctaatattttcaatttttttgtagagatggggtctcacttgttcacctaggttggagtgcagtggcatgatcataacttactgctgcctcagcctcctgggctcaggagatcctcctacctgagtctcctatagctgggaccacaggcatctgccaccatgcttggctaatattttaattttttttgtagagttgggatctcactctgtcacccagactggagttcagtgttgcaatcatggcttactgcaccctcggactcctgggctccagtgaccctctctcctcagcctcctaagtagctgggactacaggcacatgccaccatgcttggctaatttttaaatttttttgtagagatagagtcttgctgtgttgcccaggctcatctggaactcctaagctcaagcaatcctcccacctcatcctctcaaagcgctggggttacaggcacccagccgagcctatcatcttaaccattatttcatgagtagccatagattaatacaaatctataagccaatgtttcttgacacttatgaccagcccccaataaaaatcttgcatactaactccctaatgagcttctctaatgggaaactcttctcatgtgttgtcagaactccttactggagggattagcagcatcccctgtgacttcactggggtagaactcttggaagcttgcacgcagtctcctccagacctcctcccatgtgcctgttccctctcttgctgctttttatttttatttattttattatttatttatttatttttgagacagggtcttgctctgtcgcctaggctggagtgcagtggcaggatcttggctccctgcaaactccgcctccaggttcaagcaattcccctgcctcagcctctcaagtagctggggttacaggcacctgccaccatgcctgggtaatttttttgtatttttagtagagatgggacttcatcatgttgaccatggtggtcttgaactcctgacctcaggtgatccacccgcctcagcctcccaaagtgttgggattataagcgtgagccaccgcgcctggccccttcttctgcttctgttttgaatcctccactgtaataaatcagagccacgagtacaatgtgctgagtcctatgtctcctcctactgaattattgacctgggggtggtcttggggactcccagaatacctgagttgaaagcttggttatgctacttgatagtgtgtggctttgagactgttgcttaattaaaaaaaaaattattattatttatttttgagacggagtcttgctctgtcgcccaggttggagtgcagtggcgtgatcttggttcaagtgatcttggttcactgcaacctctgcttcccaggctcaagcgattctcctgcctcagcctcctgagtagctgggactacaggtgcgcgcaatgatgcctggctaatttttatatttttagtagagacggggtttcaccatgttggccaggctggtctcaaactcctgacctcaagtgatctgccttccttggcctcccaaagtgctgggattacaggtgtgagccactatgccccgccaatttttttttaaaaaatttatttttaatttttgtggatacgtagtaggtgtatatgtttatagagtacatgagatactttgattcagacatgcagtgtgtaacaatcacatcatggaaaatggggtatccatcctctcgagcatttatcctttgtgctacaaataatccagtcatactcttttagttattttaaaatgtgcaacaattacattattgattatagtcaccctgttgtgctttttttttttttttttttttttttgagacagagtgtcgctctttcgcccaagctggagtgcagtggcgcgatctccgctcactgcaaactccgcctcctggtttcacgccattcgcctgccacagcctcctgagtagctgggactacaggcacctgccaccacggccggctaatttttttttttttttgcatttttagtggagacggggtttcaccgtgttagccagggaggtctcgatctcctgaccttgtgatccgcccatctcggcctcccaaagtgctgggattacaggcatgagacaccgcgcctggccctgttgtacatttaagtagtaggtcttattcattttatctaattatatttttgtacccattaacagtccccactttcctccactcccccactccccttcccagcctctggtaaccatccttttgctctctatctccatgagttcaactgtttcaatttttagcctccacaaataagggagagtcagcaatgattatctttctgtgcctggcttatttcacttaacataatatcctccagttttatccatgttgttgcaaatgacagggtcttatttctttttagggctgaatagtactctactgtgtatatgtatcaagattttctttattcattcatctgttgatggatgattatgttgctttcaaatttctttatttattgtaatcttctgtaaaaaggggatgcaggccaggcacggtgactcatgcctgtaatcccagcactttgggaggccgaggtgggcggatcaccagaggttgggagttcgagaccagcctggccaacatggtgaaactgtctctactcaaattacaaaaaaattagctggatgtggtggcgggctcctgtaatcccagctactcgggaggctgaggcaggagaatcgcttgaacccaggaggcggaggttgcagtgagttgagattgtgacattgcactccagcctgggtgaccgagcgagactctgtctcaaaaaaaaaaaaaaaaaaaggatgcaaataccaacttcaagtgggtatggtgtgggttaaattagaaatatgcacatagtggcccccaacaaatgttggttcttttctgctctcccatccaaaagcaataactaaccgaaatgggtgtagtgagtatttgggcattgctgcagtaacagaaagaccttcagtttcttggcatcatttccttcatttattgagttatgttccatgctctttgctgacctggactctacttactaaacatggtccttcgctagagagatcgagaagaagccaaaaagtctttgagcttccaggattttctctggagacagctaacctggactaccagtaagtggccaacaccagctgacactagctgacgctagttggactgacaccaacacagacctgtaagaatgaagaacctcctaattaacgacgctatagcttgggaagataggtacttaagattgacaagccattttagtcttggtttctgcaggtggtgtggccgaacattcagaatcaaagcaattttcacttcatttcatccagaaggtctctatgttttcttataaagagactgtattttgctcctctctctccccacaaaaagaaatctggtcaaaactaagcacattcccttcgtttatgtgttggctgccgtggttcataaactttagtaggtttcagaatcacatggagagcttgttgaaacatgaaatgctggcacgatcctcagaatttctgattccttaggtcttggcggggcttgagattttgcctttctaaactgttcccagttcatgttgatactgttagtcctggataatactttgagaacctctatgtggccgcggcctctatcagagcataaccgggccgtggctgagatacatctgtcttatctgtcaagaatgactcatttaagcacttcactgcgctgcatgtcctttgattaggtggccaagggggtggctaaagctgaatttacaaggcaaggagccctgaaattcttctttgaaagatctcgcaaatgatctatttatttttcatgggatgattttccagatctttggtttgctttcctgtttggcttgtgttagaacactactgttcctaaagttgtaatttttgtaacccattggcatatgtaagtggtttacacaggttcttgtggattaggatttctaaccgtccatcatctgtctgtccactggcccactcacctactcatccattcatccatctgtttacccttaccctctctgtcccactcatccatccacacacacatccatccactaaccccatccattcatccatccatccatccatccatccatccatccatccatccatcctgcctacccttctgctcattaatccattcatctgctcacctgatccacccgcccacccactcaccccatccaccgacccacccatccatctgtccatccttccacccatccatccatccatccatccatccatccatccatccatgtatgtgtccacccacccacccatgcacttatccattagctcactccatccatccatccacccactcatctatccatatgtatattcatccatcatccatccatccatccaacataacacacttgtagactatagagatataaagaaaaataagaccatgtcgccatcctcaaggggtttatggtactgtaatagaacctcctcttttttgtcttccttacagaaaagtgtgcatttcttgctttctagtgagttgagataatagttaaatccattagattaatattgacctttcttgtaaacacacatctcctcagaaaatgttttgagaaatctgctgacttcttgaagtaaaggcacaaatgtctttaacccagtaagtaccttttgttgaaaatcaattccttccaaggaagcttttcatagcctcttggtggtgatgacaagaaggtttcctctgaataagtatggtatgttttagaaagttctgccacgttatcatgttggcttgaaagccccatgtctttatcagtaagtctggcccgtggcttcgtgcaagatgtttgtagatggtgtgtttgtattgatggagcatctgctctgggtcagcctgcactgcatgctcaaccattagagagcacccatgtaaataattctagaccaccttccttgggatcctttgaccagacacattttggcatttactactaggtgcagtaataatccaggtgactgcatgtccactggtgtaaatggttttaatggttcctagaggctggattttaagtgttaaaatcactctctgtgtcccttcatcctgcaaaagtgttcaaaaacttgagttataaacttttcttaaaatacctgaattattttcatctctccttatcctagttccatctttatttaaacacatggagctttttgcgtggttatagtcattatggatattcagtttttttctgcttttctcacattacattatttagtaaatattctttcctgctcctacatagctatgataactctataatagtgcacagtttaatgtacctttattgcttttccattttctatcacttagttattaggtcgtttctatttttttaaaaataatgaatgtttctatacctagcatctagactcagaaaacaaaacaaaactcaactcttttttccttctttaaaataattacttacgtacatttatatgatgttatttatatgtattattattctgattatatttttaaacactcttgatatagttagtcagactttcttcccaaagaattcaggcaattcagttatctctctgccaaaattgggcttaatggtttttctttgtttttctaattttaattttaaagagtgtgcccactgttttgatttgcatttctttaattactgacatcattaaatccattttcagtaattggcttattaaaggagttctgtttatgtgttcgtgtatgtgcaggaaactggtaccatattttttctttgtatgggggtgtgtgtgtttatttttatatatatatatataatttgtgtgtgcatgcgtgtatggcttaatactatacatgtgtggattttccagtcatattggctttcttttcatgtgtttttttctggcctcataatactgatgcctgctgagaactcagatatttattgagtgaatgaatgtttatctttgctctgattctcttctgttatacacattcaaaactcttacacgggaggacaatgttgtttgttttattccaggttttcttatttgatttgtgatatttagcttattttttggccacaaaatttagattggatacggatctaagtttgtttttctccattttttttggtttgatttctgtcctaatgcatgaaattatactttattttactttgccagtttttttttttttttagttttttgagatggagtctcgctctgtcaccaggctggagtgcaaatggcatgctttcggctcactgcaacctccgcctcccgggttcaagcaattcgcctccctcacccttccgagtcgctgggattacaggcacacgccaccacacccagctaatttttgttatttttagtagagacggggtttcaccatgttggccaggctggtctcaatttcttgacctcaggtgatccacccgcctctgcctcccagagtgctgggattacaggcgtgagccactgcgcctggcctactttggcagttaaattctttaaacatttgggatctatgtctgggatgcctcttctttctcagtgatctgtgacttggttttaaggtattttttactccttatgacatgtttgtttcaaacatattataatgttcaatgaagaaaatcctcttttattcattcctttcccccaaatagtatttttttctctcgtttttttctgttttaaattgcattttacataaaacaatataaataagcaatgaaaagttttccagggcaaaaggagcataaagtgcagacctttattctgtagcttcagtgaagtataattagataaattttaattaaattaaaataattcatcacacagacaatattataacaggagtagagaaaagaaagtgaaactttcacccacagtcatccataacagttttttcaagtgtacacatttctgtttaaaggtatgtgaagtctgcattgttttaattctagcttagctttagttgcatatttgcaatttttcatttaactttatgtcacaaagattttttccatattagtatttttcttttttaaaatgtagttgaatcaaacatttaattaagtaatgattgtatatctttattaggtacactgtaatgttttaatatctatatacatgatggaacaattaaatccatctaattaacatgtccatcattgcacatacttatctatggtgagaacatttaaaacctactctcttagcaattttcaaatatgtgatactttattaataactgtagtcaccgtgctgtgatatttccaaaacttatccctcccgtcaaaccgaacctttgtaacaaaaccccacggccactgccaccagcctttggtaaacaccattctattctctgcttctataagtttgacttttttagattccacatataagtgagattacgcagtatttgactttctgtacctactgttttcacttagattaatgtcctccaggttcattcacgttgttgcaaatgacaggatttccttctttataaaggctgaatagtgggtatatgtatacacacgtgcacacacacacacacatacatacacacacacaccattttctttatccatcatccattgatggacacttaggttgattctgtgtcttggctattgtgagtagggctgcaatgaacatgagagtgctgatatcttttcaacatactaagttcagttccaatggatatgtacccagacgtgggattgctggatcatatggtggttccatttttaattttttgaggagcctccatactgttttccatagtggctgtattaattttccatttccaccaacagcataccagggttcctttttctccacatccaacacttatctttcgtctttttgaaaacagccattctaatggatgtgaggtaaaatctcattgtgttttcaatttgcatttccctgatgattaatgttattggacattttttaatatacttgttggccatttgtatctcttcttttgagaaatatctattcagattctttgtccatttttaaaattaggtcatttatttctttgctcttgagctgttcaagttccttataaattttggatattaaccccttgtcaggggcatggtgtattaggctgttcacacatggctataaagaaatacctgagactgggtaatttttaataaaagagatttaattggctcatggttctgcaggctttgcaggaagtatagtgctggcatctgctcagattcgagggaggcctcaggaagctttataatcatggcagaaggcgaagggggagctggcacgtcacatggcagaaggaggagcaaatgagagagtgggtcaggaggtaccacacacttttaagtgacaaatatccagactgtgtcatatttttcaaattattttctccccgtccatgggttgtctcttcactctgttgattgtttactttgctgtacagaagccttttagtttgatgcagtctcatttgttgatttttgcttttgttgtctgtgcttttggattcatattcaaaaaagtcattgtccagaccaatgtcatgttttgttctagtagtttaaaagttccaggtattctgttcaagtgtttaatccattttgagttgattttagtatatgatgtgagaaaaggatccgacttcattctgcttgtggatatccagttttctcaacaccatttattagagactgtcccttattcattgtgtgttcttggcacctctgttgtaaatgcattgactgttaatgtgtgtgtttattactgagctctctgttctgttccactggttgatgtctgtttttatgccagtaccatgctgttttgattactatatctttgtactatattttgaaatcaggtagtgtgatgcctccagctttgttttgtttgcacgagattgtttggatatttgagtctttagtgcttctatgcaagttttaggatcaatttttcttttatttttgtaaaaatgtcattggaatttgatagggattgcattgaatctgtagattgctttgggtggtatggacactttaacaatattaattctttcaatttttgaacatggagtatcttttctcttctcttctcttttttctttttctttttttttttttgagacagagtctcaccctgttgcccagactggagtgcagtggcacaatatcagctcactgcaacctccgcctcctgggttcaagtgattctcctgcctcagccacctgagtacctgaaactaccggcatgcaccaccatacctgcctactttgttttttttgtttttgtttttgttttttgaaacagagtctcaccctgtcacccaggctggagtacagtggcacgatcttggctcactgtaacctctgcctcctgggttcaagcaattctcgtgcctcagcctctcaagtagctgggattataggtgcctgccaccatgcctggtaaatttttgtatttttagtagagacggggtttcaccatgttggccagcctggtctcgaactcctgacctcaagtaatccacctgtcttggccacccaaaatgctgggattacatcttttcatttacttgtgtcttctttaatttatcttgtcaatgttttattatcagtgtacagatcttttgttttcttggttaaatttattcctaagaattttattttattttttattttttactttttacttttttttttttttttttttgagacagagtctcgctctgttgccaggctggagtgcagtggcgtgatctttgctcattgcaacccccacctcccaggttcaagcgattctcctgcctcagcctcctgagtagctgagactacaggtgggcaccaccatacccagctaatttttgtatttttggtagagacagcattccaccatgttggccaggatgatctcaatctcttgacctcgtgatccgcctgcctcggcctcccaaagtgctgggattacagacatgagccaccgtgcccggccactttttacttttttcaagagacaggtctcagtgcagtaatgctcattgcagcctcgaactcctgggctcaagccatccttccatcacagccactctagtagctgggagtacaggcacgctccaccacacgcttgactaatttttaaattttgtgtagagatggggtcttgttatgttgcctaggctggttttgaatttttttgatgctactgtaaatgagattgttttcttgattactttttcagagaattcattgttagtgtatagaaatgctgaattcagtagagtttcaggatattattgcatcaaaacacaggatttctgcatattattatgatttaagtgattattgttttacatgactctttcattgagttaggatttaataattctcctaagcagttcctttgattaaataagtaggttatttctaacaatttgctatgatagattatacagtaacaaactttgcagtgcagatggctgctttttgttgagaatgatttctttttgatatgacactgagccactgcatgtagtcatatgggtatttatacaaattaccaaattgctttgccagctagagaatatatatatatatatatttgacatgtctctttgtcaaatatatgaggtgtgtgtgttcatgtgtgtgtatacatatgaggtgtgtgtttgtgtgtgtatatatatatgaatatatatataaaatatatatatttatatataaacacacacaccaagtggttatcttgtgctcatgaatttgtactcataaattcagctctgtgtgtgcagtctgctcagcagcacctgggcagggcacttaacccggtctagatctcccaccttccccagtccatggaccctttctgacagcagtggtgatgaattgaccatgtgagccacgagaacagaatagtgtcatgattcatgatctcccctgacttggccagaggcagcgggagaagcagcagtgctcagagctctcttgagagtggaggcctgtgttcatcattttgtaaataagtcacatgctaccccgttgtaatactactttttaagataaaaacccacttcccaaattgctttccagagatttcctcaaggtagtgatgatcctaattattaattacttgatttgcaggcttttcccaatatgattatatttctgtaaggtgtaggggaagttttattgtcagggcgaccaagacggtgggtttctagtgcagttttgatgaagacctctacttgatcagggtctcatatttctgcggctaaaggaatgcagaccatatctggattctcctgttttctctgtcttgcactgtctgcacgaggtaccccttttctagtcaagactgatcagtaggccgggcgtggtggctcaagcctgtaatcccagcactttgggaggccaagacgggcggatcacgaggtcaggagatcgagaccatcctggctaatgcagtgaaaccccgtctttactaaaaatacaaaaaaaatagctgggcgtggtggtaagtgcctgtagtcccagctacttgacaggctgaggcaggagaatggtgtgaacccgggaggtggagcttgcagtgagccaagatcgtgccactgcactccagcctgggcgacagagcgagactctgtctcaaagaaaaaaaaaaaagaccgatcagtagcagaatcaaccagcctcactttttgctttttcttctcatcagagagagagccctttcctgaattttgccattgatcaattgtgttgtgttgttaagtaagccacgtatgtttatattttaatgtgctctcaatggccttctcatctttgacttgtaagtttaaaccatgtcccttcgttgtcctaccttatctttggttttattttattttggatgttatttattattattgcattaccacccacttctctcctttctgcccccatgtccttatcttctgttatgtggagctggataatttagtttagctttgtcttttatagtgatgtgggaggaagataccgtatttcattcttcttctgctatgcagtaccagctaaaatgacttaatcagcaaagtggagggtaaggatgatagatgctggctcgggtgggttggggtagggaggtagggtacacgtcatgccacgtggactgcctgagcaagggcttctggaggcaaaacacaacattccaccatgggtaagtgtcactcgcacctggaatttgggagggcatagtgagaaatgagctgacacccactcactggtccttgggagccttgtgtgcccatttatgagtgtagacttgatcttgaagacacctggagctcaaacacgagcatctgtctgaaatggagttcgttgaaggtggttttgtgggcattatatttgttttgggatttgtcatgggtacaacatttagagccactgatgtatacaagcaatgaggtggacatgtgcctgtaattttttttcttttttcttttttttttttttgagacagggtcttgctctgttgcccaggctggagtgcagtggcacgatcatggctcactgcaacctcgacccccctgggcgcaagtgatcctcccacctcggcctcccaagtagctggggctacagtcatgccacaaccatgactggctgatttttgtattttttgaagagatgggttttcttcatgttgcctaggctggtcttgaacttctggacttaagcgatctgcctggcttggccttccaaattgctgggattacagtcatgagccagcacgcctggcccattgctataatttggaattaaatgtggtgtttctcaaaacacaacagatgcctgctcccacagggagattgataaaagggagaaggagcctcccattcacagattactgtaaccaaaagtctcagccagacctactcagtgcagacaaataccctcccagaaacatttatggcatagcctttatattgtatttgttttaatttaataaatgctttttttttttttttttttgagataggatctctctctgttgcccaggctggtgtgcagtggtgtgatcatagctcactgcagtcttgacctcctgggctcaaatgatcctcctgtctcagcctccagggtagctgggactacaggtgtgtgccatcatgcccagccaatttttcgtatttttggtagagatgagatcttactatgttgtcgaggctggtcttgatctcctggactcaggctgtcttcccatcttgacctcccaaagtgctgggactacaggcgagagccactacacctggccacgagtgcttctaaaatcatataatgtattaatattttaatttttttcttataagatgtttctgtatttttatgatatgatatgggcttccaggaatggaatctccacttacaacattacactcggaggaaacaaagaattgatttataattacttgatttgctacctttgtccagtaattgattaggttaggggttggcagacttctcctgaaacaggctggagagtaagtattttcagctctgtgggccatatggtctctgtcataactacgcaactgtgccactgcagcgtgaaagcaggcatagacacctcataaacaaatgagtgtggctgtgttccaactaaactttatttttggagagtaacatttgaattttatgtaatttccatgtgttgcaaaatatcattcttctctgaatgtttttcaatcctttacaaatgcaaaaccattcttcacttgagggcctttcaaaaacaaggcagtgggcaagatttggaccacggtttagcagtctcttcctcaggtcacagtttagggttgtagagctgtgatttacttagcaaattctatgtgctgggtactgggctttatcttttcatatataggctcacataatcttcacaaaaactcttaattatgtatttatttgtttatctacaagggggaactggggcttcttgaagttaactcacttgcccaaggttatattttagttatgtaatagtggtggcatgacactttattttttattttatttttttgagacagggttttgctgtgtcacccaggctagactgcattgtgatcatggctcactgcagcctccaactcccaggctcaagcgattctcccacctcagcctcccaagtatctgggactgcaggtgtgcatcaccatgcctggttaatttttctattttttgtagagtcagcgttttgccatattgcctatattagtccgttttcatgctgctgataaggacatacccgagactgggaagaaaaagaggtttaatcagacttaacagttccacatatctggagaggcctcagaatcatggcaggaggcaaaaggcacttcttacatggcagcagcaagagaaaatgaggaagaagctaaagtggaaactcctgatcaacccatcagatgttgtgatatttatttatttatttatttatttattttgggacagagtttcgctctgtcaccgaggctggagtgcagtggcacaaactgagctcactgcaacctctgcctcctgggttcaagcaattctcctgcctcagcctcctgagtagctgggattataggcacctgccaccatgcctggctaatttttgtagttttagtagagatggggtttcaccatgttagccaggctggtcttgaactcctgaccttaggtgatccacctgcttcagcctcccaaagtttgagacttattcactatcacaagaatagcatgggaaagactggcccccatgattcaattatctccccctgggtccgtttcacaacacgtgggaattctgggagatgcaattcaagttgagatttgggtggggatgcagccaaaccggatcattgcccaagttggttttggactcctgagctcaggtgattctcctgcctcggcctcccaaagtgccaggattacaggcatgagtcaccactcctggccgagtgacaatttgaactgaagtctgcctgagtttaattttaactataaaggccctgttcttgtggagtttgcagagttgtggtgaagagagtgggtaataaagcagttttgcaattgttagtagaatattataatttaactaataagtaactctcttagatacaccatattggtaaagcctagaatgaggttggcttttggattgttcatcacttttagtgacagtgcagtggacaggagaggttgtttgggtttgaatctcactccaccccatggaagttcagtgaccttcaagttatttgtcctccctatgcctcactttcctcatgtgtgaagtagaagcagaaagagcgtttgcttaggagcattgttaccaagattatatgagaagggagactgcaggtgatggacatgtagtacattgtcaacagacatgagctcttattgtcactattttttaagagtcaaataaaccccaccggctatatttaagactcacagtgctgctaaatttttttctcccctgctctgtatttccaaaaatatttttggaaaaaagattcagtcttatcaattacattgttcagatcaatgtctttgctttttactaaaccatattactaaattctagtgacctgattttatggtataccaccacaacagagattctatcaagttctctttaccttggtgatatggtttggctgtgtccccatccaaatctcaacttgaattgtagctcccagaatttccacgtgttgtgggagggacccagggggaggtagttgaatcatgggggctggtttttcccatgctgttctcatgatagtgaataagtctcacgagatctgatgggtttatcaggggtttccgcttttgcttcttcatcgtttttctcttgctgctgccatgtaagatgcggcatgtgccttttacctccccacatgattctgaggcttccccagccatgtggaactgtaagtccagttaaacctcattttcttcctagtcttgggtatgtctttatcagcagcatgaaaacagacgaatacagttaattggtactagcagagtggggtgttgctgaaaagatacccaaaaatgtggaagcagctttggaattgggtaacagggagagattggaacagtttggagggctcagaagaagataggaaaatgtgggaaagtttggaacttcctagagacttgttgaatggccttgcccaaaatgctgatagctatatggacaataaggtccaggctgaggtggtctcagatggagatgaggaacttgggaactggagtaaaggtgattcttgttatgttttagctaagagactggcaacattttgcccctgccctcaagatatgtggaactttgaacttgagaaagatgatttacagtatctggcggaagaaatttctaagcagcaaagcattcaagacatgacttgggtactgtgagttttataagggaaacagagcataaaagtttggaaaatttgcagcctatgtgatagaaaagaaaaaacccattttctggggagaaattcaaggcagctgcagaaatttgcataagaagcaaggagcctaatgttaatccccaagaccatggggaaaatgtctccaggccatgtcagagaccttcacagcagcccctcccatcacaggcccagaagcccaggaggaaaaagtggttttgtgggcctggcccagggtccctgtgctgtgtgcagcctggggacctggtgccctgcatcccagccactccagccttggctgaaaggggccaacatacagctcaggctgtggctttggaaggtggaagccccaagccttggcagcttccacatgttgttgaacctgagggtgcacagaagtcaagaattgaggtttgggaacccccacctagattttaaaagatgtatggaaaaacctggatgcccaggcaaaagtttgctgcaggggtggggccctcatggagaacctctgctaaggcagtgcagaagggaaatgtggggttggagcccccacacagagtccctactggggcactgcctagtggagctctgagaagagggccaccgtccaccagactccagaatgatagatccactgacagcttgcaccgtgcacctggaagagccacagacactcaacgctagcttgtgaaagcagccaggagggggggctataccctacaaagccacagggttggagcttcccaagaccatgggaacccacctcttggcatcagtgtgacctggatgtgagacctggagtcaaaggagagagatcatttggagctttaaaattggactgccctgctcgatttcagacttgcatgggccctgtgacccctttgttttggccaatttctcccatttggaacagctctatttacccaatacctgtacccccattgtatctaggaagtaactagcttgcttttgattttataggctcataggaggaagggacttgccttgtctcagatgagactttggactgtggacttttaggttaatgctgaaatgaattaagactttgggggactgttgggaaggcatgattggttttgaaatgtgaggacatgagatttggagggaccaggggcagaatgatatggtttggctgtgtccccaccaaaatctcaacttgagttgtatctcccagaattcccacctgttgtaggaggtacccaggaggaagtaattgaatcatgggggccagtctttcctgtgctattctcatgatagtgaatatctcacgagatcttacggttttatcaggggtttctgcttttgcttcttcctcatttttctcttgctgccaccatgtaagaagtggcttttgccttctgccatgattctgaggcctccccagccatgtggaactgtaagtccaattaaacctcttttgcttcctagtcccagtgtgtctttatcagcagcgtgaaaacagactaatacacttggcaattggtatttatttatatgtttcatagatgtttatggttttataaatacatagtgttctctggtttgcaattttcggtgtgcctttgacattttatgttaactatatatccatttcttaagtgaattttgattcatttactcagtaacccagccgtttttacttttatttctttttagaaatctgtatacatccctgagaatactttttatccatgtgtaacagatttcacttaactaatccagtcaggaactcctttttctcccacatgggatgataattaaattcttttatattgggtgttatatttggatcatcttctgtcatcctaatttttattttcattttaatcattcttttgacatctctttccaattataactgcaaaatcctggccattcctcaatgcctaatgctttcttttttgtcccccttattgattacattcttctggtaaccagcctgttcctaccatagtattactgaaccaaattgctcagcaaactctcatctctctatacatctgtttaaacttttaactacttacgtcagtccagcaatttggatcctcttcgtggaaaaacagttgttactctttccttcttaatagttctgtctttgataccaaatgttatatggccctccttgatctgtggtggtattgcttcttatttttcacaataaagtggcccttcccatgagtgcccttggtttatctcttggaattggcatttaaactcagttgctgttggaagtaattccagaagtgaaatttgtcagtgagaggtgtgcactatgaatagttccttcaggtgctggacgcacttaggtccttctgttgcaggtgctgttaaataacagcttttctggacgaagagtaccttgaagtctctctgcttttatttctggggtttgtttatgtcactaaagtctcagatgagagttctgagaaaaggcttgtttgttacgtttctttaaaggtgacctagtatctctttttccttgcattaagaaggcatttcccaagagagggattgatatcttcctctttgacagttctggaagaatgtcatgagcccctttcatctccaaactggattttaaaacaatgtggaaaaactgcttcctcccagggcacatttttctgttacttcttgatttggctttttttttttttttgacatggtgtctcactcttgttgcccaggctggagtgcagtggtgtgatcttggctcactgcaacctccgcctcctgggttcaagcaattctcctgcctcagcctcctgagtagcttggattacaggcagctgccaccacccctggctaatttttgtatttttagtggagatggggtttcaccatgttggctaggctggtcttgaactcctgacctcaggcaatccacctgcctgggcctcccaaagtgctgggattacaggcgtgagccaccgcacctggccttttgattaagcttcacagacacccttcaatatgaagattaggttccttgttgcatacatcatttgctcccctgcattcattgaattctacttgattctctgtaacaagtttcattgatttgatgttttgcagaaccaattctgttttggactgcatttctgggatgttcttaattgtcttatcattttatcctaagcttcttttaaaccccagtgtaaccttgattgattttgaaatgccacctttcatcttttcgggaatgaatgccaagtgttctctgcataacactgtttgaatcttgtagttgttccattttggttaccagagtccagttccggattcattccccttgctggctcctagggcttagagctcctgccacataatgaattttcactgatccttttttttgcaccttgttgttgtttgttttctgtttattgatattcttagtggaggagcctgttttgtcatcttaagtttttaggcagtgttgtcattatcgttgtgttttgaaacggtcttgtattttatgttttttcctgatgtaactgttactctaaaaaatgaagataatttactgaatttctttttatctttattgtattgtgacaataaaattaaaaattctgtcttaaagtagagaggattgtaaatgtacccccacagaccccatctgtcacctggtttttactaatgttcagtttttcaatctttttcgctcccaccccacagacacccttgttcgtcctggagtattttaaagcaaatcccagatactatgtcatgtcacctgtaaatgtcggatattatatcctggggctttgctgatgtttcctcatggaatttaacttgcttctgtagacccttgtatttgctataaactgctggttagaacaagggcagcgttctcaaacattttgggctcaggaacccttcacaatcttacaatttattgaagacccccaaaatgcttgtattgagataggtcatacgtattgatattttgcatattagaaatttaaacagaaaaatttaacacatcaggagagataagcacttcctcccttggccattagagagctgatgtcaggctgaggcaggaggattgcttgaccccaggagtttaacactagcctaggcaatatcatgagaccttgtctccataaataataataataataataaaaaagccaagcgtggtagtgcacacctgtagccccagctacttaggaggctgaggtggtaggattacttgagtccaggaactagagattgcagtgagccaagatcgcaccattgcacttcagcatgggcaacagagcaagaccctgtcacaaacaaacaccaaaacatgaagagagagagagagagatgatgtcgtgatatatcatgcagcttctggaaaactctgctgtacactttgtaaagaatgagagtgaaaagggcaaataagtctttgtactattaagaaagtagttttgattttgtggactttgtgaagtagctctgggggaacgccagaagcctcagaccacactttgagaacccctgatgtggtgactcagatacattcaacttcatctttgcttttggaggggagagggcaagtatacctcctagggggtaatgtgcgcttcttacaacacacacacatatacgtatattatacatatgtaacacacatatacacacacacaaatacacacacatacatatctacacacatacacacagacacacacacacacatatacatatatatacagacatacaaatacacatatatacacacagacacaaacacacacatatacacatatatacacagacacaaatacgcacacatatatacacagacacacaaatgcacatatatacacagagacacacaaatacacatatatacatacacatatatgcacacacacatgtatttttattactatagtagttatataactactttatgtctgggagtacaactttaataccttagtcatttattttctcctttattgttatataatttccatgtgtgtatttgtgtgttaattttccacttaaaaatttttaaaatttgtttttagttttattttgtttgagacagggtcttgccctgttgtttagcctgcagttcagtggtgtgatcttggctcactgcagcctcaaccttctcagctccagtgatcctcccacttcagcctcctgagtagctgggactatgggcgtatgccaccatgcacagctaattttttcgtgttttgttttttttttttttttttttgagatagagttttgccatgtggcccaggctggtcttgaactcccatatgatcgcccaccttggcctcccaaagtgctgggattacaggcatgagccattgtgcccggtgcttttttttctttcttttttttaactttgtatttttggcttcaattttcatttgcgggtatattgttgcacttgcatttgattaacccacttttgtattttagtcctagatgtgtttagttttcatgagccttcagtaatcagcatattgttgcatttgatttaccacagatggagaattttcttctcttaatcagaccaattaggttgcttttatctagggatgtgactgttagatttcaaataccttatatcattctggttttcttttttttgttgttgttcttacctctataagtcatgccctcctttttatttatttttaaagaagtacctaagtcatgtacatagtcgttgttaaaaaaattcaggctgggcatggtggctcacgcctgtaatcccagcactttgggaggctgaggtgggccgatcacaaggtcaggagatcgagaccatcctggctaacacggtgaaaccctgtctccactaaaatgtacaaaaaaaattaactgggcatggtagcaggtgcctgtagtcccagctactcgggaggctgaggcaggagaatggtgtgaactccggaggcggagcttgcaatgagccgagatcgcaccactgcactccagcctgggtgacagagctagactccgtctcaaaaaaaaaaaaattcaataatagggaaatagagtaaagcaatagcccatctccaggctttccagctccatgctaatttgcactgtgggtaatgtatcgtgcaactttcaaaacattttctacacatattggcacacgcagaaataaaataaatgtataagttttatggcttttaaaaatggtaggccgggcgtggtagctcactcctgtaatcccagcagtttgggaggccgaggcggatggatcacttgaggtcaggagttggaggccagcctggccaacatggtgaaaccccgtctctactaaaaattacaaaaattatccggcatggtggtgggtgcctgtaatcccagctacttgagaggttgaggactcttttccctatggtggggcacattagtttcatcttctgttgtgtttttgttctttccttggagttgcttattctggtgcccagggtgcagctctgctctgctctctgctggccccaggacagctgcaaaaccctcctaagaattgcttccactctgctatgtttcgtgtcctgtttccttgagcagcagcatgagttttaaatataactgtagggttttacttgattctaagttcaaagtagtgacacaggggtccccaacccctgggccacaaactggtctgtggcctgttaggaacctggcctcacagcaggaggtgagtggtggcaagcgatcgaagcttcatctgtatttacagctgctccccattgcttgcattaccacctgagctccacctcctgtcaggccagtagcagcattagattctcataggagtgtgaaacctttgtgaactgtgcatgtgagggatctaggatgagtgcttcttatgagaatctaatgtctgatcatctgtcaccgtctcccatcacccccagatgggagacagtgacatctagttgcaggaaaacaagctcaggggtcccactgattctgcataatgttgagtaagtagtaataatagcagtaaagtgcagaataaatgtaatgctcttgaatcatcctgaaaccacccctcccctctagtctgtggacaaattatcttctatgaaacttgtccctggtgccaaaaaggttggggactgctgtagtgacaataactcacatttattgaccaggtactacgtgacagtcacctcagatgtcccatctcatatgatatttgcagcaactctattaggtaaacactatttttgctttcattttacaaattaggtaagtgaagcatagagaggttaaataacttgagggtaattcttccaagggggtggagtcagattcacacccaaacaatctctcctgtctactgcattgtcattaagagtgatgaagagcccaagaaccagcctcattctagcctttaccaatatgtgtatctctttcttatttttggtttactttctcagaatctttggttctagtagatttttaaaattaaacctttgtttcctctgccatctctgttatctctttctggaatgcttctgtgtcaggtgctagatctcagttgatcacttgctttttattctctcactttttttggtcttttaatttaattttctgaaaaatttcttcaatttgatcttccaactcttctggagttttaaattttttgttatatttaatttccaagagcctttcttatttcctgacttttcctttttctaagtatcctgttcttgtttaatgaatatggtatctttccctcgattctctgaggatgataagggggtttcccttgtgttctgcaaggggtctgtctactccttgctccaagtgtattttacctatttgtaggcttttatgtctgtcctcatatttttattttcctcaaatgtctggtgatgctttgttcttttgtatttatgaggaaggcactaatatgtttggtagctttctgtgcattgtggtggtaagaggaagccaatggttctcactggtaggtgctctggcaggtggatggctgttttgctgggtgtatgaaatgaattatgtccctccaaaattcatttgttgagtcctgtgaacctaagttctctgaaaagtaatttggaggaaagagacttcattccagtgaatagtttgcaaacaagggagccacgtctttggtgtaaaacaaaggtgagttccagagaacaaatacgttcagggtttatagcaaaactccctgctgaggttcccaattaagtccatttatgcaaatgaaggatttggacttgcttagttctggttggtcacacagccgaatcatgactggttgatgtggttgaaccctgactggatggagcgggtgagctctgattggttggtttccaagccccaaaccagaagtctctgttagacctttcaaaaggccagttgggaggtgggggaattcttgcttcagtttatcttggcaccaacaacagaaactggtttggcttgattgtagaaagggaggtcctgtgatattttcataacatctttctgagaacacattgtacgtgactttcataacatctttctgagaacacagtgtatgcgactgaaccttcacccagccatgaccacctggttctgctctaactcaccctaaatagccatggggtgtagttcattttatctgtcagcagaggcatacttttatggtcctaacctcaagtatctcggaatgtgtctgtacttggagatagggctttgaaagagaaaatgggagttaaacgaggtcactggggtggcccttaatccaatatgcctggtgtcctcgtaagaaaaggagattaggacacagacacacagggggaagaccatgtgaagacacttggaagatacagccatctacaagccaaggagagacgtctcagaatgaaaccaaccctgctgacagcttggactttcagcctccagaactgtgaaaaaataaatttctggtgttcaatacacccccctctgtattagtttgtaatggcaaactaatatatgaagtgaagcccaaatacccatatctatagatctttcctctagggctattcagttttcctagagaggaaacttctagtattctgctgggagtctaggcctgctgtgtgcatgctgggcgctgagcctcatgaaggagctcaggactctccatctgggatctagactttcatggaactttcctttgctcccattaccccttgcccttttctgtgcctgggaccccagccctggagcccctagtgggaggtactcagctgtctgggtggaattggcacaggggtggactatggaggactaaggggagagcagcattctatccatgttcccacaaaagacaggatctcctttttcatggctgcatagtatttcatggtgtatgtgtaccacattttctttatccaatctgtcattgatgggcatttaggttgattccatgtaaccttatacagaattacagccatgctttttttttttttttttttttttccaaccctacaacttgttcctcacctcccggagcctcctctctggggtcctgggcatgaattaacatctccctccgtagccaattggaattccactcggctgacttctccttcatttcttctttcaaacttctgttcgtgttgcctgtctgcagtctccttttgctttcttgtccttgtaaatccatagattctccctgctatggactgaccataagggactaattgatagtgcagtggtcaggctgatgtcagcatgcttctgcagtggaggaatctgacccagaaactcatctctttgcatctctgcacgctgctgcctttgatgtaagcttcatttttaactttgtgttttgaaatagttttagacttgcaggaaagttgcaaagataatacagagagttccctaatggtaacatcttacgtaactgtggtatgatggtcaaagctcataaattagcattagtacaatactgtcaagtaaactacagaccttatttagatttttttttttttttttttttttgacgaagtctttgtttcctaggctggaatgtggtggcatgatctcagctcactgcaaacttcacttcctgggttcaagcgactctgctgcctcagcctctggatgagctgggattacgggcacccggcaccacgcccggctaattttgattttttagtagagatggggtttcaccatgttggccagactggactcaaactcttgacctcaggtgatcagccagcctcagccttccaaggtgctgggattataggtgtgagccaccactgctggcccttatttagattttaccagatttcccagtaatgtgccttattttctgttcccaaatccaatccagggtcccatattgtagttcattgttagggttccttagtcacttctaatctgagcctcacacacccaggctggagtacagtggctcgatctcggctcactgcaacctctgcctcccaggctcaaatgattctcttgccttggcctcccgagtagctgggattacaggtgtccgcaccacgccaggctaatttttgtatttttagtagagacaaggtttctccatgttgtccaggctggtcttgaactcctgatctcaagcaattaacccgcctctgcctcccaaagtgctgggattataggagttagccatcgtgcccagcacctgaccttcttacttttgaagaggactagtcaggtgttttgtggaatgtttcttcatttgagtttgactggcttttattcatgatttgatttagatttgggggaaggacatcagagaggtgatgtgtccttctaagtgcatcatatgtcttactactggtgacgttgttactgattcttagcttaagatggtttctggccgggtgcagtggctcgcacctgtaatcccaacactttgggagaccaagttgggagggtcacttgaggccaggagttcaaggccagcctggacaacatagccagacccttcctctacaaaaaaccccccaaaattagctggtcaccgtggtattcacttgtagtcccagctactctggaggctgatgggggaccatcacttgagctcagcagtttaaggttgcagtgagctttggtcacaccactgcactccagcctgggcaacagggagagaccacctgtccccctacccccaaaaaagatagtttctttcaggtttttcctgtaaagttacagtggagtgtagaggtttcttcttatgtaattaatatatactcggaggctatgcaaatatctaattttttttctcttaaacttttgccaactatttttagcattcactgatggacgttgctggcagtctaagtggtgcgtttctagctctctcattcctcccacatttattaattgaaattcttctgtaaggaagaattgtcccttctatcccagttatttgtttattcagtcatgtatttatatcagtatggacttatgaatatttattttaacctttaagctatatctaatactatgtttatttctcttcttgctcaaattgttctagctttgaccactgggaactctttcaggttggcttctgtgcccttttgacatgaccccataatcccaacttttttttttcgagcacttaactttttcttttttaaaaaaacttttattttaggttcaggggtacatgtgaaggtttgttacacaggtgaactcatgttacgggggcttgtcgtacagattattccatcacccaggtattaagcctggtacccaatagttaccttgtctgctcctctccttcctcccaccctccaccctccatgctcaagtagccccagtgtgtgttgttccctctttgtgttgatgtgttctcatcatttaacctcccacttattagtgagaacatgtggtatttggatttctcttcctgcattagtttactaaaggataatggccttcagttccatccatatttctgcaaaggacatgatctcattcttttttatggctgcataatattctgtggtatatatataccacattttctttatccaatttgtcattgataggcatttaggttgattccatgtcttgattatttcacttgtattttgatgaggtttcagaaagaagcagagaagcaggtgttcaatacatttttatttttatttttattgttttttatgtctgttgcccaggctggagagcagtggtgcgatctcagctcactgcaacctctgcctcctgggttcaagtgattctcctgccttagcttcctgagtagggtagtcatatgccaccatgcctggctaactttgtatttttagtaaacggagttttgccatgtcggccaggctggtctcaaacctctgacctcaagggatccttcgccttgtcctcccaaagtttcgggattacaggcatgaaccgagcctggcctcaatacattcttcctaaacttttttgatcatcaagattttctttgtttcttatgatgttttccattattttaaatttatattagctgtcatctaaacaaatcatctctgcagtggacatctgtttgagagagtgcttccagttctcatccttccaagaacagtaacctgaatttacttcccatccttacccatgtgtgcttgggggctgatactacatgtaggtgtaaaccacgtggtatatccgtcctggtcaaagccagcaaaccacgagaacaccttttctagggcttttggaaaggggaggtttctcttccttgcaaggaagctgccagaggaactgttctttctttggatggtgatgtgttctgaaacaacatctggagctgctgtagccactggatcactatgagctgaggctggaactgctatgagagccccaggtggagcccagcctgggaggaagaggagttccaaagaatcagcaccttggggttttgtttgagtttctgttgtaggaagcctcacctaaccttttgaatattcaacccatgaaccaaaatactctattgttgaaaccaatctatattggttttcttggcaacttcagtcctaaccagcataaactcattattttattttttttctttttgagacagagtctccctctgccacccaggctggaggggcttgatctctgctcactgcaacctccacctcctgggttcaagtgattctcttgcctcagcctcccgcgtagctgtgactacaggtgcatgccaccacactcagctaatttttgtatttttagtagagatggggtttcgccatgttggccaggctggtcttgaactcctgacctcaagtgatctgcccgcctcagcctcccaaagtgctgggattataggcatgagccaccgcacacagcccatagactcattcttacagaaattgtgcttcactaccttaaattttcaggtagagcatgcactagggattattatatctgagtcgatctgcaaatattttgaagcaaacacatcttattttctgtttccaggctggccagagctttctgctgcataatggcggcagcgattacattgcacgttgcttctttgacatctgagatgtttgaggctggaaactcactgcctcaggccttctgttagtgagaaacgccaattaagttcagtgaataaattgagctgcatgttagctttcagacacagagaagttccgtactgtatctaagaaacttcccgaaatgtcttgttccagtggatgacgtaacttgtcgtttgactaagaaattgcatcttaggaaattatctcaaggaaataagcagacaagtatttatacacaaggaaggtataagccagaggattactgccatgctgtcattccccgggaaaattgggtatagcatttaaatgagcaataatgggcaattgattaagtaaatgatgatacattcatggcctgccatgctatgcagccattaaacaatgatgttgatgtatatttttgacatgaaattatgcttatggtacactattaggttaaaaaaagagacaagttatatcacagtaagtaaagtataattgcattttgtaaaaaattgtgtgtatacatatgcatataaatgagatgtatacatatatatatgcatgtaaaagattagaggatatatcattttgaccttttgatgacttgctgtttttctagatcaaagctatatggtttatgagcaatatattaataaagaattaactatctttaatttgttgagtaaataaactaaaacaagaatgagctatctgacaccagggtccttctttaggaacttcaattttggaacaatgaatgaagtgagtagggcgcttctttaatatctaatcattttgtgaactgttaaggtcttaagtgtctgtggtttggatatgtctcctaccatctgcccttggccttcctggtggttggcctgggaaccccggggtggagacagggcttctgtttggagagcagcagagcaaagttgaacatcaaaagccatgggcctggattctaatttggaaacctcctttttctatcttcgtggtctaggccaactcagtcctctgttccactggggcatgatgaggttggctttcttttttctttttctttgagaccgagtcttgctgtttcacccaggctggagtgcagtggcatgatcaacctctgcctcccggtttcaagtgattctcccacctcagcctccaaagtagctgggattacaggtatgcaccaccatgcccagctaatttttgtatttttagtacagatacggtttcgccatgttggccaggctggtctcgaactcctgacctcaggtgatccaccctcctcggcctcccaaagtgctgggattacagacgtgagcaactacacctggctggccgtctttacttcaaagcagtggagtcacagagccttatacatgaatggaaagtattgccaaaaggctccgtggtccttttgggtctcctttggaaaagaagctgggacatttgctttgccctgcccccttcctatgacagtccgtcccccctctatgtgctgccgtccaaggaaccacacttctttggaacaaagggagctgggcaggatcatctctgtcccctccagcttttgagcccctccttgaaatctgcatttaaagcattcagaagatgctgagcatgatggctcactcctgtaatcccagcactttgggaggccgaggtgggaggatggcttgaacccaggagttcaagaagagcctgggcaagatagggagacaccgtctctacaaaaaaaaaaaaaaaaaaaaaaaaaagcaaaatgcaaaaattagctgggcatggtggtatgtgccagtagtcgcagctacttgggagactgaggcgggagaattgcttgagtgcaggagttcaaggctgcagtgggccatgattgcgcaattgtactccagcctggatgagagagcaagaccctgtctctaaaaaatggaaaaaaaaaaaatcattgagaagagagaacccagaggttgagatgtgctggtccctgggagaactcaggggagatcccagttctctggaggccagccgtccaaaagcatttctcacccattttcctgcatttcatggacacacaatttggatgcctaggggtttttcataagccatgattatgtttttttggcgagagacccctgttatccctcctaccccccttgctagatggcttaatttcgtttgctctcaccatttgatttgatttgatggcatacagcatgaggttcccaaatcatttctgcctgttaagcaaacatatatttctgggattgatgttttaatttaatgaaatacattctaatgagggtcagctgcagccatgaatttttttatgagtgatttgccaaaaaacccattgcctggtgacattctgtgcttggctgagcgagtctgagagagagtcctggttccagctcacgggttgaggaagagacacagggcaagattctgccggtcgtggcatgcctggatttccatgctaggtgctatgtcggtttctctgcttctgtgctggtggctcatcagatgccttcttccctggatatgcataggagtaattcagcccgatagaggaggagacagtggcctgagaggaccccagtttggtgtttgatccagggctcatcttcaggatacagcaaggcagataatgaggagggacttgcttggtgtgtgtgtgtgtctgtgatgtacacgtgtgtgttggaggccagggtgggaaggggcccacacacagcccagctgtctctaaacagcccctgatgtcccagccaagcaggagtacaggatggctggactctgctaaaagctcctaactcaacccagcaaacgttaagtctatgctagtggccatccctggttccatctgggacctgtgagaagtcatggaatcaaccgtccacctccactcagctcaggtgacctggggccaacacagctggtgtcctgtctagaagccattgcccttgaatttgtttcctgtagcccttgtaacaaattgccacaaacttaaggccttcaaacaacagaaatgtatcctcccaattaaggaggccagatgtccaaaatcaataccacggggctgaaatcaaggtgtcagcagggctgcactccctccagaggctctagaagagaatctcttccttgtctcttgcaggttcccgtggctcccaacattccttggcttgtggcggcatcactctataatagggccagcatcttccaatctttctatgctttgtcttcacctcaactcttttctcctgcatgtgtctattgaacttcccctgcctccttataaaaacttgtggttgcattttgggcccctttggataatccaggctaatgtccccatctcaggagccctaacttgatcacatttgcagagaccctgtttccaaataaattaccattcatgggttccagggatcaggacttgctatctttgggtggcagtcgttagccctttttttttccctcctcggcaaagtactgatttgatcctacctggccaatacttatattgcaggctgttcagttcccctatgcctggatcatccagggctggggcttggttctgacccgtgacgtgaaaggcaattcaacagtggccgcctgggatatgcttccttcaccgacagagcagtatgcggaaagagtcctcctgccttttcctctttgccccgggtgctgcattgtgacagcgtgattcttggaggagatatagccattttatgatcatgggtggatggccaagagaatcgtgaaggatgtggcccagcgctcagatggtgctgctgctgcctctgcatctttctggctcaggccactgcgacttgggagttgcagccagaaggctgtcaacggacccaggattcccctgggaggctccttctgccttagcagactggccagcattggcctgagtggctttagcggggacggtgagaccaagatggccccgtctggacccagactcatgttttggagcgtttcctggctctttcgtcagcctcagtccatttggacagctgccagctgcatggtttggtggtggttgtgagcttggctctctgatagccgatgagtctgaagagtaaggccaaagcaaggaaatctacatatgggaggcacatttagggacacttgtgatccatttctattctcactgtgaagaggaatctcccagcagtctccaaacagcccctgatgtcccagttgagcaagggtacagggtggctggactctactaaaggtgcctaactcaacccagcaaacgttaagtctatgctactggccagccctagtcccatctgagacctgtgagaagtcatggaatggaccctccgcctccacctagttcgatgtctgtgacaagctgtgccccaggcagggcacattctcacttgggtcacctccgtggccggaagggtaataatggaaaaaagccaagagcggcagcctgtgtctgtggactgagccagaggccagctgggcctgtttgcttggcttgagctgcagagtggatctcaggcattgcccagcacaggccttggagaaaacatggtgctgagcatgtgttaggcagaggctgcaaggaagagccaaggagaataggcccagtgagtataggggtgagaggatggaggggtttggcctggagaagagaaagcaaagggtgtctctggtataattattgctgctttttctctgtgtgcctcccaactccccatgagacagaatgtcaaatatcaggtaactggttaaaattaaagtggagtactagtatatcatttcagaatactttcagcctcaagaaacagaaagccaactaatagcagattgaataggggtttattttatatacaaccaagaatttgggaaggagctgccattgcatggagtgagaagctaaaggtcaaggcccccctcatgggtgcaaagaggctaccatagctccaggcatgcagcccacgttcaagaaacagggagggaagttggtaccagcatcaggagaacaacagctttctcttcttttccacgcacaccccctcccctgccaccagccgactttccctgtgttcctttggtcagaactctgtcacttggccacccttagctgcagaggaggccggcatggtgagtggttggggactgtggatgaggactggttagatagccagtagtgttggcacagtgccgcttaaggagccttggtgtctgggcacctataggaagagagcagacaaccatcttcattaggagccatggaccctgcccgggaggttaggagggcatccagacccatccctgggtgtgtttttggtttttcagatccccttcgtgagcatgctggggagtccgccttggttttccaaagatagagcacatgagacagtggttttcaaagtgtgtgccccaaaccaacgtcgtcaagatcacctgggaatgtgttagagttgtaaagtcttgggccccaccgcagactcattgaatcagaaactgtagcgtgaggaccagctctctgtgtctgaacaagccctctgggtaatactgatgcaggaacaaatttgagaaccttagacttaggatttctgaaatatgactatctctggggagggaagggaaagaaaaggaatagtaagaaattcattcacatttgtaaattattcctctttttcttaaggtgatctaagctttaaattcactttccccattagtaataatcagtgaaattcatgagggaatttcatctgtccatggttcatgttggactgaaggatatttttgctgttttttttttttttccagtagaccctgggatggttgaccttagacttgaatcttttgggagcttgtttacaatgcagatttctgagctggtatctgggttttcccccagatatttggatttagtagatataggatgggctcaggaatctgcaacatggcaggcgatttggatacaggtaatctgcaaactgcacctggagaagtgcaagtccagagcttgctatggaagagagggtggatggaaagatgggtgttttagtcggcttgggctgctgtaatgaaataccatagactgagtggcttaaacgacagacatctttttcccccatgattctgaaggctgaaaagacaaagatcagggtgccagcatggtcagatactggtgagggctctcttcctggtttgcagttggttaccttctcattgtgtcctcacatgacagatagagcaaggagagaagaaaggagagagaaaagagaagaggggagtgggggagggagagagagagggagggagagggagagagagagagagggagagggagagagagagcgctttctagtctcttctttctcttcttataagggcactaatcccattatgagggccccaccctcatgacaccatctaaacctaattacctcccaaaggccccaccttcaaataccatgacattgcagggatataggttcagcatgaaatttaggggaggcacaggcattaagtccataacattggggaagtaggttctcagtggctcctctcccttgggttatatgagggtctttagtagcttcagaattccctgagttgtattcagagtcaccatttgctttggagaattctaggattgctacatagaccagcgaacatggggagattcagggagtgtgagcaaatattgagaaagagagtttgggatgtaaggtcatgagtcataaagtgtgtggatgcgcagtccttctctctgaggggatctgccaaatccctgaggcctacacatttctgtccttagatttcttgttctttctttctgtaattactgcccaccactgcccccaccccaccatctcatttgtgcaggggtgaaagattgaacaccttttgggagccttggtggtcagggtcagtgggggtggtgcagccttgcagaacatgctctactgccactgaccattccagggttacttgtattttagccaaagcagtggggagtaggggggagtcacagatatagggcataggaaagcaggagttagggactaggggggatttaataagtgattggaagtgatgcagggcaggtgagccctaaaattggggcttaacctgggaaggtttttggctttgctcaggaaagaattcaagagtgagccagtagtagaagaaaccagctttatggaggcattagtgttacagctctgtgactgctcctgcagagcagggctgccccataggcagtgtgtggagtgcagccgctcagggtccgtgctgcagttctatttatacccacttttaattacacgcaaattaaggggtgggttatgcagaaatttctagatgaggggtggtaacttctgggtgtggccatggcagtggtgggctgtcatggtgctgatgggtgtatgttatggagaggtgcttttggtgcctcttccgtaatttagccagttaccaatctcgtccaaagtccagtcccatctcctatctcagaagtagcatacatttccacagtgagttccaagttcacacatattgtctcctttaatcctctcaacaaccctgtgaagtaggttctactccctgcattacagagggggaaactgaggtccagagagctgaagaagggcttcttcaccaacccggaagaaagccatttgaaatattcccgtgttcggctgctaaccctggtggctctctgccccacactcctgttcctccatctttctcacaccttcctttccaagtgtggagtctatgagttattgagctgacaagcctggggcagtgtcaggggtaagagccaatccctaccttgtggcttttgtcccatgttcacaggactagggtgaggtgttggagggagagaggatggcgagggagctgggcagtccctggatgagcgcatcctccatcagcatcgtgtcttctgttctgaaggctcccaagacagtacctctgtgagggactcatatcagctgaaagttaccttcaacagaagtagaccttagaaggccaatgaattaaattgcaaagagagatagaactgctccagagcctagcatattctcattggcatgatctgtgcaagagttccctgttggccatatgggaagccaggatgatcagaaggttgctctgggagcctatattcaggacaaggggagccggatgaatccagcctgtgatggcaagagtctgggatggtgggtgcatctctactgcctgatggtaggggtggccttgcctttggggctctcattctctggttctgtgctgacccacagcccttgggagcacacatgtattagtccattctcacattgctgtaaagaactacctgggactgggtaattcataaagaaaacaggtttcattgactcacagttccacaggttgtacaggaagcatgacttgggaggcctcaggaaaatcatggtggaaggcaaaggggaagcaggcacgtctcacatggccagagaaggagaaagtggtcaaagagggaggtgccacacacttttaaacaatcagatctcatgagaactcactatcatgagaacagcaagggggaaatctgcccccgtgatccagtcacctcccaccaggtccctctttcaatactggagattacaacttgacgtgagatttgggtgggacacacatccaaacccaaaccatatcaacacacttcttgctttgggtggtttagcacaaccaaccaggctacaatcggagagctatcctgtcacttttaggtagtttgcatgatcagtttctgagctatctgtaaggacattgcatttaattttataagtttatttatttatttgagtcagagtctcactctgtcgcccaggctggagtgcagtggcgcaatctcggctcactgctacctctgcctcccaggttcaagctattcttgtggctcagcctcccaagtagctagattacaggcatctgccaccacacccagctaattttttgtatttttagtagagagacagggtttcactgtgttgcccaggctggtcttgaactgctgagctcaggtgatcagcccacttcggcctcccaaagtgttaagattagagatgtgagccaccgctcccgacccattgcatttaaccttgaagtacaaaccaaggaggagggaaggggtagggtgaatggagggaaactaaactgcacccactacaaactgagctgcctgtcctggaacagagcttgctttcatccgtggtcataatgaaccatgttgacatggaactttctagcaagataaaccacagtgctgaaccagatgcgttatttccactgttcaagcaggtttccatattagggatgctgactcctgaatttggggactggagatttgttctgtgttgccaggtggcctgggtgtctaagtgcctttttgtaccttgtctcctcctgcatagtgactgttgggtctcctgcctatgcagaggacgctggaggtttgattttgatcttaaggataaaaagttcggtctgttcagcggggcgcggtggctcatgcctgtaatcctagcactttgggaggctgaggcgggcagattgcctgagctcaggagtttgagaccagcctgggcaacacagtgaaactctgtctctactaaaatacaaaaaatcagctgggtgtggcatcgtgcgcctgtagtcccagctactcgggaggctgaggcaggagaatcacttgaacccgggaggcagaggttgcagtgagccaagattgcgccattgcactccagcctgggtgacagagcaacactccatctcggaaaaaaaaaaaaaaaatttggtctgttcgttttaggtgttgcccgtggttgagaatcagaccctctgcccagggtttgtgactttattgcacagaaggctgcatcacccgcaaccgtcatcttaatactgccaccgaatttcattttgctgtttttgtttgcgaaggacctggagtgactcggatagaattactgctggaataaatgacgtatgaaatgagaaatctttgtccagtgttgcaagggggagggagagaagaaaagaaaggctttgatggaaccgctgttgtacagaattagtttccataagaccagaaaatacagaagaacaaaataaaacgtcatcagatatttttctccagatttactgaaaagtcaggcttttatcaatctcccagcaccgcattcaggctcccagtgatggaaagtaatgggtcttgcaccaaacgaaagcaaacttctatttagtctagcctgtggcctgggttcccccagctccagcaccgggaagcatgaggaagggggtgcccttctcctcaagctccactccttcttcatggggacaagctccactccttcttccttccatctggttcccagtgtccttggatttgcatctcctgtgccatttaaaagtctgctcttggtcaggcacagtggcttacgcctttaatcccagcactttggcatgctgaggcgggtggatcacctgaggtcaggagttcgagaccaggctaaccaacatggtagaaaccctgtctctgttaaaaacacaaaaattagccgggcgtggtggcaggcacctgtaatcccagctacttgggaggctaaagcaggagaattgcttgaacccaggaggtggaggttgcagtgagctgagatcgcgccactgcacttcagcctgggtagacagagtgagactctgtctcaaaaaaattaaataaaaaaaaaaataaaaatctactctcttaggaaaagagctgacaaactcacttacactgaggtgtaaggggcggctgagggcttcattgctaccctatctcagggtattttaattttcaatggtgtaaaactgagctccaaagaccaaactgaaacttgctgcaccagaaagcaaactgctttgtcaaggccactggctgtaggtttcagcaataccattgtcctcacagcctcactgttggacgggcctagtctcctgcttagggcgtttttctccagggctctgcaaactacacatcctgggtgcctgcataattggctgcctataggggtgccttgttatctttttctataagatggggaatacattgctttgccttagacttgctgtcatctgtcccacctgggagggacgggctggtgttccctctgctgccaaacactcctggatcgcaggatgcaacctccaggctgtgtgctgatgcaaccgaacaatagcaacaagaaccagaaacatggaatccaggccagccctcggcgggggcacctgcccttgacctccctcgcagcacttctgcggggtgtttacaaaaactgcacctgctctaatagctgatggtcgtgctgggagaaaataataatctaagccattagagagagagaagaaaagaaagccaggacggggaagggaatgatccatcctctgctctatttttgtctgtgctccacgctcactgagtgtccttgagggagatgcctaagttctttgtcttggtttgttactgccctggcaaaatctcatgcatcgcctgccagaacacccagggaatctcgtggctccctgacaatgcacaaacacgctgccacattcttttttgggggtccagagagtgggaggtagggtcaaaaaccacgggagtggaactgaaatacccccattcatccaatcataggcagatcgcctccttctttaaattgcctttgaaaaatagctttattgtctccgtatgtaatgcaagtaggcattcccccggcaagttcgggggagtagctgacatttgttgactgtttactgtaggtgtgaactttatatgcaccatttcacttgatccccattttcaagatgagagaattggggctcagaggggtgtagtcatttgcctgggacggaacaggaagatgtctggaataagggccagccctgggtagatgtggtggctcatgcttgtaatcccagcgctttgggaggccaaggcagatcgcttgaggccaggagtctgagaccaacttggccaacatagtaagatcccatctctgaaaaaaaaaaaaaaaaaaaaagaaaaaacagggcataattgtgtacgcctgtagtcccagctactcaggaggctgacatgggaggactgcttgagcccaggagcttgaggctactgcgagttataatcaggctatggcactccagcatgggtgacagagtgataccctttctcaaaaaccaaacaaacaaacaagtaaacggaaaatagccagccccagcacagagcttagcacacagccaggggcttaataaataattagtggctaaataagagttttggaactttttggggatgttttcccatcaccccactgcctcttaatgcctcagtttactcacttttcaaataggagtgtggactggtggactagatctttgtgtgtgatggggatgcgttagggggcacccgtttctatccttgctgagtttgaaatcacttgagaaataaacacgggaatctgaccaatggagtgaaaaatatccactttatttattgagagaagctgtgcttaagggcgtggcttagatccatggccacagtgagtctcccactaatccactccactatttaatgtattcagcaaacagagccagagctgggcagctcccctgtggcacagagcacattccataaggcagagggcagagcagccacactctctctctgagcaggcagaactgtaggagagagccccagaggaactgagccaagagcagttactttcttttgcagtatttcaggcatggaggggactctggttccagggtgggaggcagggaaggtgaggggttgggaaagaggtctctcccagaagcctttcacatttgcatctagctgcattcggaatttatttatttatttagagagacatggtctcactctgtctcccaggctggagtgcagtggtgtgaccataactcactgcacccttcaacttatgggctcaagtgatcctcctgcctcagcctcccaaagtgttggggttacaggcatgagccatcaccccactgcacctggtctgtgttcagtatttattataaatgatgggctaaatattgaaaggtggggaaatgaaggtctcgccagccctgtgaatgactgggattctgtgtgtgttctggcttccaagtgggataatgaaatggtgcctctctctgtgtgcggttaaacacccattcataccacaaggaggttgtagtcagcagcctgtctggtggccccgtgggggtctccagcatttatacccttgttaatcctctcccctggaatgtgggtgggacctattgactcattctaataactacaatgcagcagagaccatgtgtgccacttctgaaattaggttataataagactgtggcttctatcttagggtgtgccctctctccgtctctcatgtcactcacctgggagaactcagctgccacaccgtgaggtccccttgtagataagccacatggcaagggcttgaggcctgtcagcaaccgtgtgagtgaatctggaggagaattcccccttgtccccagtcaagcctagagatgagcctgcagccccagccgacagtcccattgcaatctaatgagacaccttgagtcagaggcaccaagctatgctatgcccaaatttcccacccatagaaactctgggatagtaaatattgtttgggctgggcacagtggctcatgcctataattccaatgctttgggaggctgaggtgggaggattacttagggccaggagttcaagaccagccttggcaacatggtgagaccctgtctgtacccccccccaaaaaaaaataaataaaaattagctgggcatggtggtacatgcctgtagtcccagctacctggggactgaggcaaaaggatcacttgagcccaggaattcaaggctgcagtgagctatgattgtgctactgcaccccagcctagacaacagagagacaccctgtcttgaaaaagaaataaataaatgaaataaaaaaatactgtgttcatgactcagttggggtaatttgttatgcagcaagagagatctaatgtcaaagccctttctcttttcttctgagaggttcctgcatgacagcagtatctagaagggccagtgatgctttaaccccaaggcttctgatttcacgaagcagggctggatctctgaaacggcacagctgagcagagcttgggattgtttttcactccaggccccaaagtagggacacagacaagctgggacatgtgacgaggctctggaaaacaggtttaaaaataactttactagctcacactctgaaatttaagccatccatttaggaaatgctgagtgtggctagaaaaatgagttttacattgttattcttcaagaataaagtgataagtgacttcagagtaaggggaagtggttgtttgcagagcttattaaaaataagctgtcatttctgtcctatattacatttgagtcactgggagttaaaactcagttttcttacatttgggtgttttaagagactttggacatattgaaataaaagaatgcctcacagttacacagaagtgacatttcccacgttttcccttagagggtggaacgttaaaagcttgcctaactcttttggatccttacctagtagctacttcacagcctggggagaagacagaagtagacagagatgcatgcctgtctcagccgagaccggagaattgtcaattgtatttagatgagatataatctcagatatcaaatgtattttttcgttgtttttaatttcagtttttattttggattcaaggggtacatgtgcaggtttgttacaacggtttattgcatgatgctgaggtttgggcttcaggtgaactcatcacctaggtagcacagtatccagtaggtagtttttcaacactcacttcccttcttgtctccctctatttggagtccccagtgtctgttgttctcacctgttaagtccataggtacccattgtttagatcccacttataagtgagaacatgcagtatttggttttctgtgtctgcattaattctcttaagataatggcctccagctgcatccaggttgccgcaaaggccatggttttgttcttttttatgcctgtctagtattccatggcgtatacgtaccatattttcttttttctttttttccttttttttgagatggagtctcgctgtcgcccaggctggagtgcagtggtgcgatctcggctcactgcaggctccgccccccgggttcacgccattctcctgcctcagcctcccgagttgctgggactacaggcgcccgccacctcgcctggctaattttttgtatttttagtagagacggagtttcaccgtgttagccaggatggtctcgatctcctgacctcgtgatccgcctgcctcttcctcccaaagtgctgggattacaggtgtgagccactcgtactacattttctttatccagtccactgttgatgggcacctaggttgattccatgtctttgatattgggaatggaaatggcagcattttggggatcagatagttctgttgctctggctctgagcttgctgtgtttatgatgatgttctctgtaagttctttgaaagtggcttgttttgccatcatacttggaatattctaaagttaaaaattttcaaggagacgaatgcccttggattacttgatacctttctcactctttctctcctccctggtttggcggatctggtaagggccctgatggtagagttgtttgggtaagtaagctccctggggataaacatcaacttctgttgtatccttccccctttgtgaaaaagattgctgtttgtccacttcaccctccctagagataggctttttagctggacatgtggccacccagagaagaatgatacttcccagcttctcttgcattgtggtcgcctggaggtgagtagatcctttcctctaaggagatataaaccaaagaacagggatgtgaaccaaagtgccacgttccatttccaattttgctcttaaaggcaaggagcatgctttactcttccctttcctcttagtctgtttgtgttgccataaaggaatacctgaggctgggtgcagtgtctcatgcctgtaatcccagcattttgagaggctgaggcaggaggattgcttgaagccaggagttcccaaccagcttggacaacatagggagaccttgtctgtacaaaaaatttaaaaaattagccaggtatggtgatgtgaacctgtagtcccagcagcttgggaggctgaggcaggaggattgcttgagcccaggagttctaggctgcagtgagccatgatcacgcccctgcacccctgcctaggtgacaggatgagaccttatcccaaaaaaaagaatacccgagggttggtaatttacaaagcaaagaggcttatttggctcatggttctgcagattgtacaagaagcatggtgccagcatctgcttgtggtgaggacctcaggaaacttccactcatggctgaagaggaagggcagcctgcatgtcacatgttgagagggagcaagagagagagagaaggtggtgccagacccttttaaacaaccagctttcttgtgaactagtggagcaagaacttgctcaattcaatgaggagggcaccaagccattcatgagggatctgtctccaaaacccaaacaccttccacttggcccacctctgccattagggatcacatttctttttttttttttttctttttctttttctttttttttttttttgagacagagtctcactctgtcgcccaggctggagtgcagtggcgccatctcagctcactgcaaactccgcctcctgggttcacgcattctcctgcttcagcctcccgagtagctgggactacaggcgcctaccaccacgcccggctaattttttgtatttttagtagagacagggtttcaccatgttagccaggatggtctcgatctcctgacctcgtgatccgccctcctcagcctcccaaagtgctgggattacaggtgtgagccaccgcgcctggtcagggatcacatttcaacatggagatttggaggggatgaacgtccaaactgattcacctcctatctgccacaggctggaatgcagatgtagttttgagtcaacttggactacaaggaagagggcaacatttagggatagtggggaggaacttacagcctgggcccctgaggactttgctgtgcaagactgccatcttccctggtaaagctggtgtcattttaggtctctgtcacaaacagcagaactgatatgctaactcacatccttttatgtctcccagggtgcccattactgggcctactatagaagacactcaatgttcattgcaggtgtactttacctttctgtggtttacagctagttaggccattagaatcttagagttgggaagaatattctagataacctatctggtccactgatatgatttggctctgtgtccccacccaaatctcatcttgaattgtaatctccctaatccctacatgttgagggagggtccaggtgggaggtgattggatcctgggggtggtttcctcaaggctgttcttgtgatagtgagtgatttctcacgagatctgatggttttacaaggcagttttctctgatctttcttgtcctctcttgctgccaccatgtgagacgtgcttcttccccatctgtcatgattgtaagtttcctgaggcctccccagccatgtggagctgtgagtcaattaaatctcttttctctataaattacctcttttctttataattaaacctcttttctttataaattacccagtctcagatatgtctttatggcagtgcgaaaatagactaatacatctactcttcaatgatttcagtgtctgctcatcattcttgtctaatataattccggcttgctttatgatgtataacatgttgggcgaccttaattctactaaaggtttcttttccacaagcagaaatatgcaatccttcaacttcctttgctattgtttctcttttcttttcttgtcttttcttttcttattgagatggggtcttgctaagttgcccaggctggactcaaactcctgagttcaagtgacccccccatcttggcctccagagtagctgggactacaggtgggtgctgctgcatccagccctttaacttccttcgatcttgttcttattttcctttttgagacctcataaaacagcacatttgggggcagatagtatgaggaatgagaaaaaacaacggccaaacttgtgcaaaaatgaaaaatgtctgttcataaaaggactgaaacaagtctattgaatttggccatgatgaggtcatgatgtcgttggcaggatcaagagtttgtggaagccagattgaagtggggtggggtgtgaaatgagaaaatgggaaaatggaaccgatgtggatgactatgccaagaaattggattgagaactggggaaagggagatggaggtgcagggttagaggtggcgttttctgtgcctgtgtttaggaagggagtgactagagcagtttagcagttaagaagagagtgtggatacagaactgctccagcatccgcctgctgctactgcatgcccagctctgctccgtccagatcctgcctggctgcacaggcacctcctgaactcttctagttcaatgcatccttcttggctcccacttgctcattctctctgggtctgctgtcatcagggagaatgcttgccaaggtcattaagggttgattgacactaagacatttcagtaattcctggcatttggagttctgacacctaacactgtagcgtttggtttcacggctcttttattttctgggagcattccagtaagagagaagagagcctgatggtcaggagctgagtctttggagacacacagatctgagtttgaacctcaactctgccctttattagttgtgtgaccttgagcaagtcatcccactcctttatccccatctgtaaataaaatgagataataaaaatgccaaccccttaggcttatggtgaggaatgaagagagattacgtgacaactttgtggaaatgaagattttagaatgaaggcagagactgggatccctcccattcccaatacttggattaaaagttgcccaggtgcggtggctcatgcttgcaacactgaggtggaaggatcatttaaggccaggaactggagaccagcctgggcaacatagtgagaccttatctctacaaaaaaatttaaaaattaactgggcatggtggtgcacacctgtagttctagttgcttgggaggccaagacgggaggatcacttgagcccaggggttcaaggctgcattgagctatcatggcaccactgcactccagcctgggatacagagcgagaccctatctccagaaaaaaaaaaatcaaccaaaaaaaacctctgtcttttgggaaggacccctaggaagaaatggatgtttctcaggaaaagcaattaatcgatgtcacctagccccactctaggaccttccaaatgcctcttggtatctgtgttcttttcttggctcctggataataagtggttgaaataattacgttctaagtctttggcacccatctgccctcgtcctccatccactcgcttggtggagcctttgtcattgtcgacaataatatgactgaagtctgtgggcttttctaaccccacacatgatctataccaagtgggaagattctgtgggggccgtgctaagagagtgtgctaaaaagagagactattttaaaaaaccatcctaattttgtgaggcagaatgttgttgccatttttactttgtgctgcctgtcatccacgggtgtaaagaagggcacaggtatggagtagtctatgctcatggtgacattccaggcacatttgttgtccttgggatgtttggaaaagggggaggcaggtggaaaatttggccatgtctggccaaatctaggtgaaaaaataatgctttgctgtgaaagagtggagacttgggagcaatctctgggcgtatgtgcaacctctagttctgggtctctgaaggttaacgccctgtggacactggggactgaactggtttagatttttctgtctctttaatgggcaaaggctagagataatgaaggtgagttctgtgtgtaaattagtatttcaaattagcttctggaggtggaaaattcttttaaagaggagcacagagatcactcagtaaaaacaggagaaatcaataggggaagactggtgtgaattgggaaaggtctgcagagagcaagagagcaggttttttttttttttttgcaaaggtatctttgcactcctaccctgtataagtgagattttgcctggaccccatagctggtggccttgtaaaatcagaatcacacctttggaaagccatttggaagtacatactccgagccataaaaatatttcatacctctgaactagtaatcttccttctgggaatttatgctagggaaatcaatcataaagggggaaaagtgccacatgcatgaaaatgctgatggcctcatagcttttttcgttgttttttttttttttttttttttttgagacagaggcttgctctgtcacttaggctggagtgcaatggcgcgatctctgctcactgcaacctccacctcctggactcaagcagttctcctgcatcagcctcctaagtagctgggattacaggcacccacccaccactcctggctaatttttgtattcttagtagagatgggatttcaccatgttggccaggctggtttcaaactcctgacctcaaatgatctgcctgccttggtcttccaaaatgctgggattacaggtgtgagccaccacgcctggcccctcattgcttttaatattaagaatttggaagccacctaaaagactaataggaatggaatggtcatttaaattatggtatatttaatcaatagactgctatacattcattaagattatacttatgaggccaggcgtggtggctcacgcctctaatcccagcactttgggaggccgaggagggcggatcacgaggtcaggagatcgagaccatcctggctaacacggtgaaaccccatctctactaaaaatacaaaaaattagccgggcatgtggcgggcgcctgtagtcccagctacttgggaggctgaggcaggagaatggggtgaactcaggaggcagagcttgcagtgagctgagaacgcgccactgcattccagcctgggcgacagagcgagactccgtctcaaaaaaaaaaagagattataattatgaataccctttagaagcttgcatctgtctgaaataagtactttttatgatataagcataatgtaaatacttgtctgtacaattgactttttggggggaggggggaggggcaaggttttgccatgttgcccaggctggtcttgaactcctgggctcaagtgatctacttgcctcagcctcccaaagtgctaggattagaggcatgagccaccacgcccagcctattactgcttttcctctgctgggtttgtgtttggtttgttcttatttctctagttccttgaagtgtgagcttagattgtgtatttgtgctctttcagacttttttaaatgtttatgtttttatttgtgttagtatttatcttgaagaagagtgaaaacataattaaagaagtactggagaatgttttaaaatagtaccatcatagacaaaaatactaacctcgttatagctttggggatagatggggaaaacatgagaaaaattttttgatggctacaattgtctcttgaacgatgcaggggttagaggtgcttacctccttggcagttgaaagtccacaaataacttcaggctcctagaaacttcactactaatagtctactttttttttcttttttgagatggagtctttttctgtcgctcccactgacagtgcagtggcgcaatctcggctcactgcaacctctgcctcctgggttcaagctattttcctgcctcagcctcccgagcagctgggattacaggcatgcgccatcgtgtctgggtgatttttgtatttttagtagagatggggttttgccacattggccaggttggtctcgaactcctgacctcaggtgatccacccacctcagcctcccaaagtgctgcgattacaggcatgagccactgcacctggccaaagagtctactgttgaccagaagtctaaccagtaacataaagtccatcaacacatactatgtatgtcatatgtattgtatatcatattcttacaataaaggcgagctagagaaaagaaaatgtttttaagaaaatcgtaaggaagaagaaaatctatttactgttcgttaagtggaagtggattgtcataaagttttcatcttcatcgccttcacattgagtaggctgaggaggagaaagaagagaggttggtgtattagtctgttctcacactgctataaaggaagacccaagactgggtaatttataaaggaaagaggtttaattgactcacagctccgcatgtctggggaggcctcaggaaacttacaatcatggtggaaggtgaaggagaagcaagtatcttcttcacaaggtggcagaaaagacagagagagagagagcacaggaaactacacttataaaaccatgagatctcgtgagaactcactgtcgtgagaacagcatagaggaaactcccatgatccagtcgctttccactaggtccccccctcaacacgtgggtattacaatttgagatgagatttgggtggggacacagagccaaaccgtatcagttggtcttgccgtctcaggggtggtcaaggcagaagaaaatccatgtataagtggacccatgtaattcaaacctgtgttattaagggtcaactgtactgcgacttatatataaaataaagacagaaacatacagataggacctgaaaggaacatacagaaaatgagaacagttgatgtgttcatgtggtgaaaataggaatgatcattttccttgttttttttcagatcacttcattacaattgcagtgttcctttaagtcagatcctagctttgtcaatgaatggcttcagctttgtcatctgtgaaatgggtgtaataataatagtttgtaatactagcaactcatttccccccatgcttctttgttcttagcctttctatacatcagctcattcggtcttccccacccacctataaggtcggtatctacagacaggcaagggaacgtggaggacttgtcatagtcactcagagcaaatctgggcttccagatccacctacttttaccgtaaaggtgacagccttaaccacctctttgtaccatcttcttgcctcttctctactgaatctttctagatatgttgtaagaaatagaggtgatgttatgctccctttgggcctggcatttaggagaaattcagtcaacagtagctggtaatcaccattgtcattataatgtttgtataataaagcaataagaagaaaataacaaaaagtagagtcagtatcttgaagttcatgtatatggtgagcaaaactcacagccaatattttcaggcacatgcattcttaaggttcatctttacataacagcatctgtttcagatttcctttcttacgtgggttaaatatacctcctgcaaggatgtttataatgtcttacctctttttagcactttgtccttctttcaaagcatattcatatttatttttttctctcgttaattttgggagacatgtcagtggtccccccattttacagatctgtgatctctcaccttttttggattgcatacccctattggtgaaaatttttgagcacatacctccaatacctgcatatatgtttaattataaattatatgtgtggattgctgacagattgtatttaaaagcatgagatgatgaagatgaaataagcaatgcttcaaatttattttccaatatggtttatttaatagcataggaaaccttttttcctctcattaaaatatcattactggctgtattttccatggcagccatcttagtagatctgtttttgttattttcaaaatcatgatttaatactttgtgatagagtaattcacaggtctggttttaattcacttatttttggtttcaatactggaaaagataccccccaaaagagatgtagatccaagtagaagaaattcatagttggtggtgcttaataaattatgatactcgcttcgcgaagccatccatgtattatgcaaaagtttttgttgaaattcagctagtaaatttccatttctcatgatgccagtcagttgctcttgcaaactaactgaaaggtgatgcatttcaatatttttaacaaatgggcccaaaacctgctgaaactcttcatatggaaggcgtttaaaagcctagaaaatctgtttccaagtttttcaagtgtgaacatatgagtttttataaattaaattatagcattttcagccacaaatcattaatcatagaaacatttccaaacatccatttcaaaatgactctctagtagtacaagtattcttttttattggaaagcattagtttctcattcatcgtttaaatgtcatctttaccttgaggtaacaaattaagtacgtttattttttctgaaaatatttatggatgccataggctcttgagggatatctgtcatccaagaataggccattatattttgaacttaaaaaataatgtataatttattattaatttacagcccttcttaagttttttgacacaagataaccagcaaacttctgggtatttccaggggatttaggtcactgcctattttactaaaggagttttttgacagtatggctatattttaaatatctgtgtttttacgattgatatcctggaggctttcgtgccctttgctgtagtaacttgctaggaatatagagtgaatgaaattagctgtgcacctgtctctgtaagctcgccccaaaacccttcttttatttcagtcaaagcatccattccatcaggaggcaccctagacgtttttcccctcgaacaaggttttcacgtaagaactcatttagttcagaatataaatttaccgtagtgacaaaaactgcaattacttttgcaccaacccgatcattgactcacaaaagtggtattttgtatgtgttgtaacagagactgaatctagcaagtatcacaggctgaaacgtgggaaaaacccttttccctgagcacagcaaacctgccttctgtgtgcgcctttcttaagtttctgtcttcaagttgtcaccagtgttttcaatacattttccaaaagtatttgctgacaaagaaatgcatttagtttattgccagattatgtttttgtgtaatagtcctgctatcttggctgtaggtgaaagcataagcatttccccaacatgacttcttatttatttattttttgttatactttaagttctagggtacatgtgcacaacgtgcaggtttgtacatatgtatacattcgccatgttggtgtgctgcacccattaactcatcatttacgttacgtatatctcctaatgctatccctcccccctcccccttttgctattgggtggagaactctgaaagagaatcacaatgcttattgtttagtttgggggaaatttggaaggtcctgggattgtgtctagtagggtgttaaatatcattgaaaatattacagatacttgccttctatttctgtatggttcattttaaaatgtcattcaaaagcatgatatattcttaaggtaagaattagtgttactggcagtgggtctgcatccatatttcaatacctttctccttttcttttgagacaaggtccatgctgttgcccaggctggagtgcagtggcactatcataattcattgcagccttgaactcctgggttcaagcagtcttcccacctgagcttcccaagtagctaggactataggtgtgcaccactgcacctagctaatttaaaaatttttttcgtagagatggggtctcactgtgttgcccaggctggtctcaaactcctggcctcaagtgatcctctcttcccggagtgctgagattacaggcatgagccaccacaactgacctcgatattcttcttgataattccttttggacctatatcggattgtcagtcttttaatctcagatagtggctccagacaagctcccaacaggcagaaaagcgtcagctctgccctgtgaggttgcagcttgtgtttaccttacgactgtcacccccagggcacatgctgtgtgcacaaatctttatgtctcttacctgttttatgaggacttgtttggttaaagctgaaccataagatctgtacagtcactacctgggcatgtgtaaactgcacattcagcctcgggctgtgatccaaccctggaagaaggtgcccctgctgcctcctccgggactcactcagggagcaaattgtccttccgacatgggacatcacccccaaaagaggatgtcaccaccagggcatgtgtttattgtggttatacccgatatcctttttttgttttcagatcaataagcattgctataacagaagttttattataggcttgcaaccttttatctgcgatcctgaaactcaaaaaaaaaaaaaaaaaagatgaggccgggtgcagtggctcatgcctgtaatcccagcactttgtgaggctgaggcaggcggatcacaaggacaggagtttgagaccagcctggccaacatgatgaaaccctgtctctactaaaaatataaaaattacctgggcacggtggcacgtgcctgtagtcccagctactcgggaggctgaggcaggagaatctcttgaacatgagaggcggaggctgcagtgagccaagattgtaccactgcaccccactgggctacagagtgagagtctgtgtcaaaaaaaggtggtaaaacctaactgtaatgggatataaggctatttatgacgtttacttgtctcatttaatgtgactgtgcacacatttcatttcaggaatattgacatgttaagttgggatgctgacccagacccattagagagtgttagatcatacatatatgtgtgaaaggaaaatacaaccttggagccctcaacttactctgccaaaggggaaagtcaagctgggaacagtcatgcaaaccggcttcccattttgttcctaaattcataactgcaaagataaaaggctgcatacctccctcacgatttattcatgaggaaattctttgtgggctccaatatcttttaccctaaagcagttctattgagtttcaccctgacaatgtaaattaacagtttatcttcacaggtatgggacaaaggacagatttgaaatcatccctccactcatctgagccatatgcctgtctgactgcatcctctatgtttattaaaaatgctctgtgtgcaagacaacttgaaattgactattcttctgccctctgctttcccatgtaaaatgcagattcagtgaccactgatcaaagcctcaaatgaatgcaaccacgtacctcttttatctacttcattagtttgttttcatgctgttgataaagacatacccaagactgggtaacttacaaagaaaaagaggtttaatggactcacagttccccgtggctggggaggccttacaatcatggcggaaggcaaaaggcacatcttacatgacaagagagaataagagccaattagaaggggaaaccccttataaaaccatcagatctcatgaggcttattcactaccatgagaacagtatggggggaactgcccccatgattcgatgatctcccacgggatccctcctacaacacatgggaattatgggagctagaattcacaatgagatttgggtggggacacagccaaaccatattacctactcttcctttttttttttttttccttcgtctcttccttactgcctactcttttctctttaaatatagacgtccccaaactctctttggaaaaaccatgaatcactgatatttcctgtggttttgtgttcctttttcctgagcacatcctaaaccttggccaaataaatctctaaaataactgagactcgagtcagtcattttctttggcttacataggtacaggtaagaatttctacagctcccaaagaactctgattctaaaaaatttctacagctccccaaattctgattctaaaacccagtgtgcccaaggttttggatacaggaccgtgaccctttccacagtaccatgaattgttctggcattccccagggcgagttgttgagggaaagagtcaaattctgtaagatatttgaagagatttgttctgagtcaaatgagaggaccatgactcttgacacagtcctgggaggtcctgagaacatgtgccccaggaggtctggttacaacttggttttatatgtttcagggagacataagacatcaatcagtgcatggaaggtgtgcattggcactgtcctgaaaggcaggaccactcaaagctgaggagagcttccaggtcataggtagattcaaacattttccaactgacaattggttgaaagagttaagttattatctggagacctagaatcaatagaaaggagcatttgggttatgatagattcttgtggaggtcaaggtttttatcatgcagatgaagcctccaggcagcaggcttcagagctcttattggacataaaagggtgccagactcttacttaattctctcctggatcaggaaaaagacctgggaagggaagaggattctctacagaatgtagattttccctacaagagatagctttgcagtgccgtttcaaaatatgtcaaggaaatatattttggggtaaaatacttggatttctttcagggcctcccatctatcatgttggtatcttactgctgcaaagaatcttttttgtcagtcttcagatctctgttttacttttaatgctggtcacctgtgccttcccaaaggaggagagtgtaagaaggcatgtctgaccacctaattcccatcatggtctcacctagtttttcaggtttctttggaatgcccttggccaagaagggggtccatcaatcagttggggggcttagatttgatttttgatttacagagtgtaccccacttttgagcatataaagggtgacatgaaagcccacaggatttgttacttgctccaagtcacccagcaagctgaaaacaggaatctgaaatgagactcggccacagtctgctactgcggctttcactgaatcacatcttgttgtctgtctgaggagaagattctgggtctagtttaaaactggagctttccaaagagaacatgtatatcagtggccttctgccaagagaagatttcattcattgccagcatcagctgtgagaggcgatgtcagggagtggggaagaatctagactcacaggatgttcaagttagaacatttccccagtggattcctatctattttcactcatccattcaacaaaatattcaatgatcctatgctaggaatggagctgatagggtttggctctgtccccacccaaatctcatcttgaattctagctcccacaattcccacatgtcttgggagggacacaatgggaggtaactgaatcatgcgggtgggtctttctcgtgctgttctcgtgatagtgaataagtctcatgagatctgatggttgtataaagaggagtatccctgcacaagctctctcttttcttgtctgccaccatgtgtgagatgtacctttcaccttccaccatgattgtgaggctttgccagccatgtggaactgagtccatcaaacctgtttcttttgtaaattgcccagtcttggatatgtctttgtcagcagtgtgaaaattgactaacacaggagctagctaagcccagtcaagacaaaagtctgttgacttctgcctcccctgaaggagtttgcagtttactgggacggtagtgcaaatttcctgcataagattcatttgtaacctggaaaatgcttgtgagttcaggggagaaggtgtcccctctggagagagtgtggtgatgtgttcatagggaaagtagctcttaaatggaaacgtacaggttgcctggggctttttcaggggagctggcttgtggaaggcattccagctgagggaacagcatgagtaaaggcatagtggctggccgagagactagatacatctgctgtaaaccaaaaataaaattctcagtcctcccccagccacatgaatggaccactgtcctctcggccaagggcaatcccaagttaacctgaaaaatgagttcaggccatgatagggaggggaagctggacatacctcattatacccttctgccttttcagaattactgacagagcagactctttaattctgaaaagaagcatttacaatctattctccctgaagcctgctacctggaggcttcatctgcatgataaaaccttggtctccacaactccttatcacaacccagacattcctttctattgataataattctttcatccatttaccaatcagaaaatctgaatctgcctgtgacccgcaagcccccgctttcagctgtcccaccttttcagatccaaccagtgcacagcttgcatgtattgattgatgcctgttgtctccctacaatgtataaaaccaagttatgggctaggcgtggtggctcacacctgtcatcccagcactttgggaggctgaggcaggtggatcatttgaggtaggagtttgagaccagcctggccaacatggtgaaaccatgtctctacaaaaaatacaaaaattagctggacatggtggcacatgtctgtagtcccagctacttgggaagctgagacaagagaattgcttgagcctgggaggtggaggttgcaggttgcagtggatggcaccactgcactccagcctgggcgacagagtgagactccgtctcaaaaaaataaaaaccaaaaaccaaaaacaaaaaaacaaaactgagttctggactgaccaccttgcgcacgtgttctcaggacttcctgaggctgtgtcacaggccactggtcactcatatttggctcagaagaaatctctctaaatattttacagattttgacttttttcaatgacaataatttggcacccaatatggggccgctctttttgccaacactgcgtatctcagtagctcggtactattgaccgttcaagtgagaatgagagaggtaggagatgacactatctaggctggcagaggtcctgccatcccagattctgtgctgagaggtatagatttccaatgcagaggtagagaacatttttgagcaggagagggaagagtttttctaaaaggactctctctctcgcactcctaccccctgcagaaatgccttctgcaacattcctgctgggtggctgagcggcctctgtgtgaccacttctggggacattatttggttaacatagaaattaatttcttttatatagctcgtagtttgtaacctccattggttttaaaacctggcattttagggctgtctgaacaacttcaatctgttctttttttgtgaaatgggtgcaggacacatcagtttaattcattctgcatcctcatttttcacacgagttgtcttattattcttaactattattaaaaggaatgataaaaagtaattaaccatctggaacagattcatgcttcctattagtcagggtgtccattatgaaatctcctgaaagttcagccttagaaataaattctccaagtaggtggattagctaatgaatttttcttctccaaagatgagtgtactttcccagcacagccagcactcccctccactgctcatttatcaaagggggaaaaagtagaagtgaaaaatagaaatggcttgtcaatataatttactgtataaaagctataggtttgatatggtttgtggaaggtttccgcactatccttctccactattatttatggttttagtgtgacgctgaacctcgccttcaggaggaaaatgctgtattcagtcactggtctcttcagggtccctaggaaatgcccccagtcccttccaggccactgtggggatgctggagatggatctgctgcagaacgaaccaacaggtgatgccagaagcctaagtttgtcttgtatggatcccgtgatgagttttaggggcacttgtaatttgacaaaggaagaattatgttgcaagtgggtaaccgttctgtgcatcctggattctacgaatcactgcctaccacagcctcctgggcattgacaggcagccttgactcctggaagaccatgtgacaccatgagccagctgtatttgacctctgcattggccctttatgcttctaaacccaaatcatcgctcccctcggccgtatccatggcctcccgccattgctaataccaatgaattgagacgggatggatcagggaacccaaaggccaccctcttccttaatggctgcccttgcactcacatgagctgagacccaaaagtcctttctcagagagaagctgcttcctgggagaattcctcctgggtatagaacatagggccaggcctcccagggccaaggggctgactcccatattatctgtgtcaacaagaagcatttgcttcttgcaaatactagaagatctgaagctgttcactgcactcagtattccctaagtgcaatgctgattcatggtcaagagtgaactcttcatgcttcatgaaatcttccacggttttgtattatcctgagaaagctcagctcaagtgcagtttctttcgtgaagccttgataatgcaggttacaagtcagttctatgcaacaaatatggcaccttttgtgtcctaagccccacactggactctgaggatctaagagtaaatgagacatgtgtccatccccaagaagttttcagtctgctgatagacacatgtatagaaaaactgcaaataaacacagtaagagaggtggcaggaatatatcacagaaacctggaagaaaacattaccatctgccctgaatgcttggggaaatctttacagagaggatgatatttatgctgggttttgatgtattcataggagtttgcaggaaaactgcaaataaacacagtaagagaggtgtcaggaatgtatcacagaaacctggaaaaaaacattaccatctgccctgaatgcttgggaaaacctttacagagaggatgatatttatgctgagttttgaggtattcataggagtttgctaagtagaaagtaagtgaaggagtggggaagacatttgacgcagaaaagacatacaaaagcatggcttgaaagcctacagggtggggcatagtgtatttctgatgctcagggtatgtgtatatgggggatgaggctggagaggggacctcttctagttgtttctaatgatattgcaatcacctaagaccccaagcctggcacaccgtacccactggagcggggagacctaggttgagttcatggggtagggctggagcagggagctcttaccttcagagggcctctttttcatcctaaatctgaatgtctagagaattccatacccagaaatgtcaaaggcttggatcaaagctgcagatctctgagtcagagggagttggaaaagaaggagcaacagaagcaagttgttccagccaggtttgaatgggggatggcactttcctgtttcatgcacgtgtgccttgtcttttcaaatcaattatattctacttgaaggcaagagaaatggtttaagaaatttgttaaagtattatgaaaacatagagaagtcgtatcaattgcccaaggtgatagagttagcaggggcagatatagggttttacgggcacttggaaacgaagcactggtccctgtcctgtgtctcagatctcatacacagtttgtgcttagtggacagtgtcacatattaagagaggggacataagccaatggaagtacacacagaagatggagaccaacagatcttggtcctgttttgttttttgtttttttgtttttttttttttgagacggagtcttgctctgtcactcaggctggagtgcagtggcgcaatctcggctcactgcaagctccgcctcccgggttcatgccattctccttcctcagcctcctgggtagctgggactacaggtgcccaccaccacgcctggctaattttttgtatttttagtagagacagggtttcacggtgttagccaggatggtctcgatctcctgacctcgtgatccacccgcctcggcctcccaaagtgctgagattacaggcgtgagccaccgcacccagcctcttggtcctgttttatggaaaaacatctattaagggagcagagaggatgacaaggtcttgggtaggggatggggagagggatcactgtcatcaaatatttgcaggaattttatatacaaaaaggagttgctttgtcccatgtggacttggaggccatcctggacttgcaatagaagttgcagtgaggctgatttctccctaactgctggtgctacctgaaagttccatgggctgtctagaaagagtaagcctcccaggacgagaggcagaaacatcatagatattgtcaaggaacttcttcctcttggttggtgaccccaccaaatgatttgcagtgtctcttccaatttggagatgctgtacatctcttgacacttctataattctgccattctccctgactcccaggagagcccaggatctgtgaagacatcagaagttgagtgctgggccgactgaaacacacagacctttgctttaattattccactgtgtgagatccatttgccaagggaaatggggaaagtatttttagccaaggcatttgcttttaggggactcattctcctagaaatattctactcctcctcttttatgctgtaccttattattccccaggagttttactccttgagacactatttggattttttaaaatctttttttaatctttttttttttgagacagtcttgctctgtcaccaagcctggagtgcagtggtatgatcccagctctctgtactcctgggctcaagtgaccctcctgcgtcagcctcccaagtagctgggaccacaggtacatgccaacacatcctgataatttttatttttatttttattttgtagagatggaagtctcactatgttgcccaggctggcctcgaactcctggactcaagcaattctcttgcctcagcctcccaaagtgctggtgttataggcatgagcctctgtgcccagcctctttttcatccttaaactggtttgattccaaaagaattataaacccaggtgttaaatttcaacatatagagatgacatcctattgatcgtcacaccggctcatcctcctgagtgggcagctgacttcgcagtgcagggattcccctatgtgtgcactttggaagcccttggacagttggagaagtccccatgctcaggctatactccgatggattatatcagaaaatctgggtggggtcaggcactagaggtctttaaagttgcctggatggttccaacgtgcggtcacgtctgagagtcgctgcttgagatgcatcctggattctgcctggcaggactcatgggcccctgttccctttcggagcttagagggattgagcaaagccactttcagtttttccacttgccaggcaggtgcttgaggaagttatttgactgctcagagccaccggagcaaaaatactttccccaatttcccttggcaaatggatctcacacagcagaataactaaagcaaaggtctgtgtttcagtcagcctagcactcagcttctgaggtcttcacagatcccgggttctcctgggagtcagggagaatggcagaattatagaagtgtcaagagatgcatagcatctccaaactggaagagacactgcaaatcatttggtggggtcaccaaccaagaggaggaagctccttcctccgtgaaatggagaccctggaaggttggcttcgtgtgccttgaatccctgaggtagtgcctggcagggggcttgccctggtgcccttggctgtgacagtggtggtgatcgtgacaaccgtaaggaacactggctgggcattcttctgtggaggtgtagcctctgtgccaagtgtgtctcagctttttgcacgtgtacttcatttattcctcttaggaatcggaggtggtagttactattattatctcacccttttcacattgccacctccatggaaaatgatggtgtttctacagcatagtggagtaaaataagacagctgccagaggtgacgagcttgggccctcttcccgggagccgtgagcactgagggggtctacatcttgggcaccccgattacctgagcgtgcacctaggaggctgtgtttctgacgcgtgatgatggtgatggtgaacaagaatgtcaggatgaattgccctgttggtttcttcttttaaatcttaattgatttttattttttttgtaggcgagatcttgctctgtcacccaggctggagtgcagtggtgcgatcatagctcactgcagcttcaaactcctgggctcaagtgatcctcccacctcagccttctgagtagctgggactacaggcatgtgccattttgcctggctgatttttaattttttttcttgtagaggcagactgtcattatgttgtccaggctggtctcaaagtcccggcctcaagcagtcctcctgcctcagcctcccaaagtgctgagattacaggtgtaagccactgtgcccaacctgtttcttatgtatatgtcacttgtcattggcaggcaaattggagttgttcacttggcacaatttcaattcttgggaactattatgggttgaattgcattttccccaaattcctatgttaaagtcctaatccccagaacctcagaatgagactgtacttgtagaaaagatcttaaagatcttaagggataattaaattaaaatgaggtctttagagtgggccttaatccaagatgactgactggtgtcctttttttttactttctttttttttttttttttttgagacagggtcttgctctgtcacccaggctggagtgcagtcgcgtgatcttggctcactgcaacctctgcctcctgggctcaagtgatcctcccacctgagctccccaagtagctgggaccacaggcacgagccaccaagcccagctaatttttgtttgttttgtagagatagggtttcactttgttgcccaggctggtctcaaactcgtaagttcaagcaatccacccacctcagcctcccaaagtactgggattacaggcatgagacaccacacccagccgactggtgtccttatgagaagaggaaatttggacacacatgtgtgcacagagaggaaagaccatatgaggttgcacaaggataagacgggccatctgcaaaccaaggagagaggcctgcagaaagaagcagtcctttgggaggctgaggcaggcggatcttgaggtcaggagattgagaccatcctggctaacatggtgaaaccctgtctctactaaaaatataaaaaattaactgggtgtggtggcgggtgcctgtagtcccagctacttgggaggctgaggcaggagaatcatttgaacccgggaggcggaggttgcagtgagctgagattgcgctactgcactccagccttggccgcagagcgagactccaaaaaacaaaacaaaacaaaaaaacaagaagcaatcttgcagcactttgatcttatgcttccagcctccagaacgatgagacagtgaatgtctgttgtttcagccacccagtctgtgcaattttgttatggcaatgctagcaaacaaatacagggaagagaactgtttgccacttgcaggaatttacctttagagcctccttgggttttccttgcctctgaaagagtgggtcacaaactttagtgggcttgcaaacacctggaggtcttgttaaaacctcagtgatctggccgggagcggtggctcatgcctgtaatcccagcactttgagaggccaaggcgggcggatcactaggtcaggagatcgagaccatcctggctaacacggtgaaaccccgtctctactaaaaaaatacaaaaagttagccggcgtggtggcaggcgcctgtagtcctagctacttgggaggctgaggcaggagaatggcgtgaacccgggaggcggagcttgcagtgagccgagatcacaccactgcactccagcctgggcgatagagcgacattccgtcccaaaaaaacaaaaaaacaacttcagcaatctgatgtttccatgtgtgggagcgagtggggcttgtaaatttgcgttttctggcatcttcctaggtgatactgctggtcttggggactatcgtttgagagctactgctctggcacttgcaagcctggaggtggctctcagcaggccctcctattagctttttgaacattttgactttgagagtgaggggagagcatgtggattagcctgctgggggcagctgatgcttccagttgtgccttcattcctcttggacctgctctctaggggttgagcatgccgcacatgctttctttatcataggccctcttagtttgacagctgaaggacacaaccctttatttagtcttcggttcattctccctgtgttttttgggttcttcttggttctagtcttatataggcagatacatttctggggttacctgggttgtacctgagggggtgaagacagtcacgttattgaacctactgtaaaaatgtaataaattctagaacttccataccctccacaatcctagtgctgagtatttatgcaaaggaaaggaaatcagtgtgtcagagggatacctgcacccctgttcattgcagcagtattcataatagcaaaggtatagaatcaaactaagtgtccagcaacagaggaatggataaagaaaatgtggtgtgtatgcacagcagagtaccatttgaccctaaaaaagaatgaaatcgtgtcatttgcagggacatggatggagctggaggtcactatgttaagtgaaataagtcgggcacagaaaagaacatattgaatgttctcactcatatgtggaagttaaaaaagtcgacctcatggggccagagagtgaagcgatagataccagaggctgggaagggtgaatggcaggggtagggttcgtagagaggttggttaatgggtgcaaaaatacagttagaaggaatacattctaatatttgatagcagagtagggtgactgtagttaacaacaatgtattgtagatttccagataactagaagaggacttgaaatgttcccaattcatagaaatgatcaacccttgaggtgatggacaccccaaaaccctgacttgatcatgacacatttgatgcatgtaacaaaataccacacgtaacccataaatattatatatatatatatatatattttttttttttttttttttttttttgagatggagtctctctctgtcactcagtctggagtgcagtggcgcgatcttggctcactgcaacctccgcctcctgggttcaagtgattcttctgcctcagcctcccaagtaactgggattataggcgcatgccaccacacccagctaatttttgtatttttagtagagacagggtttcaccatatcggccaggctgctctcgaactcctgacctcatgatctgcccgccttggcctcccaaggtgttgggattacagacgtgagccactgtgcccagccagctatataaaatattatgtatcaatattttttaatgtgagaaattcttaagaagatctttatgttgataccacataatgatagagtgtagagaggctaaatttgcacaaggagggcaaggaaggtttgacagaggtggtggtatcagagctactgtgtgactgattagcagagattttcttggcagagaggggaggcccaaagtgttctcttctaaggcagcagtatgtgcaaaggcacaaggattggaaacaaccagcctctctaggggaagatttaaggagataagtgtggctgatgcatgaggtccatgggtggaggcgtggtgggagctgagaaggaagggataggttggtgccacttgtgtctactgggagttcagtattaatcttttaaggaacaggatgtattagtttcatgctgctgctgtaacaaatggcttcatagtggcataaaacaccacacatttattcttatagttttcgaggttagaaatctgaaatgagttttacaggactaaaatcaaggtgtctgcaaggctgccttccttctggaagctccaagggtgaatgtaattcattcctttcctctcctagcttccagaggctgccagcattccttggcttatggccgcatcactccagtctctgcatctgtggctgcatcactttagtctctgcatctgtggctgcatggactttgttactttgatcctcctgtatacctcttataaggactcttgtgatatcatcaggcccacccagataaatccggcatagtcccccccatctcatgagccttaatttactcacatctgccgatatggtttggctctgtgtcccaacccaaatcttatctcaaattgtaatccctatgtgtcggaggaggggcctggtgggatgtgactgaatcatgggagcggacttcccccttactgttctcatgatagaatcctcatgagatctggttgtttgaaagcatagcacttcccactttgctttctctatctctctcctgctctgccatggtaaggcgtgcttacttccctttcatctttccccatgattttaagtttcctgagcttctgcagtcatgctttctgttaagcctgcagaactatgagtcatttaaacctttttcttcgtaaattacccaggctcaggtagagctttataggtatagagattggactaatacatctgcaaagccccatttgccatattgggtaacattcacagtttttgggggttagaatgtggatatctatagggggtcatgattgagcgtattgtaggggaattgaacaattcaactctgcaaggggagagaagtgcaacctggaaggccagctctgctgctctaccgggttgcatgagggaagaggagagcctggtcccaaatattgtcactggagatgggcaggagatggtggcttgaactaagagggaaaaaaattggtgagaatttagtaaaggaggctgaagacccaggaggcattgagactgactctgaggtttaaaatgctgtcattttttaatggtgtcattaaccaggagaaagtgtgcagagcctccagtctccagttgcctggcatacttttcttggtctttgcaacaatttcaggaatccttccctgacatgcaaaagcccatccccgaagcaacgtgctttccagttagcacatgctgcatccctgtgcttcacagtgacttgcctcactccgtttgctaggctgcaagtttctgcagcaccatgcaaggtgcctgtccaagccaggctctggttctgtcgagctccccattggtatataaagatgtaggtgtcctttgcgagctgcgcaattggctattgccaggatgcccttctcaggctccacgccttcctggaatgagccttggggttgagtagttaactttgatatctcctgttaagggattttctagttttttttttttttttcttctaggaggatatgtggtttttaacatagacataaataagtctaataggtagaaatgactttgaaataattcatcaaggaggaataattcagctagaaatagcagacaccagttttcaagccttcttgcctgtgtattttcagaaatgtgctctcctttgagatatttctctcatccatttcggtaaatatctgttgcgctcatttgctgatggatggtgaacctgctttgtctcctgtgtgtactggctcttttattcccctttatcctgcttattccttacagccatggagaacagcaggtttcttattttattttattaagttctggggtacaggtgcaggaggtacaggtttgttgtacaggtaaacgagtgccatgctggttttctgcacctgtgaacccatcacctaggtattcagcccagcatgcattagctatttgtcctaatgctctccctccccccacctgcccccacccccacttcccagcaggccccagtgtgtgtttttcccctccctgtgtccatgtggagaactgcaggtttctttacttaaaaacagggcatgggatgttgaaggagactgttcctttcacttgggaattctggtttatgtcccaaagctgagagcaataggggcgtgtttgccattttttcagagggatgctggatgcctctgtggaggacctaccaagggattcacaagattcgtcctgcagcctggatggcacttctctctaaggaaaagatgagttaatggaggagaaagttggagggaagaatgggtgtttctttttccctcccaacaggagggactcctccccaggtcaaatggggaaatttaagcaaaccccccatacagattgggatgctggctaggcatggtggctcatgcctgtaattccaacacactgggaggtcgaggtgggtggatcccttgagctcaggagcttgagaacagcctgggcaacatggtgaaaccccgtgtctacaaaaaatacaaaaaaaaaaaaaaattagccaggtgtggtggcatgttcctgagtcccatccactggggaggctgaggtgggaggatggcttgaactggggaggtggatgttgcagtgagccatggtagcaccactgcactccagcctgggcaacagaatgagatccatctcaataaataaataaataaataaataaataaataaataaataaatattaaaaaaaagagattgggctgcctgccagaggaggctggcctctccttcactggctgggtgctggctgaactgtggcactcataggtccatcttcataggcgagagcagggtttgatgagtgcattcttgggatcacctgaaatagggaagaaattgatgtgacttctctggacttggaggagcctcggtgaaggttggggttgtgcctgtctcctgtctcctgcttggggaattctgagggcaggagtttggtaggcaggaagggtgggcagcaatagagtggcctacatggcttcttctagcatgaccagcagatgtgagacttgaggcctcatggaggcaggaacagggaggaattaggctggctgcagaggggatctggcactgaggctgccaagggcaggttcaataaaagtccctagaggccagctggagagcttactgccatatcagggatccctgtagcttggaaagcctcacagcagggcctgggagaaccctcagccgggccctttaacagggctcatctttgaccactgccaagaggtaacaaaggaaaacaccaggcaagcgtttaagccttttgtggccaggcatcatggctcatgcctataatcccagtactttgggaagccaaggtggtaggatcacttgaggccaggggttcgagaccagcctgggcaacatagtgagaccctatctctacaaaaataaaagaaaaataagctgggcatggtggtgcacacctgtagtcccagctactcaggaggcttaggtgggaggatcatttgagcccaggagtttgaggctgcagtgagctatgattgcgccactgtacttcaggttgggcaacagagcaagaccatgtctattaaaaaataagcctttgcttcccttgctctgtcttctcccctcttctctcgtctgccttggtcttggaggaggcagtagaaggagtaggggctggaggaagtatggagggccatgccactgctcatctgtctgcagaggtcctcgacccacacgtggggcctagactggggaggggcaggaagccgagaactggacatgaatggaagtgttcacaggaggctgtgccacactttgtaaatcctaaaattgagttgtagtttcctaacttattttcctcttataactgaaagtgagtggagggctaagggattgtcatctggctgagaagggagagctgtgatagcatggctgggggaggtgatggaagacggatggagcccttgcctttgtcccccacagataaatttgttgtaaaacctaacaagagcacaaagcaggggatagactcaggaagagagattaatacactctctgaaacgctttgtactgatttacaggctttaggaaatattttcatgagtgtgtgtgacacctctctctctgtctagcacatagtattcatttataaacctacctccctgctgccctacacatttaataaatgtgctttaaactcatttactcacccccagcaaccttatgagtagttactatttttagccccgttttacagagaagcaactaaagcacagagagattgagaaacgtgttgaagggtgcacagcacatgtggaggaactgtgatctgcactcagaccttctagtccctggggtatctcactctccccccttgtatctcctctatctctcaattttttattatagaatgcagatcacgaggtcaggagattgagaccagcctggccaacatgatgaaaccccgtctctactaaaaaaataacaaaaattagctgggcgtggtggtgggcgcttgtaatcctagctactctggaggctgaggcaggagaatcatttgaacccgggaggcaaaggttgcagtgagccgagattgcaccattttgccccagcctgggcgacagtgcgagactacgtaccctccccaccccaccaaaaaaaaaaaaaaaaaaaaaaagaaacgaattttctaaacatatataaggtaaagagaataatataatggacttaatgtatgcatcacttggcttcagcaattctccttttataaaatgcattccaaacccttaccctcttctgcctctttcagcaaatttgtttgaggtggtggatgtttgctgagtggacggatgaaaaaaaatagttgaagagtaattgccatttgatacagaacagaagagcttagctttggtttaagctgttcatttccctcccacagtctgaagttcagctgcaggaaaaaaaaataaaaaagaaagaaaagtaatttaagtaatttaaattctgcctgctgacttagttttgtcctcatcttatctgaccttatttaatcagagaaaaaaaaaagaagaaaagaaaagaaaaaaaaagactgggaaagcgttttctaggaatttcatcatgaccctttaaacacatcttccatttacacttatataattgtttcatacgggatagtgttaataataccaaatttcattcctaaagcaagctgacaaaagcatttaaagacttgctcattccaaatgtgttagagcagctgagaatcacgatctggtgccagttcatttgctttcaatacttcctgcttttgggtgctgcatattttctttacaatagcccatagttagggccatatccatacaccccaactccagattcctgtcacgcgccttccagtgcaagaaatgatcatgctttagggtgcacggggcacagtctagcattttccttgctttccacatcagggtgatgatgctcagagatgtagaagagctcccaaaggggtggcactgaccagtggccacgtggctccctgggcctgttcatccatcccggtttgttctgagataacctcatgtccaggaaacagccttggctaacgtgcctaggagcagtttttgaaagaatctgagctcacggaaatgaagtaaaaaatctctggcactcattcaggttttttatttaagatttattaaaggataatttacaggcgataacattcaccctttttgggtgtacagtttgatgagtgttggcaatggatatgtagctgtggatttaccaccacagttaagatgcagaataatcccattttgtggtcagtctccaactcatccttagcaatcactgatctgttctctaattcttcctgtcttttttatttagtggtggggacagggtctcactctgcctcccaggctggagtgcagtggcacgatcacagttcactgcagcgtcgacctcccaggctaaagcgatcctcccgcctcagcctcccgagtaactaggaccacagatgggtgccaccatgcccagctaatcttttaatttttgtagagatggggtctccctatgttggccaggctgatctcaaactcttgggctcaagcagtcctcctgcctcggcctcccaaagtgttgggattacaggcatgagccactgtggccagttgtcccctatttctatggttttgcttctctagactgtcatacattggaaatggaatcatgcagtatgtaacctttggggcctggcttctttcacttgaatgattttgatacatgctattccatgtattgggagtttctttcttttttactgttaagtaatttccgaagtatggatggacatttgggttgtttccagtttgggggaatcatgaataaatcttctattaaacattcatatacagtcatgtgaacatatgttttcatttaccttgggtagatacgtaggaatgggattcccaggtatcatgtggtgagcgtatgtttcactttgtaaaaaaacgccagcctgttttccaaagtggctctactattttgcattctcacagctatgtatcaggcagagttcaggttgctccacatccttggtgacacttggtattgtcaggtatttttttaagccattctagtaggtgtgtagatgtcatgcaggcttttgtacatggaagggcaggaatgtcttgggggaaagtcagcctcagttactgctcccataaagctctttctcctgcagcccttcaacctgcgcttcagacaatcgacagcaggattccctgtttagattcactttgtgccaacaacctgtgaggcttggcagcctaaggcctggatgccctttggtgagaggcaggcacagtaacagggcagacagtgaccaatatgacatgaggaggcctgagatgatatttcttctctgatacttactgctcttgtaacatccccacatcatttaagctctatgtctgtctctcctgttatgtagaagatatagagttaatcatgtctgctttttcaccctaccggagagcaaagaagagccttgaaagttgaaatgttcaattcagagaagaaagaagagagcacgatcatttttattgcttttgagttgctgccagctaaaacctcaggtccaaagtaaaaacactcctgttattagcagtgaaggttgacaagactgtttttcatccatcttattgtttttttaacaattttatatgcatataattccatgataatgacataagaactgcttggagaagaaactgcatgttcttttgtgatttttaatataaaattctctttgggctaaggcaaccccttgtaatcactcacctcatttccctgataccagttctctgaaatgttattgtagaccttgctccaatttcaaacgctgtcaactcttgcacataaaaacagttgtttatatagtttgtggattactccttttccctcttgaactatttgtttcactgctcaatgctattcccagttggttctgacaggagaaatggaagataatgaaatatcggctagattattttctccctggttatagctattgtgaaagtttggctaaaatgtagtatttttgtctgtctggagatttgagttgttcttgctatctcccttttctctgttagcaaagtcagcaaatggttgaatcaaggtagacaatgaagtattcctgtttgtggtctccagtttctgtcctatagacatcacaaggttatttgcagagtttgtatgaaacaatgtttttggagcctaattctcatttgtactttagagccaacagatgtttcttttaagaacataggaaaagagagtgagataaagagactttggctaagcattcttttgatcagccatgaaaagtttgacttttaactgttggtcaaatacaatcatggcatttccaaaaatttttctctaatgagataatgtgtgtgtgtgtgtgagagagagagagagagagagagaatgagagacacacagaaagagaatgtgaatcataggtttccactgacctgttttaattttagagactcatttcagggatgtgcacccacagaaaaatgcctggcatctaagcatagcatgtgccacactgaagaatattctggttcatttcaagctgtactatgctggtaaaccagccctctgggtagggcgagggcatatgttcggtggtggtggtagggaaccttcatttgtggcttttgcctgtttccctggtgtacatatttctactctggtggatttcaagttagcagcatttggcagctagtttgcaaaagtcctaaatatttaacagtaggctctgggggagctggcttcagcacaccactcattttgagggacattctgctttttatttgatgtattaaatggatgtttttagagatagggtctctctgttgcccaggctggtgtgcagtggcatgatcatagctcactgcagccttgacctccttgtgcacaagtgatcctcctgcctcagcctcctgagtagctgggactacaggtgtgcgccaccacacctggccaattttaaaattttttgtagaggcaggatcttgctatgttgcccaggctagtcttgaagtcctggcctcaagcagtccttcttccacggcctccaaaagcgctgggttggcagatgtgagccactgtacccaatgctcattctgctttttatgtatttcacttttgcacagatcccctaagacattggtctggaacacaccatccacatcagtgcacatgaaaatagttcaaaatacattaaaagatgccccctggctgattttggcatgaccagtagtacctacaactctgtgttcttgtgtgtttgtgcaggctcaccagcctgtggatgtccaggtaccccgcagaggctgtcagcaggaagagtctgggcagacaggaaaactcagggcttccttctgatttgcatttcaaaatgaaaatgagaacttttcaaaaaaatagttatcctgccaacaacattgttatactactgatgggctggggaccatgcttggccctggggggtcgaaaggggagcagaccacagtccctgcctctggccctgggtcaccatagtgggggctgaggcaggctgtgagggtctgtattgggagttcggctcttgaacaaatctactgagtggtttcagtactgggagatcctgaaatggtttgtctttgcctacagccatcttggaaaatggcttaatctctccggcacctctcagtttcctccttggtcaagtaaatataataatccttcccttataacaaagattctcagagtcagaagttgcaggggggtccttacgttaataaatgcagcatcacctgcatacttcttagaaatgcaaattcccaagatgtagtgactcacgcctgtaatctcagcacttcgggaggctgaggtgggaggatctctggaggtcaggagttcaagaccagcctgggaaacatagtgaaatcccatctctggaaaaaagaaaaaagaaatgcaaattcccaggccccaccttcagaccctgaagatcagaagccctgtgatgggcttgtgttttaccaagccttgcaggtgatgttggtgctgaaaccagctcttgtgtgagacccactgagctgcagggctgttagggtcaccatggccttttgtgaacacagctcagcgcctgtcacatgtaaaggctctatctacggcagttccatgggggacacaaatagctagaaagcgttttgagctgtctgaaggttgaggaagtgggatgcacgtggtgctagctttattttgggataggaaggagagaaggaggcaatgttccttttgcaggatctgttgatagaactctccttcccctaaggcatcaactgcctggttctcttactgccaatgttagaagctcccttccccacaagttgtggcccagttctttgtcctgactcttggagtcctgggagatcgtgggtcttcctgaatagaagtagaaatgaactatgcgatgggctcctctgcacaatccacaaccaccagctccttagctacttatacccctggcctacttgtttcattttcttcatagcacttattattcctggcacttaattttgtgatttgttgctataatgtttacttgtccctggtcttccttgtccatcagaacagaagcactctgaaggcagagacattatctgttttgttggctgcggcctctccggcacctgagaacagcagccggcatgtgatgggtgcccctgtaaatgtctgtggaatggctgactggctagctgggtgggtagcagggcaggtggctgcaggggtgggggtggtccataagagtgagtgttctgagctgaacatacaactgccattcgatccagtaatcccactactggatattcactcaaaggaaaagaaatcattctatttaaaagatacctgcacttgtattgtgccattcacaatagcaaagtcaaggaatgatatggtttggctctttgtcccccacaaatctcaccttgaattgtaataatccccacatgtcgtgggagggacccagtgggaggtaattgaatcatgggggtgggcttttcccatgctgttctcatgatagtgaataagtcttatgagatctgatggttttacaaaggggagtttccctgcacatgtcctcttgcctaccaccatgtaagacgtggctttgcttctcctttgccttcttccatgattgtgaggcctccccagccatgtgtaactgtgaacccattagatctcttttctttataaattacccagtcggccgggtatggttgctcacacctgtaatcccagcactttgggaggccgaggcgggtagatcatttgaggtcaggagtttgagaccagcctggccaacatggtgaaaccccctatctactaaaaatataaaaattaagcaggcatcgtggtgggcacctgtaatcccagctacttgggaggctgaggcaggagaatcacttgaacctggcaggcggagattgcagtgagccgagattgtgccactgcaccccagcctgggtgacagagcaagactccatctcaaaaataaataaataaataaagaaataaattatccagtcttaggtatttcttcatagcggtatgaaaatgaacaaatacaaggaaacaacctaagtgtgcatcagtggtgggttggataaagaaagtatgttatatacaccatggaatactatgcagccataaaaaggaatgaaatcgtgtcctttgcagccacatgggtagagctggagactgttgtcctaagtgaactaactgagaaacagaaaaccaaatcctgcatgttctcacttacaagtgggagctgaacaatgggtacactcgcatagacataaagatggaaatgatagacactggggactataaaaggagggagcgaggggcatgagggtaggaaaaccacccgttggatacagcattcactatttgggtgatgagttgatgagaaacctaaacctcagcatcacacagtatacctatgtaacatgcctgcacatggaccctgaacctaaaattgaagaaaacaaaatatattttaaaaagaatattacaaaacagcaaggtaacttgttacacagtatatgacatgtcacatttttaaaatgatataaatgttacattaaataaagaaggagtgttctgagacactgccactgcgcaaacctgggcactttacagacgtgccaagagaaagggtttgcatcacagcctgcctgaaactttggtggaagcactgagaaagttagtgagtagacagctgtccagaggaggggagagagtgtttcctttggaggaataatgattattgcagtctttttcaccccagtgcccatctgtgccctcctttttcatttattgacatgccacttttgtgccatgggcggtcacccgtgaagaaaaacatttcacttacaccaaggggaagaaaacttcaaatccattatttcttttcagtttggaaagtttaatctgtgagcatagcttgtgtttggagcctaagataattgagcttctttctcctgctaacttttttatttatgatacttaagaggaggtcaagctaggcagttcagcttagcttttgatgtgtgcccaggagagggtgggatgggggatgcagcaaaaagtaataataatgatactaagaaaagaggtcactgtgtgtcagttactatgtttctgtttaatccacataactagtctatgaatgaataggtccttttgttagtagccttctttacagatgagcaaattgaggctcagaggtttattgacttgctccaggttacctgcaaccttgtattaatttgccaggactgctgtactggatggcttcaactcatctcagatttctagagcctagaagtctgaaacaaagatgttggcagaccacgctccttctgaagaatccttccttgccacttttagcttccaggttctggtgtttggagtgatacagctacaagctagacattccttggcaggtacatttggcttgtagctgcattactccaatctctgcctctgtcttcacatgacctttgtcgtaatatgttctcaggctgctacaaagaattgccagagactgggcaacttatgaaggaaagaggtttgactcacacagttctgcagggctggggaggcctcagaaaacctacaatcatggaggaaggggaagcaaacacatccttcttcacgtggtggcaggaaggagaagtgctgagcagaagggggaaaagccccttataaaaccatagatctcatgagaactcactatcatgagaacagcatgagggtaaccactctcatgattcaattacctcacaccgagtcccttgcacgacacatgggaattgtgggaactacaagttgagatttgggtggggacacagccaaaccgtatcaaccttcttccctctgtgtatctctttttcctctttttcttcttcttcttctttttttttttaattgagatggagtctcgctatgtcgccaggctagagtgtattagcgcaatcttggctcactgcaacctccacctcccgagttcaagcgattctcctgcctcagccccccgagtagctgggattacaggaacgcaccaccacgtccagctaatttttgtatttttagtagagatgggtttcaccatgttggccaggatggtctcgatctccttacctcgtgatctgcccgccttggcctcccaaccctctgtgtatctctgtatattcccctctccttataaggacaccagccactggattcatcctaatctagtatttcttcttatggcagcaggaagaagtgttgagcaaaagggggaaaacctcttataaaagcatcagatcttgtgagaactcactattataagaacatcatgagggtaactgcccccatgattcagttacctcccactgggtccctcccatgacatgtggggattatgggaattaaaattcaagatgagattttggtggggacacagcaagaccgtatcaaccttcttccctctgtgtgtgtctgggcattcccctcttcttacaaagacagcagccattggattcatcctaatctagtagacctcatcttaacttaattacatcaacaaggactacatttccaaataagatcacattctgaggttctaggtggacatgtgctttgaagggacaccatgcaaccactgcaaactctgttctgtctgacttcagagtcatgttctcttcactgccttttacagacttgagcatggagggtctttgatagaggcatgcccaggctggaggaacgaagcgaaatggggggcaaactagatctgtgagctgggagaaaattccaccaggagggtgatgtttggctttgttgatgttctttatgttatttggcatgtaaactttcttgatggtggtgtcttcattgggggttataccttttatcaaaatcaaataatcttccggcccactaaatgatttttgtttctctatcctctggatagtaacctggatagttcatattttctctttttgttttcccaatatatcttggggcatcttttaatttgtctgggttactgggttatatgcatgctttgtacaaatgtatagagtagcattttctgccccattgtgagctttttgcctttggatcagagagagagggagtattggagggagggaggtctctgaggttgtggaagagacaggggaccagagtccaggataatgagatgggcacaagggactttattcattctgggctcagtgtgaggcctttggtgtatgttctgtcctttcatcttcatggtttccctgtgcagtaagtgtgattgtccccatctgactgcgttggaaactgaggcttcaagaagtgctaaggagcttcctctgtggtcacgtggctcatttgtggcataggggattatgtcactatgccatcctacctctactttccaccttcaccaagagaggaatcaggggatgagggtaggcgtgaaaaagatcaagattaggacattgacctatgaagaccctcttggttgcaagtgacagaaaacccgtttaacctagctgaagcacagaagggaagacgcagaaatttattagcgcttataactgagaagttcagagttgcctctggctttagataaggccacactcaggagtttaagcaatgggactctgccctccagtctgtcctgtagacaggctgtctccagtgtgatagataagacagcagtagattttcacccctggagaaagagggttttccttgacagttcccttagagatgtcctaggaaagtctctggtttggtttgaggcacatgcctgtctgaacccatcccaggggatgggggcctacagttggtgactgggctggtctgcatcacatgcccacttggaggaagtagtagggtcaccctgatccccatgggttggggttcacacagagaagaggggattggtttccatgaggaggagaatgggatgctggacagatgagaaccacagatgcccagagattgtagtggtctctccaggagactagatagtttcagcacagaaatgcataaaggcaaggaaaagcaggaaccatgggaccagctattgggaatgcccaaagttgccaggtttgaggagctgtcagaggtagaagaaaccaaaagcgggcccagttgaaataaacacagtgttattcaacaatgttaagtaccaggggcaactccagacaccaactctgggcactctctagtctaagactgtgatcctgatggaaggtttctcagtcagcccaggtgaggtggtaggatcacttgaggccaggagttggagaccaacctggctaacatagtgagactgtttctataatttttttaaagaatgtcatttagctagaaggatttggcttactttaatttcaactcatgtgcagacaggaaaatagcccatttcctggaatctgcaaacatccagatgcatgagccagagaaaggaatttcaaaacggctgctgcatctttcactggatttgtttctcatgtgctatgatgtcccagagagtgcagcaggatccatgggcggcttctccatccagctctaatgagcatcatgtagaaaggcatcatcccttattatttgttatctctgacacctctcactttttcctttgtgatcatatcactgaattgagccctctctgaagtctactgcagtagcaacgtgcccctgtttccttaacgctggaaaatcgtgttggttttgaatttgggagacaatgatatatatttccagatatcagaaaaatccattttgacctaaccacctcccagtgtgggaacaatttatggttttctacttgatgttttgaaaattcatttggaaatagaaaaagtgacccatagatttcaggttagtgtcgtgggatgaagatgagctcacctgctggagacaattctcttctggaaaaaatccgattccctctcatccctactagggcccaggtcacaggttgcttctatgtgttaactctttcttcctcaatgttctccaagcctctccttgctgatcaatgacaacgccacccccttgggctcctgtgccatccctgaatcttgctttcatggggacaaatcctacaagcatccacatgcttaaggacgctgcatgaaatcccaaaacccattcagtgtgatgctttcttttgtgaacgaaaaagctcagacaaaagcatgttcatcctaatgacgactggcaggtttgtgcctcctgacgacgagagccactctgcagcccaccttatttccagtgcagtttagcaaacatctggggtttgagatgcaaccagatgggaaccttttagcctggtgggagaagaagtaatcgaatttacacagcagaatgaaggaacagcagtgaaggaagagtagcaatgcagagagagaagggaaaaggagagggccatgttattctttgcccccgcaaggctagcccagcatttagcactgtgtcaggcacatagcagatgcccattccgtatttgttgaatgagtgaatggaagggcttctgcctgtttagacaaccagtgtgtgtatgttccaaaaggaaaatcctgcataagggcagaggagggaggaatattgtgcagatgggttgagggctgaagaatgtcctcaggacatcctgagtcctatggactcaggactggggtccatctcaagggagggctgtgggtggggggatgtctgcttctatggggagggtcaggtttcaggtgaagcagatatggtagggggaggttactgagaaaaggctaaagcctcagagaagttacctgctgtgggaaggtctcagaggctacctggaaatggtttgccaggaggaaagggatggagaattcgctaggagggaaggagtgctaggcaatgtgggggtgaaggctcaagaaaggaccgaaggcaggaggggttctgagagtgagcaggacatatagagggtggtggcttagctgggggatctgctcagagccaaggtgggaccagaacacatgccccactgccactcgttttttaattttagagacagggtcttgctctgttacccatgcaggagtgccatggtgtgatcatagctcgtggtaacctcaaactcctagggtcaagtgatcctcctgcctcagccccccccaagtagctgggactgtaggtgtgggccaccatgcctggctaattaaaaaaaaaatttgtgtgtagatggagtcttgctgtacacctttcccaggttcttttcaaactcctaggctcaagggatcctcttgcttcagcgcttggattacaggcatgaaccactgtgcccagctctccctgcttttattttatttttttgtggttcaaatttttgtcttggtttaattatgttgattatattgattttattgtattacagcaacctgcaaattattctcatacctacatagaaataaataaaaataatagttaaaaaaatagtagactctccaagcttagaaagccaggctgtcttctctctctgggagtcagcatcagtggacactcaggtaagatttaaagaaaatctattccagatgatatggtttggctgtgtccccatccaaatcttatcttaaattgtagtttctatattctccacctgttgtgggagggacctggtgggaggtaattgaatcatgggggcagttactcccatgctgccgttcttgtgagtgagttctcatgagatctgatgtttttgtttgttttgagacagagtgtagctctgtcacccaggctggagtgtagtggtgaagggtgaagccagctggacttcctgggtcgagtggggacttggagaacttttctgtcttacaaagggattgtaaaatgcacccatcagtgctctgtagctgcaagaggtttgtaaaacgcaccattcagcactctgtaaaatagaccaatcaacactctgtaaaatggaccaatcagcactctgtataatggaccaatcagcaggacatgggcggggacaaataagggaataaaagctggcggcagggaagcccgcagctgcaaccggctctggttcttttcggtgctgtggaagctttgttttttcgctcttcacagtaaatcttgctgctgtatattctttgggtccacgccgcctttgagatgtaacactcataacactcaccctgaaagtccgtggcttcattcttgaagtcagcgagaccacgaacccaccggaaggaaccaactctggacacagtggcatgatctcggctctctgcagcctctgcctcttgggttcaaacgattctcctgcctcagcctcccaagtagctgggactacaggtgtgtgctagcacacccggctaagttttgtatgtttagtagaaacgggtttcaccatattggccaggctggtcttgaactccagacctcaactgatccaccggcctcagcaccccaaagtgctgggattacaggcgtgagccaccacaccaggctgagatctgacggttttataaggggcttttcccccttctgcttggcacttctccttagtgccaccatgtgaagaaggatgtgtttgcttttccctccgccatgattgtaagtttcctgaggcctcccagccctgcagaactgtgagtctcttaaaccacattcctttataaattacccagtcttgactatgtctttagtagcagcgcgagaacagaccaatacaccaaagtatttccttaagaagttctagaggcagggttctataagctttcatagctggaagattctcttctatgtaactgctgttgtttaaattcattttctttcagtccttggtggagatgctttaaaatcattgcatttgtttttgtgaaaggaagttctgagcttttttttttttcttccataagtgagttaactgatgggtataaaaaacttacaggactcaactggtggggtggcatccaaggtgttatggggcctgaagcttacacaattttggctccttctttaagaaaaataatgcaaaattcataatacacaattaggtgcaaaagtaaatatctattttggatgagaaaagaaatcataacaaattgctaagttaaagaaagccgacaaataccgcagaaattacaaaattcacaaaaataatgtaaggtttttattaactaccgaatacacctttctgatcctttttttcctaccttctttgactacatattatttgactacctctttattatgacagcaattcggaatagccttttctattaataaagagaataaaaaggtaattcattccttcttccagtatggttggctaatccttgcttttttctaagagttgtaattgagaaaattcactttagcttcataactcaatttgcgtattgtcatgtaaatttttaggattgttgtaaaatctggaccaacctctctccacttgctatgtgagctgcaagattatcaggcatttcacattttcttgtggtcacttgtattaaatgtggttatggactggatgttagtgtgttcccaaaattcatatgttgaaattgtaacctccacagtgtgatggtattagggggttgggcctttgggacatgattaggtcatagggtaaagctctcaggaatgggactggtgcttttataaaagagaccccaaaaagatctctcatccatttctgtcatgtgaggacacagcaaaaagacagtatctatgaaccaggaagtgagccctcaccaaacacagaatgtgctggtgccttggtcttcaactccccagcctccagaattgcaagaaataaatgtttgtggtttaagccacccagtctatggtatttttgttatggcaggctgaacagattaagacaaatattctttgaattgaggacattatgaagtatttgtgaagctatttctagttccgggcagctcagcaatatatggaagactggaaaccatcataaacacatcccataaagccaaactaaatgcgttcccaacctaaattccgcaaagccaaatcctgaataactgtgtgctcccccagcccctacttggggagaactataacacaaggaaaactgggcattcaactgattgcaataaaatatcttgcgtttgcaaattttacagaagcatatgattgtgtgcacacattactagggccctttcaaggccttagaaggggcccatgtaattgaaagaccctgaacttaagcctcaatagcttcacagtaaatcttgctctgcccacgttgattacttctggaagtgaatatttactaaatccccctggagtgaaggaaccctgggtgttttctctattagaccttttacatttttttaagtttcattgaaataggcattaagaatacttggcccaaatgataattacatttcccttacatctgtgtagtggtttgccgtttgcaagagttcacaatgctttattttctttcctctccactccagccctgtgagccagacagggccagtattattcccgttcgcaaataaggaaacacgctctgggcttgccagggctttttccatctgcctctcaggaggagcctttgccgcagcaggctgtaggtgtgatgaagggagcattgggcactaatctggagacccacgatcgatgctagctccaacatgaactggctgtgagtcttgtgttaggccttcctgagccttggtttcctcatttgtaaaggagggattatctcctagaggggccttgtttttgtttttttttttctttttttgtttgttatgtttttgtttgtttgtttgtttttttgagacagggtctcactctttggcccaggctggagtgcagtggtggtgcgatcatgggttgccaaaaccctgacctcctgggctcaagccatcctcccatctcagcctactgagtagctgggactacaggcgcctgccactacaactggctaacgtttttgtatattttatagagacacggaactccccatgttgcccgggctagtctcgtactcctgggcccaagtcaagtgaaagtgctgggattacaggcatgagttactgcgtccagctgcttttaagttcctttttgttttgttttttgagacaaggtctcactctgttgctcaggctggagtgccgtggtgcaatcaggcttcactgcatcctcgacctcctgagttcaagcgatcctttcaccccagcctcttgagtagctgagactacaggcattgtgccaccatgcctggctaatttttgtatttttgtagagatgaggttttgccctgttttctgggcttgtcacaaactcctgggctcaaacaattctcctgcctttacctcccaaagtgctgggattacaggtgtgagacaccacacccggctgcttttaaggtccttaaagtgcttaagaaacacttttatctactagataagaggagggttcccacctccctctcgtctcatagccaaataggagtaagaggtgccttcactctccttatttctctcgcttctgttatccatttatagttaaccctttaacaatgcaggggttagaggcactgaccttatagtcagactgcgtgcaacttctgactcctccaaaaggtaactactaatagcctactgtcaactgaaagctttaccaataacataaaccatcaattaacacatatttcgtatgttatatgtattatatgctgtgttcttataatcaagaaggctacagaaaatgaaatgttattaagaaaatcctaaggaatggctaggcatggtggctaacgcctgtaatcccagcactttgggaggctgaggcaggcagatcacctgaggtcaggagtttgagaccagcctggccaacatggtgaaaccccatctccactaaaaacacaaaaattagctgggcgtggtggtgcgcacctgtagtcccagctacttgggaggctgaggcaggagaatcgcttgaaccagggaggcagaggttgcagtgagccgagatcacaccacttcactccagactggtgacagagcgagactgtctcaaaaaaaaaaaaaaaaaattagctgggcatggtggcacacacctgtagtcccagctactcgggaggctgaggcaggagaatcacttgaacccgtggggtggaggttgcagtgagccaagattgcaccactgcactctagcctgggcgacagagtgggactccatctcaaaaaaaaaaaaaaaaaaaaaaatccaaacgaagagaaaatccatgtgctgttcattaaatagaagtgtatcgtcataaaggtcttcatcctcatcgtattcatgttgagtaggctgagcaggaaaagggagaggagagttggtgttgctcagtggtggcagaggcagaaggaaatccatgtagaagtggacctgtgcagttcaaacccacggttttcaggggttacctgtcctttctggcatcattctgacatcccatgagtctgtcttttcctgactataagccctgagcgggctggatccttgtggaaattaagtatgtatgtgctcctctgatttcggaagcaggttgcaaactttcagaggtgtttgaacatcctgagtctctccagggtggtcttgcagcatgctcaggggcccaatgtcagtgcagtgaccttgcgtttagctgggttcctgggctgtgattttgcttcctcattttctgctttgatgcgtgtgttcatctggaaatccagagggtcccagaactgggtcagggcagcacacattgctggaggaagcccagctagagagtgcaggagaggagagttggttgatgctgagaaatatttttttgctggatccatttcttctgatgaaggtagccattccctcgggattttctttaggtgatgtatttaaaagatcgctgaaacatgatttggctcatgtgcttaaaaaccatcaactacataatttaatgtgcccattttatgtatggggaaattgaggtctggtgacgacaggtccagggtcaaactggactcctgatatctttttaaatttgacccttcagcagtacaggggttgcaggtaccaactctcacagtcaaaattttgtgtgtgacttttgactcccccaaaacttatttacaaatagcttaaggttaaaactggagcatgtgtttaaggttattcctctctgtgcaggcatcatctgaccacgtctttttttttttttttttgcaatccttttttgtgccttgttatcccaatcattattgggcataattaataaggaaataattgaattaaaatattctggagattttgcttttatgtacatttactggatcatacacgtaaatacagagatatatttatatgtagtttggtttttaaatttttgtctttctttttcctttttcaagattttatgtttttctcgtgataaagttcacataacatcagattcatgccagtgctgtcacctcatgcctgtaatcccagcactttgggaggccgaggagggcggatcacttgaggtcaggagtttgagaccagcctggccaacatggtgaaaccccatctctactaaaaatataaaaattagccagatggaccgggtgcaacggctcacacctgtaatcccagcactttgggaggccgaggcaggcggttgacctgaggttgggagttcgagaccagcctgaccaagatagagaaaccccgtctctactaaaaaaacaaaattagccaggcgtggtagcgcatgcctgtaatcccagctacttgggaggctgaggcaggagtattgcttgaaagggggaggcggaggttgtggtgagccaagatcgtgccgttgcattccagcctgggcaacaagagcaaaaccccgtctcaaaagaaaaaaaaaaaaaagccagatgtggtggcacgcacctgtagtcccagctattcgggaggctgaggcaggagaattgcttgaacccgtgaggcggaggttgcagtgagctgacatagcgccactgcactccagcatgggcaacgaagcaagactgtctcaaaaaaaaccaaaaacaaaaatccatcaggttcatcattttaaccattttgaagtgtacgattctgtggattttagtatatgcatgatagcatgcaaccatcactgccatctaattccagaacattatcatcaccccaaaaagaaaccgtgtacctattagcagtcaaatatattggttttgaagatttgctaaatcatggtgccaagagtgttttatacatgtgtgtgaatgtgtgtgtcctcttgtaatgggaagacatctttcgctttatgacaagagtctttggaaaggtctttgtccaggcgggatgctcaggaatatactcatctagggagctgctctggattgcgatgccgtcttgcaggtggctgatgctataaaaatacatgcagaaggtcctttgggaggccctgaacagaggctgtaggaaccttggggagggagaatagatggcccggggaggctaccctgctttcttagtccctgttgagcccaggcctggcacagcattaaagagagctgggctgcagaaagaggctgtctgtaaaacaggcagggagccaaggtcctgggtggctggtctattaaaagctcccttgacaatttcgacaaaagcatcagtattggctggtcccatcctgatgtggatccttagcttctgtgtctgaaaatcctccctgaagttccatttgcatgtattattccattctctatgattccctgctgtgggttactgttctacagactcttatgctcagactccagagagccgtgtttgtttataaaaggcggtaattggaaacagtgtggttagagagacataatattggacacagacctcatcttggctctctgcctcgctctgtgaccctggcgacatcactcaccttctccgagccttggtttccacattgagaagtgagttggaatagtggatctagaagtagtaataccttcttcataggacttatgtcaggattaagtgagataatgcatggaaatactttggcatagtgcttggtacccagcttaagtgcccaataaatggttaccaacagaaatatacccatgattattaatatattaaccttaataaattaatgtatccatccagactgaactcccaaatagccaatttccccaacaccttttacgaaatagcagagtcgttaatttgtaacaccttctacatcatatattaatttctctttggttggccggtggactcggttttgttctgtggatctgtttttgatcattttattagaaacatttaactttaattattatgtcttttaattcttgttacattcctattcttccagaattcttaggcatgattttgttgggttgaccccacgttttactggggttgtgattagaatccaattccatgatagctaaatcttggtctgtgaaaactgtctaacaatattcagtcatttcatctagaaagagactatatttatttattggtttcagtattttacatctttctaagtatttattgccagggttattcctggacagtttttatttgttaacgttttcactggcattttatcccattatttgttctaattggtttttgctttaggagaggggttgatttttaattttaatgttatgcgtaccttatatccaatcgtatcactggatctatatactaattttctgagttattttgattatctcttgattttgaagcatgtaatcatataattgaatatgcatctaataattttatctgttatgaacttgattttctctaaatttatcttttcgattgttttaaatttcttgcatttatttatcaacctaaaattcttttctgttttctggtgcattaatttctgctttactcttattttccccttcccagttctttctttgtttctcaaactgtttcaacagagtggttggttcatttatttttcatggtttaataataaaaataattagggctgttaatttctttctgggaacatgtaactctgttatggattatttacattttagatattttcaagctagtttataactgtagatttgattttcttcttgaactaataattttcccagttccccttctgcagtgggattccgggagagagtagtcaacagctgaattaacaagtctagaaagcattcctagaaaaggtaccaggctgagaaacgaactggcttagagtaatgggttgcaccacaggtaggcaagtgacagaaaaacaagaatacataggttttgctggacagacatcaggcacaccttggttgggtgttctaagtgctgggctgcaaaagtctattaagcatgtcaagtctgtataggcaatagttgattaaaggattattttcaaatcctcatgttgtttggatttgttttgttggacatcttattatattcttattttattgtgctgtagtctgaatgtgaactgagcatttttaacagttttattgagctatcatggacatataaaaattgtatatattcaagatgtattgatatatgcatacattgcaaaatgaccacaattaaccaaattaacatattcattatctccacataggtaccatttgggagagggagagagagagagagagacagagagagagagagagtgtgtgtgtgtgtgtgtgtgtgtgtgtgtgtgtgtgtgtgtgttgggcagatttaagatctatcctcttattaaattacagtatacaatacagtattgttaactttgtcatcatgctgtacattagatcttcagaaattgtttgtctagtataaccaaaactttggaccatttgacccaaatcaccccattcttccctccccccatcctctggaaattagcatcctaccctctacttttatgaatttgatatttttcaatatgtgagatcatgcggtacttttatttctgtctcagtcacttcatttagcgtgatgttctccacctccatccatgtggtcgcaaatggcaggatttccttcttgttgaagggtgaatgctattccattgtgtatgtgtgtgtgtgtatacacaccctgttttctttatcaatacatctgcaaaaagatagtgagattatttttgtatcttggccattgtgaataatactgcagccgctcagtgtagatatttctcaacatactgatttcagttcctttggatatatatctaaaatgggattgctggatcatgtgatagttctatttttaatttttggggggaaccactatactgttttccatgatgtttatgctaatttacagttccccctgcagtgtacagggtttccctttactccaaatccttaccaacccttaccttgtctttttgataacagccattctaacaagtgtgagataatatctcatactggttttaatttccgtttccctgagagttggtgacattgtgcatttttttcatatatccattggccatttacatgtcatcttttgaaaaatgtcaattcagaccttttgcccattttaaaatcagattatttcttttttgctgttgagttccttgcatattctggatattaatcccttattagataaacatttcttgaaaggcaggtatagtagtgacaaacacagtttttgtttgtctgaggaggacttaatctccccaacattttaaaaggatagctttgcagggtatagtgttttaggttagcaattcttctttctttcagtcctttgaatatattacttcactgtccccaagcttgtaaggtttctgtgaagaaacgtcctgttagtttcatggtattttctttgaatgtgatgaggcacttttctctttctgctttgaaaattctttgtctttggccaggcatggtggctcacgcctgtaatcccagcactttgggaggccaagatgggtgggtcacgaggtcaggagatggagaccatcctggctaacacggtaaaaccccgtctctactaaaaatacaaaaagaaattagctgggcatggtggcgggtgcctgtagtcccagctacttgggaggctgaggcaggagaatggtgtgaacccgggaggtggagcttgcagtgagccgagatcacagcactgcactccagcctgggcaacagagcgagactccgtctcaaaaaaaaaaaaaattctttgtctttgactttttacaatgtagttaggtttctcagtatagtccactttatattcaatatatttgatgttttatatgatttttgagactggatgtttatttctcttcccagtttgagaacttttggttattatttctttaaataagctggttgccctttttgctctctcttctttctggaatgctcacaatatgcatattgttttgcttgatgatgtctcataagtcctttttttttttttttttttttttgagatggagtcttgctctgtcacccaggttggagtgcagtggtgtggtcttggctcactgcaacctctgcctcccaggttcaagcaattctcatgcctcagcttcccaagtagctgggactacaggtgtgcaccaccatgcctggctaatttttgtatttttagtggaaatggagtttcaccatattggccaggctggccttgaactcctgacctcaggtaatcaacccaccttggcctcccaaactgctgggattacaggtgtgagacaccacgcctggccatatctcataaatcctgtatgctttatacagacatctattagttctattttgtatattcaaatgctttatgttattatctataggttttaaacctgaccagtttaaagatgtaaaactggaaaagagttgttttgttcatttgccccccttttccaagaattttgcattatatattttgaagtaatgtcatttaatcccctctctcctgatgctgcgatagtctgcattaatgttgaagcttatcttttatcaatatataatgtctctgttttcctatgtaatgctttttctctttagtgatgctttgagtcaaatgaatatttccacctgtacacccttaactcagtgttcttaacctcccatcccctctgagtcccttacaatgggccgaggatacactttctatatggtaattcttctaagttctacgagaacgctgctggcttcatttctcttcaacctttccaatcctgattttctcctcaatatttttgtctagtggatatcctagacttgcttcctgtgtgagctcctttgcttctaggttcttcctttggacatgtctagaacattttccctgtacttcactaggcagctatctattccattgcttgcccaccttgaggaccctcagcttgcctcttacctaacagttgtctaggagggtgaggcagagtttgaagcctgcctttctcccttctcttccccttccctccttccttcctttctgtgtattttgtttctctctgtctctctttgtttcttccatcctttctctctttcttttttcctttcttcctttctctctcccttccttcctttcccttcccctctccctccttcctttttcctttccttttcctaccttccttcctaccttccttccttccttcccccacctccactttcttttctttgctccctgtctggtagagttccatagaatggtcatagctcactgcagcctcaaattcctgggcttaagcaatcctcctgcctcagcctcccgagtagctggaactacaggtgcacaccatcatgcctggccaattaaaaaaaattagagatggggtctcattatgttgcccaggctggtgtcaaacacctggcctcaagcaatcttcctgcctcagcctctcaagtagctggaattacaggtgcaagccactgtgccaagcaggagtctgcctttctttcttgggttttttttttttttcccagcctgtcatctgattcacatattttccttggtcacataatacaattttgctttttagtcctgggagctcttatcttttattaaagacatttttatatgagttgttttaagtaagtagtcctctgccatttttgtttttagccttttcctcatagttggggctattcctcttgttatctgtctttgaagttatgggcaatgttttgtttgtctttatcatcaccattagtaattatctttcacatttaaaaagcagttcttgatcctatctatctctatttatcagaggcaagaatgaagtagtttcttttgattccttattatgtaggagatattttaggatttcttacacctgccccacacagaaacatagatatactcttgattaatgtattattggcctttgcagtgactcacgcctgtaatcccagcactttgggaggctgaggcaggtggaacacttgaggtcagtagttcaagaccagcttggccaacatggggccaaccccgtctctactaaaaatacaaaaattagccgggcatggtggcaggtgcctgtaatcccagctactcgggaggttgaggcagggagaatcacttgaacccaggaggcggaggttgcagtgagccgagatcattccgctgcactccagcctgggcaacagagcgagactccatctaaaaaaaaaaacaactatatatatatatgtatatttacacacatacatgcatacatatatatgtatataaatttggccttaagaaccaagaaaaaaaaaacgtgtttttttttagacagggtatatgtatgtaaataaaatatatcctgtaagtaaagtatgatatttaatatagcatgtgtaatatatagtgttataagatggtagaaatacacacaccacacatacacttaaatttatatatataattttttcgctgctgtgtcattgatcttggcctccatcatggtgcgtgaacacgccatgccaggagctttatcctcttcaggctatagaagttgaaggataggaaactaattcctagtccagttccctcctgcatgctggcattcttccactattgctctggtgggataaggagaaggcttttcttattgcttaagccttttcttaagcacacctcattgcctgctcttccatcactttcgccagatggaataagcaagaaaacaactctccaggttcttcttttccacatgggagctctcactcttggcacatggtactgctgcagcctctattctcattcatgctctcacctagggcacagtctcaaagctgatctcatacaccaaaagacgcctggggccgggcacagtggctcatgcctgtaatcccagcactttgggaggctgaggcgggtggatcacctgaggtctaggagtttgagaccagcctgaccaacatgatgaaaccctgtctctaccaaaaatacaaaaattagccagttgtgatggtgcctgcctgtaatcccagctactcaggaggctgaggtaggagaatcacttgaacccgggaggtggaggttgcagtgagtggtggtgcatgcctgtagccccagctacttagaaggctgaaggtggaggattgcttgggcccaggaggcagaggttgcagtgagctgagagcatgggcaacacagtgagaccttgtctcaaaaaaataggacacttggattagaatgttcatagcagcctttctcataatagctccaaagtggaaacaacccagatttcaaccaacaggtgaatgaataaacaaactgacatattcattctatagagtaccattcagcagtaaaaaggaatgaactactggtatatgcagcagaatgaatgaatttgaacaagtatcttgtagaataaaataagccagacagaaggagtacctactgcatgattccacttatgtcaagttctggaacaggcaaacatcatctctggggtggggagaattgcctggaaagagtcaggaaggcacttttgttggggatgggtcttcttttggatggtagctacacaacagatgtttatggttgtcaaacctcgttgaactcaagagttgtgtattttcttttattttttgagatggagactcactctgttactcaggctggggtgcagaggcacaatcttggcttactgcaacctccgcctcccaagcttaagtgattctcctgcctcagcctcctgagtagctgggattacaggcgtgcgccaccatgcctggccaatttttgtatttttagtagagatggggttcatcatgttggccaagctggtctcgaactcctgacttcaggtgatccacctgcctgggcctcccaaagtgctgggattacaggcgtgagccaccacacctgtcctgtgtattttctttatgtaaattatatatcaataaactaatggctgtactttttgcaaaaacaatcagaacagaaaataaggatatatagtatatataaatgtatatataaacagaaataaaatatgagtatgatttttaaaacgcaggactgaagttggtcctagctcgggcatggacgcgagtcttacactgtggcatctgctcctttttctttctggttcagaaagaagccagacctgagctgacacttgcgggcagctggagccagactgtcctgccttatttccaggtggctgggcttttctatttctaagggtaaaggtgtgttcaggtcactgtaatttttcatctagtgccatcagatttgtgcacgacttttattccagtggggtgtgtgtgtgtgtgtgtgtgtgtgtgtatgtatgtgtgtgaatgtgtacacaggctagtgccttctttgggatatttacccaaattcattttggatgtgaggagatctatttcagagtttggtagcccaattcaaccctaagatataaaatatgattttaaaaagtcatagctgcccgggacattgggccagaaagtagcactggtggtgtggctgtggaatgtcatatctccattgatgggcacacgagggtttttgcactagtgactgacaggtgttaagtcaccacccttgcaactgactatcggagttccaaatgtgagaggtcggaacattttagtcactcacctgcggagagagggagactatagggccttagaccagtaaggcttttagaccacctgggcccgcccctcattctacaggtgagatctgagcctgcggggaggcagctggagaagggtatgtgtgggaccagctggtggcccgccttgacccccggtgcaatcagttttaaggccagtgctcttgcatgttaataacttttctcttggatggtgttttaatccgctgggactaaatgattctgtcataaatccttgcagacgagaggatgggaactgccgtttatgaagtcacctgcaatgtgccaagtactcaacacatgctacctcatgaattcctaggtagtggacctaggaggtggcaattatttgttccattgtacagataaggaaaccgaggctgatgcagaattggggtttgttacaccatgatttttcccaggctccacgcattccacagatttacagtctcagttttcagttttcattctggaggtatcggacaggtgtctgctgtgtgcacgtcctgagaacacagtcctggccctcgtgggatgtatagacattgccactgtagcgctggaatcaatgggatttactgcagagatgaccgtgggggcgaggttaatgccaagggtcagactgaaccctatgtccttcctgtgtgtctgcttgtagatttctggagggaatgtttctttttattattacaattttttttttaattgagatggagtcttgctctgttgcccaggctggtgtgcactggtgtgatcttgactcactgcaacctccgcctcccgggttcaagtgattctcctgcctcagcctctggagtagctggaattacaggtgcctgccaccatgcctggctaatttttgtatttttagtagagaagaggtttcaccaaattgataatcaggttggccaggctggtctcgaaatcctgacctcaggtgatccacccaccttggcctcccaaagtgctgggatcagagtcgtaagccactgcaccctgccctggagggaatgtttcaacctcataatcccggcctctcaaagcctgcctctccttcatgcctgacaccggagggggaacaatgactgccatgttcaataaaacttttgtgggagatgatttaaattgctttgatgacacccttgggagttgggactccttttagtaatttaggttgaaggaatgtgtgctttcatgaaagagaggaaatgtatctggactctgggcttgaagctcttctttctaagaggaggcttgttggatttcaaaaccaagacgacaccacctcttggtgtgctggcagacacagagagaggactgtctgtcttccctcctgtgtccctctctgccacagctgaaatggctgatcttttcagaatcactgactgggggatgttcatgagcttggacaggataacaaatggaggtgggttattttctcatcctaataagtgagaaacagctgttcttcctagcttggaaagcaagtcatttgttttctacacacacacatgcatgcgcgtgcacatacacacaaccacacacacaaacacacatggttatcaacatgctgctaggaaaaattaaaaattgcgcatcatatttctaaaagaggaagcagagaaaagggatttccagaattctaaacacgcctcccatcactgcgtctcctctcagctaggactttctgtttgcacagccgaggcctgcagggtacattccagaggtggacttggggctggccttgaacttccagaccctctctcccctctctggccggggctggggaaatgtcagctattctgagggccttggaagctggactcagttattttcggtaatgtatcatcaaccacttattccacttttacagaagctatttgtaaaatgaacagtgtttaatgtatttatatttaaagtaattattgaggtcaggcatggtggttcacatctataattccagtactttgggaggcagaggtgggaggatcccttgagccctggagttcaagagcagtctgggcaacataacaagaccttatctctacaaaaattaagaaaatcagccacacgtgatggtgccgcctgtagtcccagctactcgggaggctgaggtgggaggatcccttcagccgaggagttcgaggctgcagtgagctaagatcgctccactacactccagcctggatgacagagtgagaccctgcctgattactttttttttaaagtaataatactttttaaaaaatattttttaattattatattaaaatatatatttaatatatactaataattatatataataatatataataaaatatatatttaaatatgtatataataaaatatataacatatattttaaatattgtttaattattataaaaaataattacttttttaaaagtaattattgatagagagggatttacttttgccattgtgttgctgttagtcttgtagtccttttttctgtctttcaactgatgtataatttcagttaagtaagatgaataagttctagttacccaatatgcagcattgtacttatagttgaggcataaactcatttagtactttaatttggcccaaatacacaagtgtgcgcagtattggacacttaaaaatttgttaagaggatagatcttgtgtgaaaggttcttaccacaaaaaaaactaaacgaaaatgaaataaaaatgaataatgtaaaggataggtaaattacaaagtacacaaaggcaaaaaagaatttcactgtcttttgaatgaaccctttataggcggtttctgctttatatgcaggggtggaaggtgaagaacctgctattgacagtgactttgaaagactttgagaaaatagtgtaagtaggtacaaaatgtcatcacaaaccatgtgtcttataatacatgtagcaagaatggaatactgtgtagccataaaaaggaatgagatcatgtcctttgcagggacatggatgaagctgggagccattatcctcaccatactaatgcaggaacagaaaaccaaacaccgcgtgttgtcacttataagtaggggcttaacgatgagaatacatggacacagggaggggagcaacacacactggggcctgttgggagagggcaggggtggggagagcatcagggaaaatagctaatgcatgcggggctgaatacctaggtgatgggttgatagttgcagcaaaccaccatggcacatgtttatgtatgtaacaaacctgcacatcctgtgcgtgtatcccagaacctaaaataaaatatttttaaaaattaggtaacagagtctcagtatgctgtccaggctcaagtgcactggcatggggcttcagctgtgtcatatttcaaaatgagagttctctacatggcggccttcgaataatgtgtgctaatttcaggacctgaaagatactagcgtacatgtgcagggccatgtgcacacactctccttgttgtcccagggacctaggtctccttgtctgttgcctctgagctcaggcactgtaatctcatagaacgtcactgtaatggggagacaaagctaggctgaattgatgaaagctggaaagactactttactgggtcttattcattattttcagcagcatagcataaccgtgctctttaaaaaatggactaaattgagagtctgttgaacttccccctttcaacatggggtattcatttgttattaggaacggcaatttttatgcatgtaattaacatactatgatagcttcagtggattaggcgagtcatatatgtatatatttacttttttgagacagagtctcgttctgtcgcccaggctggagtggtgtgttggctcaatcttgactcactgcagcctccacctcctgggttcaagcaattctcctgcctcagcctcccaagtagctgggactataggcacgtgctgccatgcccggctaatttttgtatttttagtagagacagggtttcaccacgttggccagggtggtcttgatctcctgacctcatgatccacccacctcagcctcccaaattgctgagattacaggcatgagccactgcacccagccttttttttttttgagacaggttctcgctgtgttgcccaggctggagcgcagtggtgaaatcatggctcactgtagccttgacctgggctcaagagattttcccacctcactctcctgaggagcagagactataggtgaacaccactacacccagctaatttatatttttttttgtagagatgggatctcgccatgttgtccaggctggtatttatatcttatatataccacttaattgctttattttcatttccttcgtaaatgatatctaggtgaaattaaccagccttttttgaatgaatgatccctaagtttgaattggtggggtctgtgtaaatggatgagggccatttgaatagacattgggacacttgaagatgaaaaattcatggtcaaatacaacatttttctgacttgtgctagaaagatgtcagattctcttttttgtttaatacagtgattactaatactcagcacgtcgacctgttgcttggaagtgatttacgcattctctggtctgggagaattactgcctttttttttcttcatgactcagagtgggctggactcccctctaaagaagccattaaatttgatgaagagccacattccttgcaaggcttgacctcaaacatttgagattagccctttgaatttctctttctggaagtctgacagcaaaacttggtgcatttttctctgcaggatccaaataatagctaaacgcctccggggcagctgtaaggcaagtattttaaaaacaaccatgttaaaatgatctggagactgcaaacaatcggcttttctttcgccccaggagtctcaaggtgcacacttgcatatttgagccaattaaaatactaaataagcttgtccctcaagaatgtagacagagcttttcactctaatttctgctcaatacccttgagcacaccttgttggttgaataaagccacacctagtttctgcaattaggggaaccacgtagttgatttttgcaagctttccttcatcagagaatgagcagtcttcattcattcaatgcagtgatgcatttgttcttttacccaacagatactttttgaacatttacaacgtgccagcatagtttaatctgtatatattcgacagacgctaagttaactgaaacggcgttcagaggtggattaagtattcatcagtgcgtatatagaaactgaaggcatggagtgggtgacaaagtgggtacagatgttgtctcttcccctttgcccctttgggtaaattaccgtatgatcttaaatacattgtcaaggaataagccactgaaaacggagaaggttttgatgacagcgctgcatgcatgtttttgttaagaaacactccaagggcatcattcttgggctatgtcaaggtctatcaactgggaaccactcaatttaccaggctcccaagatgcaagtggcctgtgtttgcttatttgtgtcaaggggatccctacagttcagataagttagttttgcacttcccactacagtgtttttgttggaaagtggtctgctaagtgagaacccattgccagttttacctacaagtcctgtatttcttttttcttttttttttttgagatggagttttgctcttgttgcccaggctggagtgcaatggcacgatctcggttcacctccgcctcttgggttcaagggattctcctgcctcagcctcccaagtagctgggattacaggtgcccgccaccatgcctgactaattttttgtatttttagtagacatagggtttcaccatgttggccatggctggcctccgtgattcacctgccttggcctcccaaagtgctgggattacaggcgtgagccacacaagtccaatattttacctagaagcctagcaattctttctgtgtaaggagatgcatagaacacgtttggggtagaggtagatgtagctatagatacaattacagatatagttatggatatataaaattaaataccttaatccttgactttattatttttcttctatcacatataatcctatttggagcaaaaatactttgagcacatgttaattttgctagttttttgggatagtttttcccgccagtactcccatttgcagaactagtggtaaatgctaatggaaaacttcttcagttagcagatttttattttactttattcctggggcaattctccttaaattgtagatcaaatccagctgcaggctaaagcaccaaaattttcttgttttcaactaacccacggcaaggataaatttttctaccccctgggatggcagattcagtcccggaaattcagagtagtgaaattgttagcagttgttcttaaaatctgggctctcatttcatggcgatgtctttggtctttgtgttgaaagcaggacctctgtaagccccttctcctccccagactgtgagtttggtgggtgttatgacaacggtgaggggacgggggagggcccctccaggaagttgtcatctcagtccagtgcggggtcagcagtaaaggacttactaggttggcgacctgatgtcacccagagccagagaagtttccatatctcaatgaaccttttggattcgaagagagataattactaactccacggactggccttagaagactcttcctctgacatcatccaattcattctgccacttaaaaaaagaaaaaaaatccaggtaccgtggaaagccactggaagctttaagcaagagagtgtcctgatttacaattaaaaaatttctaattaggccgggcatggtggcccacgcctgtaatcccagcactttgggaggctgaggcaggcggatcacttgaggtcaggggctcgagaccagcctggccaacatggctaaactccatctttacttaaaaatactaaaattaggcgggtgtggtggtgcgtggctgtaatcccagctacttgggaggctgaggcaggagaatcacttgaacctaggcggcagaaatagcagtgagccaagatcgcatcattgcactccagcatgggtgacagagtgagatttgtctcaaaataaaataaaataaattctaattttggtaaaacatacataacatgaaatttaccatcttaacaatttatatgtgcatatatcagtagcgttaagtatatacacatttttgggcaacagaactgttttcatcatgcagatctgaagctctgtacccattaaacaataactccccctacctgctgtcaacgccccccactattcttctttctctgtctctagaatttgactactctacatacctcatttaagtgaaatcatacagtaattgtccttttgtgactggtttatttcacttagaatatcgtcctcaaagttcattcaagttgtagcatgtgttaggatttccttccttttgaaggctgaataataatccattgtatgtttacatcttaggctggtgcaaaaataattgctgtttttgccattgaaagtaatggcaaaaaacagaaattacttttgcaccaacttaatgtatcctcttttgtttattcatctgttgatgggtacttgggttgcttctacctactgactattgcaaatagtgctactatgagcatgagtgtgcaaatatctgttcaagtccctgttttcatttctgttttgttttgttttgttttttgagacagagtctcgctctgttgcccaggctggagtgcagtggcacagtctcagctcactgcagcctctgcctcctgggttcatgccattctcctgcctcagcctcccgagtacctgggattacaggtgcccaccaccacacctggctaatttttgtatttttagtggagatggggtttcactatgttgggcaggctggtcttgaactcctgacctcaagtgatctgcccaccttggcctcccaaagtgctgggatgacaagcgtgagccaccacccctggtccctgctttcatttctttggggtttatgcccagaagtaaaattcctggatcctgtggtaattctatgtttaactttttgcagaaccgccatactgttttccataggggttgcagcattttgcattcccatcagccgtgcacaaggtaccactttctccacatcctcgccaacacttgttattttgttttcttgacagtagccattttaatgggtgtgaggtggtatctcattgtggtttatgtcacatttttgagtatacgttttaccctgctgggtatatgttattacactaggtgctggcttacagaggcaataagacccactttctgccatgagagaggaaactcacaatctgttggaggagacgggcatctaaacggaaaattataatacagcttatcaagtgctatgatagagacaggtcttaagagagcagagagtggatgcaatcgaggaagacttcctggtcttcatagccccacctctaggaagtcttccttggttgcacccactctgtgctccgttaagacctgtctctggagtagcagtagagttcctactcaacttctcattttctggttccttctaccaagttaagcatactcattagaaggaaccagaaaatgagaagttaaatctgaagtccaagtggttggtgagtattggttagagcactatttttagaatagaacaatgcttatgagtgaagcattttttttttcttttcatttgtgcatttctctggctctgggagattgtaaaggttacttcattgggatgcttagatcacagtttctggttattagaaagaggccacactgagacctttgggagaaaaggggcacagcaggtgggtaggtgggacgtgcctcattgagcctgattcaggggtcttgtgtgttttccatttcatccaattctgggaagtctgaaggctccgggtcagaggggagtttgttgcatgggggcagttgtctggaaagcttagtgacaaagtagcaaataggagcaaggaaacaaagtatataaagacctgctatttaggaatggcactattcttgtcgtggtgactcacatttgtcaagccttgaaggatatttgcagaggaagaaagaagcattggattgcagctcggtgggagcagatcctggctgccagtgccgggaccaaggcagggtgtgatctcacccgtgttgccaagggtcatcccacacccagactgttcggtttccattctcattccttggcattgccttttatagaactgctttcaaaagaggcattggggctgatgtcacaggatcactatgtgtttctcaggagtagggagggaatgaataggatttttcgaacattctataccaaattcactgccctccctccatttgatttaggacttacatcttcagcatcctctctttgttaggctcctctggaattgtctgtccccctggctagatcaagagcccctctgtatccccagaaccttgcagcttcaggcactttgcacgagataaataaacatggatgcaatgagaaaagggatgtgacaggtattggggaagacaagccagcaactgctctgggctctgctttggaagtgcctttcatttctctttagtttttttttttttttttgaaacagagtcaagctctgttgcccaggctggagtgcagtggcacgatctcagctcactgcaacctctgccttttgggttcaacggatttcttatggctcagcctcccaagtagctgcattacaggcaagcaccattacgcctgggtaatttttgtatgtttagtagagacggggtttcaccatgttggccatactggtctcgaactcctgacctcaggtgatctgcccacctcggcctcccaaagtgttgggattacagatgtgagccactgcgcccagctcatttctttttactctctatccaccacttgtcctagctcaaatccttttgagtctgacttggacagctgatgtcaccctctacctagtcttttttcccttcagtgccatttttccaactcttgtcagtcatttttatgctgtcattgcatccagacctgatcatttcttttctctttcctactcaaaacctttcttggttcactgtgactcagtgaataaatccatgacccttggcagtctaattcctgtttgtctttccagccttgccatcctgcccagctacctgcctcccatctcattccctgctaaatttgcttcttccttatgtgagttgaggcacacgctttcccttctgctgggaaggagtttccacccctctgagaccacatccaaatgttatctccttgaggaagccatgcatgctccctgccgagaccaaggagagaaaaccatgccttcgtctgggttcgcataacttttgtctacacttttgtcgtgtcatttactgcaaaagttgtcccccaagctatccttttatttacatttgcttattaatttcaagaattatttgagatagtattcaagttacatactagaggaatattcctatgaatataggatattataatgataataagagttatgttaaggaattcccataataaagggtggagggagagtggggatgaatttggggtcatgtaaatacaaactgcatatgctgtgatgtttagcgcatttgccagaaatgtttagaatacttatttctaaacttggacctctactttctaccagccaacactaagagagaaatatattgatatgatttggctatgtccccacccagatctcatcttgaattcccacgtgttgtgggagggacttggtgggaggtaattgaatcatgggggcaggcctttcccatgctgttctcgtgatagcgaataagtctcacaagatctgatggttttataagggggagtttccctgcacaagctctctctttgcctgccgccatctgtgtaagacgtgacttgctcctccttgccttctgtcatgattgtgaggcctccctagccatgtggaactgtaagtccatcaaacctcttgcttttgtaaattgcccagtctcagatatgtctttatcagcagcatgaaaacagaagaatacatatatcatccatatggttcacgatgtctccaggatgaaatgaatcagaagcagaatgactctgccaggggctgagacgctaaagaaatttcccttactttgtcacaaaggattccctaaatcatatcactatgtgttcaatggcatcgtctttgtaaatgtaacttcacattccgtgtgcctatttgcatctgtttgcaaatagaagaacacgtagcactgtctgagatcatgaggacatttagtattaggtttgtgcaaaagtaattgttttttgcatttaaagtaatggcaaaaactgcagttacttttgcaccaacctaatatttacctaaggattctagtggcctggggtcccagatgccttcaagcagttcagcagtgcaacatatatgtttccctttccttcatggctaatccaaacattgtatcctaaccccagcatctcaagcagggtggatagaaaagggcagtcctttttattagcaaagatgaatccttccagaatcttttcagaagactttcctttctattggccctaccagagtcacccaggtacacctagtaacaaaagggctagagaagtggctctgtccttcattctgggctggatggaatgccacgcgatgttctgctggtgtagaagagaatgggagaagtggaggaagggatctcaggaagacagctgggagtgactaccacggtagttctctatcacgacactagtccagtaaatcctgctttgcaggaggtaacaccagtgagcagctcgccgctgatgagatttattcccaaaataactttcaaatctgaagaggaatggctgctctgtatttcatttcagcaagtctccatggatattatttttctttccactgactttatttataacctgagctgcaggaagctggaaggagaagctccttgacaatatctggagcctgggcttgctatttgaccagttaaccctacgttttctcccttggcgaggttggggatgaggaaacaccttctctcctaaagatgggcctgatgaggatgcatggttcccaaggtgtgtggtgttggtcagggaggaatagcatgctctaggtttggcaggccgactcatttggcttaggccctctggctaagccataccggaatggggctcagtggtgagtcaatcaattggggaagcatcttatgtttggagatagcttaacagtaagaagtgagctaagggtgctgttattgcaagacccccatctctacaaaaaataaaaaataaattaatggggcattgtggtgcccaaattcaggaagaattttttttaaaaaaacctaaggcctgagtcacattttttaaaaattgaaaaagctgtgggggatcccagttcatgcttctctcttctcaatccaggatgagatgagcagcgcagcatctcagtgaagagtgatgtcatggacacagttgggagagccttcccttgatttgttattcttgagataggctgaagaaggaacatgagtattcagtcattagggatgtggatgggtacaccatgcagttgctcaccagtccctgtgtgggagaggcaaaagatgctacagctaagaaggattttggtgattgctgagatgcaaggaacattagcctagcatattgctcatctttccacactagctgtccctccatctgcttctgaggtaggaggtagaacttgactctggaccggattgaagactggttgaaacagggaagaggcactgaaagcacttctccatgagacatgtccatgagtgccgtgacagtttaccattgccatagcaacaccaggcagttactgcccctggctgtggcaacaccctaaagttacctcctgttttctagaaatttctgaataatccatgccttaatttgcatggtattaaaaagtggttataagtattactgtaaaattgcctctgagctgcacttctgggcaaactgcctggggttagccctgctctgcaaggagcaggaccttcgtgctactgtgcactgatgcctcaataaaagttgcaacaccaccagctcatccttgaatttcttcctgggcaaagccaacaaccctcccaggccaagtcccaactttggggctcacctgccctgcattacttctaccagctcttatcatcctatttacctgcatcaaaaccttaatgttaactcctgccgtgatgtcatcactactgaaaactcttgaaaattgagtacaattatctgtgattgtggattagtgtattctgagtaccataacaaaagactgtctggtttaaacaacagaaatttttctcgcagatctggagactggaaatccaagatgaaggtgctggcagggttggtttctcctaaggccatgctcctgggtttgcaggtagtgaccttctcactccctcttcacacagtctttgctctgtgtgcatatctccctggtgtctcttcctcttcttagggtccacttaatgagcctcattttaacatagtcacctgtttaaagagctcatctccaatatgtttacattttgaagcacagggagttaggaattcaacataggtattttgatgggacaaaattcagcccataacagcttgtaagtgctattaagaagactcagggctagcattttgggaggttgaagcaggaggatcaattgaagccaggagttcaaggccagcctgggcagcatagcaagaccccatcactaaaatagtaagaatattagctgggcattgtggtgtgtacctgtagttccagctacttggaaggctgaggcaggaggatcacttgagcccaggagtttgaggctgtagtgagctatgattctgccactgcactccagtctggggcaacagagcgagaccccgtatctttaaaaatatatatcccatcccagagtccaccctatagagaaacccaagtatttttccacttgttgaactaggaacatctgtggatattatgaacataaatattttattctaagcctctattgacctttcaattctctgaatcattgcaaaaattattctcagcagtctttatttttaccacctcagcaaaatgattctatctcagctccctgtctagactttaaattccaggaaggcaaggctgcatcttcatacctttttcctccaggtttctgagtgttggcaatgacactctttcggtaaatggaaatttgaaagagccaatgaaaaagaataatagttgaggagcaaaggtttctcctgcagtgggccaactgtccgtagcaacaaagacacatgggcaaacaaacagtgcttgcttctctttaggaaagaataattatttaccgtgaaagaagctctgtgaaaaaaaataacttcaatgtgtgtcaggtgaatatcctgtaaaggagactttttgaccttaaaaaatggtgagccatagctcagtaaaagctcattagggaagagagggagctagtctggggacagaatgtgtattgattgactcagaggttctctgagtttctctctataaaggcaatttgcataacaatgattacatattgggtttgaggcagttactgctcactggagtccttccagagtaactatttcggtggttgcagagccccctcagaaacctggctttaaaaggaaattaaatgtgaagggttgagttgctgcagttgttagccttgggaagggattaaaggggacgtttttgtcatgtgagatgtcaggaaaattcatgaggagctcactaggttgtctacttggaaaaaaacgaacttcttcctaatggattttgaaaaagattatttaatttgggttcaccattagccattctgggcaagggatggaggcgaatgttacccttcattcttgtagagaacagtgaattgttctgtctttacaaaaccaaacgcaattgaaatatttttttatgtgtaatttattgctctgcagacaatggagtggaaaagttatagtggttaattactccccaaaaccagaatattgagtgtgtgtgtgagtgtgtgtctgtgtgtgtgtgtgtgtccgtgtccatgacacaaaactgcttctaatttattaggcaatagtcattggattaggcaatgtaagtatgacatttggagaacagtgcagccccccaaaaaagtagaatgaacttttagataaatgagagagaaagagagggtgttagaactggataatgactcaacagagcaagaggtcaaggcctttcagtgctagtcaaaggacccaaaaaggccactccaagcgtgatggtcatataacttgaagtggaaaccagaaagtctggaaagaaggacaaagagcccttccgatatttttgctccatgttctatttttgttttgtttttttcttttccattgttttgttgagattaatttacatcccatgaaattcactctactttgggaggccacaggagaaggatcacttgaagccaggagtttgcaaccagcctgggcaacatagtgagacccctatctctacaagaaattaaaaacaaatattagcgtggtgtggtggtacatgcctgtagtcccattactctggaggctgaggtgggaggatcgcttgagcccaggagttaaggactgcactgagccatgattgcacagacactgcactccagcattcattgagagcaacagagtgatgagaccctgtctgcaacaaaaacaacatcaaaattcaccttaaaaaagtctacagttcaccactgtctaattctggaatatttttatcactctgaaaacaaacattgtacccattggcagtcactcctcaatccacccctgactttggcaatcactaatctattatttgtctctggagttacctattctggacacttcatatatatggaagcatacatctatttgtttttttgtcggcctttattcacttagcaaaacgacttcacagtttatccatgttgtagcatctatcggtacttcctttctttttatagtcaaatcatattccattgtatggatacaccacattttgtttatctatccaacagctgatggacgtgtgggttgttttgactttttggctgtgatggataaggctgctgtgaatcacttgtgtacaggtttttgtgtggacatgttttcattgctgttgggtacatacctaggagcggaattgttggatcatatggtaattccatgtttcacctttggaggaagtaccagactgttttctgaaacagctgcaccattttacattcccatcaacaatgtacaagagagcacttaaaattggatcccctaccatttgccaagtaccatgctgtcctcttggtgtgccttccattatatgggcttgtgttcattattcctcctttataggataagaaatggagactctgagagtttaacatatatgggaagagagaaaaaacatgcaatcactgaggttaaggctatatgatcaagtgtgagactggaaccctgaggttcttccgcaagagttggtggggaaaatgttgagtgcggcctcaagggcaggtgcagagtgctgtgaaacatagagtctgtgttcttcatagactgtttccacagactctgaccatcaagggcactttctcagaggtggaggataactgggacatggaagggtgtgtgtccatgtccatcacccttgagtgaaatatcccaactgttttgttcacctgcacgtacctgcagcctccagattgagctgggtaggtctgtcaactacggtgagagggccatatgattctccttggaatgtgaacacagggaaaccaacttatgtaaggtaatgcaacaagcaagcattgggcagagagattgtgtccagtgcaacagctggggcctctgcagggccaccagacttccctctgtgcttgcaactggaaatggagcaggagcaaagggaggaaggcaggagcctcgcaggccgcctggggtcctgatctgtgggtctgatcaggatcctgatctgtgggtctgatcaggatcctgatctgtgggtctgatcaggatcctgatctgtggatctgtggatctgatcagagggagaatggaacagggtgggctgggtcttggctctggtcactcaagctgaacaaggtggggtgcgactgggaagtcctcaagaccatctgtacatagtatcttctcacgcctgcctcagatcattaaccagcatagtattgatccataatttggttgtgttgcttctcaattatttgttggtcttgcaatttctgattttggctttgattattgtgaggtttgcagcagagaaggatataaacaaatagatcccaaagtaaagggctcctccaggacttctaaataagcaccatgtagcttgggcagctccagctgacctgctggagggaggaaaggctgatggtaccacccatacccgcatacctagggaggcctgcttacttcacacctgaagggcttggctttggcctgggctaagaggtgcacacctgggagagtgaccctgataccagaaagaagagtgatacagggattgtttccacgtccattccctgaagctccttagagatggaaactggcatttcaatgttggggcctcttaggatgtacatgttctgtaggtcatgaaacccctaaagggttccagagcttttcccaccaaaaacaatacattcaggatgtttttcaaagactttccacaaactctggccattgaggttatttttttcagaggtggaggataactggggcatggaaggtgtgtgttcacatccatctcccttgagtgaaatatcccaactgtttgtcttgttcacctgcacacacctgcggcctccggcttgagctgggcaagtctgttaaccatgatgagagacagggccgtatgtttctttatggaatatttacccccaacgtgcctgctgtttctttttctcatctgggaactctagcaagggaaggagctgaagtcacctggaacagctagaggcagaccaggtgagtgatggaatagtgaagattgaggaatctgcctggtcagatgatgcctcgtgctctgagaatcaccgtgacactgagctcttaggaaatcagctttgttggcatgttcacaggcagaattaggaccaatatctagaaggtataagatgttgcagacgttgattctacttaaagagcaatgcctgattagaaactcaaaggctgggcgtggtggctcttgcctgtaatcccagcactttgggaggccaaggtggaaggatcgtttgaggctgggacccagatagaacagcataaagatgctagcttaggatgtgagcccaatggggcaggctgctctggggggatcatggctgagtgtggacctctgcaggtgtttattctaaagctggattctgaactggccacaacgtggagggctggagtggccttggatgatcctgacagtctgggtttctgtgtatttggtcatttcttatttattcagggagttatttttggtctgttgaatttatcaattctccaagacgttggattttaccacttgtacatctggcggatacaccctaagctagtgtctttatattactatatctgggtctgtttagataaagaagaatttggcttcttcctttcttttttctggtttctgtgatgctgtagtgctttgagtttttattattcataatttttggggtgggagagggggacaggttctcaccctgtggcccaggctggagtgcaatggtgtgattgcagctcactgaagcgttgatctcctgggctcaagtgatcctcctacctcagcctcccgaatagctgggaccacgcccgactagttttttgtattctttgttgagatggtgtctcaacatgttgccagactggtctcaaactcctggcctcaagtgatcttcccaccttggcctcccaagtactgggattataggcataagccactgttcccagcctttgagttttcaatcaggcagtgggacctcacattttttcatctgcatgggtcacagggaatcacagaacttagataatgcaggctttggaaatctgctgatgttggagacacagtcatgtcattccacattcttgcttatagcctcatctgtcaccagaaagaagagcagctgaggcattcttcctacgaccattccctgaagctcttttttttttgtgtgtgtgtggggggtgggatatagtcttgctttgtcaccaggctggagtgcagtggtgcaatctcggctcactgccaccactgcctcctgggttcaagcgactctcctgcctcagcctcccgagtagctgggactacaggcatgcaccaccacgcccagctaagtttttttttcttttgtatttttagtagagacagggtttcaccatgttggccaggatggtctcaatctcttgaccttgtgatccacccacctcagcctcccaaagtgctggaattacagatgtgagccacctcttgcggccccctgcagctctttggagatggaaactggcatttcaaccttaggacctcttaggatgcaggatgcacatgttctgtaattcatgaaacccctaaaggcttccagatcttctcctcccaagaacaataaattcagtacggagttgcagagaggagcatagaatccaagcgctccagcggtcttagaccttcttgaatccacatccccattgtacgcatgtgagtttcttgtggaagggatctgtccaaggtcattgggctgaccagggctgaccagggtgaagtaggcccagggatctaggtttctgggttccttggtgttatcctaatgtctgaaccacatcctcagcttgctgagctatttttgtttatctttctttctttctttctttctttcttttttttgttctgtcatggtaattgtttttctagcatgatcactagaatagcagtagttccacatttatctgccctcttacagcagactttttggaaaaattgcctctttctgctgccttctgttctttgcctcttgttctctcttgaatctacccaggttttggttttctgaaattggtgctgtgaacatcaccaatgcattggctttaccaaatgcaaaggtccattcttggaatctaccatttccagggtttccttctacgttcttctgttttctttgcttggcctttctttttctgattctatcagttggtgtgtccagggctcagtattcaaacccctttctctttgtgtgtttctactgcccaggtcttctcctcaaggaacttgtctttaaactccatttagactgtggtgaatcccaattttctatctccaattctgacttctttcctgaactcccatgtacttgacagcttcatttggatgtctactaggcacctccaatgttgtatgtcccaaccaaactcttgattccatgttacatcccttcataacccaagtcccttttctcccccttctccatctcaatcaataacaccaacattcaacatcctttgttgctcaagccgtacatgtataagtgagttgttcttgaatcatttcttactctcacatatctttgggtaagctgaggtttggctgatctgggttttcagctgggcttggttctaagccacagattggatcttactgtttcatgtgtctcatgcttcttggatcagtgggcatcccaaagcatgttgtcatggtgatgtcaggatgaagaggctagaagcagcaatgcaagctcatttcaagtctctgctcatgacacatccctagtattttgttggctaaagcaagtctcgtggccaagctcaaaggctgtgggtggggaagtacactcagctcagcaaatgatcaagtccaacattagtggcgtgaagatgtttttgttgagcagatacatactctctgccctcttcacatgcatactcttcccctgaattgtgtgcatgagaagagggcagtctgcatttgctgaacaaaaatgtaatgtgccacctcagataatttttttttaaattgagatagtgtcttgctccatcacccaggctagagtgcagtggcacaatcacagttcacttcaacctcgacctcttgggctcaagcaatcctcctccctcagcctcccaagtaggtgggactacaggtgcatgttgctgtgcccagctaattttgaaaaaaaaaaaaaaattttttttttagagatggagtcttgctatgttgcccaggctggtcttgaactcctaggctcaggcagtcctcctgccttgacctcccaaagcactgggattacagatgtgagccaccatgcctggcatcagataagttcttaaaggaagaaatctacatctaagtaaatgggatcttgccaagagggtctttttatgaagaattggatgtgtatttaaaattgatagtgcttctgaatacctctttagaacagatgctttattgtttcagattctataaattaattagagatgatggtggtggtggtgggatgtgtgatactgatgattttgaagaggggaggaaggtagcaacattttattagggtgatccgtttttgttctgccttactcttccttatccttctgatttcataatttaccttctatgatatgaccagaattgttgtcactcaaaatctctaatcactggggatgtacccacgtgatagcagaaatttacatgcttttgggagaattggtgaaggttcgtgtcccactctgtccctcctctttagcccctccgattaggaataaaaatgctagaaggagtgcttggagcatagtggaggagagagaattttctccaaaagttgttgagactgagaggggctgagcaaatgcagcatgtgacctggtgtacagtgtcaagcacacatttgatgctgacaaatttcttaggtcttggcagggagagtgcttattcaattcagcatatttcttacctgctcctagatcagcctttttcccccttgtgcagctttataaatgctaggaggctaagtaacacaattaacctttcatccatctgctctgagaaaattctgaaggttcccaaactcttctttatttggttagaaatattctttgcacagacactcttgggcatatcagcagccagagactgtccaagacagacatacgtgtttatcttctcctcacacagggggatatttgtggcaatgtttgttcggtgctgagagtgaggttcgggcctttgagatcctcgccatcacagtggcatgaaatctgagagagcattgccttaaggcatgcctggtggcctgaaatacagagaccctgttctagatctaacacttcagaacattcttcattgtcttcgtgcttcaattttctcccctccctccctccctccctttttttgagactgagtcttgctctgtcacgcaggctggagtgcagtggtgcaatctcagctcactgcaacctccgcctcccaggctcaagcagttctcttgcctcagcctctatattggctaggctggtcttgaactcctgacctcaagtgatctgcccaccttggccccccaaaatgctcagattacaggcacgagccaccacacccagctccctccctccttccttcctttccttccttccttcctttccttccttccttccttccttccttccttccttccttccttccttccttccttcccctccctccctccctccctcccttccttccttccttccttttttttgagacagagttttgctctgacacccaggctggagtacagtggcacaatcatggctcactgcagcctcaacctcctgagcttaagcagctctctcacatcagtcttctaagcagctgggactacaggtgtgtgccatcatgcctggctaattttctttcatttttttgtagagacaggtctcattatgttgcccaggctggtctctaacttctagcctcaagcagtcctcctgcctcagcctcccaaagtgctgggattacaggtgtgaaccatcatgcctggcctcaattttcttatctgctgactgtggataaagctattcggaggatcaaattaaataacctttgtagagcaattccaggaagtataaagttcataatacatgtaagacatgtcattttgaataaaaccgcagtttgaaaatttatggaacgtttgctccaaaggcacttcaagcgtctaacaatgattcatatctcttggaactacaaatgctacatgagcagttcagttaatgggcgaaaatgtacctccagtattcgtggctctgagggaagcacaaatctagagacctcttagtccttgttttgtcttctaggacagaatttaacagtggatcaccatgtgttataaaccaagttttgtcccccgctgaaattcatattttgaagccccaagcctcattgtgatgctatttggagatgaggcctttcggaggtaatcaggtttatttgaggtaatgaaggtgaaactcttataatgggatcagggtccttataggagaggaagagacacaagctctccctctctctgtcatgtgaggatatagcaagaatgaggccatctgcaagccaggaagagagccctcaccaagaaccaaatctgcgtttaccttaatcttggacttcccagcctctagaactatgagacataaaggtctgttgtttaagcctctccatctatggcattttgatatagcacccctagctggctgagatactgtggaaagtatgaaaacatggtcatattaagatggctgaaggagtgggtgtgtttagcctggaaaaaaaaagaagataaaaggacggttaatgatatgtcttgataatgtcttgtaatatttgaaaattacatgataatgatatgtcttgataatgtcttgtaatatttgaaaattacatgaaagtgtaatctgcatgattgatgtagaagaaaaaaataagatcattgggtagaagaaacaaaggtacccatttttgaaattttatttatttgaactataaaccaggaatgcagtgtaccacaaggtggtggactctttgtccctgggagaatacagtataagctgggtcgccatcactctggaatttctgcaccaaatggggttgtggggctagctgacctctcctttcttccaacccaagattctaagttggactgcaggtgtactaattgtcctaatacttagggaacattttactccattctcttccaccaagcagcagctgatacaattgaactcttaaaatttcattcaagatattaataacctttggacatcatgtcagggaagcactgaaaatgcaggagggaaaatgtcaaaatcatcatcataattcagttgtcaacaaatatcaagatcatcgtactgatatatgaactagggaatcaatgatgatttgacatgagttaatgaaacggcgcttacccatttctgacatgtcaccaggagatttctgtatgcacagtagaatatgatgctaaatttggccagtgcagtttataatgcactcattcattcattgactcactttggtcattcagccgtccaatcgtatctatgatatttacgaggtgtttgctatgtgcaagacacaaagatgccttcctgttcacaagagaccagtgctcacgcaagtgagcagtcaagggcacatagactatgatatcagaaatgttgtggttgagattttcaccagcctctgactttctgggttggatagtgtccagaaaggatttccggggctctgttgagtagcagggaagactggcagtggtcctgaagggcagcagctttttagaaccatcagaggaaggtttgggtaccttaaacaaaggaaacagcagaggacgaggctgggcaaggactccactaataagcagctttgcatattacgtgaaaactttgggattattttccataggcagcaggaaggcactaatgaatttcaagcaagcagtgttcagatttgcatgttggaaagctcactccgaagatggtgttaggagttgcctgcaataactcaagtaagcggtggcttgagcttgcatctgggtggtggcagaagagatggagaggtgagaatagggtcaggagatattcagagttcacaccaagaggcccagcacagtggctcacacctgtaatcctaacactttgggaggctgaggtgggcagatcacctgagctcaggagttcaacactagcctgagcaacatgtcttaacttggtctctactaaaaacacacacacacaaaataagctgggcatggtggcatatgcctgtaatcccagctacttgggaggttgaggcaggagaatcgtttgaacccaggaggtggagattgcagtgaaccgatatcatgccactgcactgcagcctgggtgacagagtgagaccttgtctcaaaaaaaggagttagcaccaagagtcatttgagtaacaatttaaaaaatattatatttattaatttaatgtatatatgaatttaaaaatatatgcgtgcgtgtatatatatatacacatacgcatgtgaatttaaaaatatacatatagcacacatatttagcataaattttgtgtacatgtaataattgaagtgcttattatagtgctttgtgtctaatagacatttgtcatttgaactaattatcactaataattgtatccaaaatggggctatcttttcttttggcaatatttcctgacaagctcttgtgttccattgatcttgcctatcctttcctagtccattatttcaccttcttaattattggagtttttcagtgtgtgttaatagctggaaggataaactgtatttttcagatacttacctttattaccatactggattctaagaggtggctcctcaaacccccaggagtacattgaaattggccaggagtaaacctggaatgttgctcactgttaagcttatggctgcaatggctgcaatttgtgcattgtctataagttttattgacttccagatgatctagcataaggtaggatctccctgagacgcggaccggcaggagggctctggcctctctgcagaaacttccaaacaaatgcctgcccagtggaagacgggctgcatgacatgctggctctttggcttagagagagagagatttactgcatgctgggctggggctgctgagatgatgaggagctttatgagttgacaaggcaccagattgcattttgctgtggtcaccatctatcctggagtttgtgcctccatcgtgtgtaccatctctatttctaaaagaataatgctggttatctgtaaacccataagtttccgctgtaaccctggagaaaatcatgtcctcatttgtatgaaggaaggtgggaaggcagctcagagtcaatttacaaccttgactcttttgttttgccaccaccatcgagccttcatagcttgggctgaacttaaccacagacatcggcagagtgatgtgctcttgctgagcggtgatcaaccgtgtggccctcagaggatttctgggttctgtgtgagatggagctgctccatcattcacacaagatgtcgtgcaaaaatgagtcgttggcttgcctgcactagaagggaatttctaaaatttcaaaagtggaggttatttttatttatgtttcaaaaactggatgactacctgagaaaacatatattttacagcctcacctgccaacgtatatttaaaatttcctcccagtcttcataccactttagtgattattgctttattttctagcttaatatcagagaaggctaccccttttctgtcttttgtttttttaaaacaattctaaattttctaacgtctgtgttcttctaggttaattttagaacgttttattgtgttgcagaaaaaaaaatcccctttgaaattatgtgaaacctatgtattaaaaaggcagtggatgggtacagtggctcatgcctgtaatcccagtactttgggaagctgaggcggggggatcgcttgagtccaggagtttgggacctgcttgggcaacatagggagacctcatctctacaaaagttaagaaaattagccatgcaggatggtgcatgactgtattcctagcttcgcaggaggctgaaaaaaggaagatccctcgagcccagtagctcaaggctgcagtgaggtaagatcacccccactacactccagcctgggtgacagagtgagaccccaactcgaaagaaagaaagcaagaaagagagagagagaggatctcctaacaatctcccaacattccaacttccaactcaaagacgtgttcttctctgccacttatatatgtcttattttattgcatttagtaaaattttcaaatattcttcttactggttaaagttattcctaggtatactgtaatatttgttacttttagaaatagatttacttacattgtatattctagttggtttttgctgaattaaaaaacactattaatatgagatgtctacttgccccagcctgggcatccttttctagtgacagctgtatctcgtgactcatttccttatcaccctagaaacacttacttcactgacactgtctcagaggtcaccagtgcctttcattgccacaccaaagggctcttttcaggcttaattctctgtgacattcatcagtagagattctcttctttgtgaccataaatatactacaatatttaatatattcaacacctcttttcctattagatgctttccttatggatatttaatttgctttcttaaagtgaaatactcagtttgtaatagatggcctgaagctggttctccagatctaatctctattcatccatctacctaacagtttttaagaactctttgtgtgtcaggcactggaggtgaccacatgtatgccattaaggagagcacctaaacatgggaccacaggagaagtcttccagttgtgattggtagtacatcagtcccttttcacgctgctgataaagacatacccaagactgggtaatttataaagaaaaagaggtataatggactcacagtttcacatggttggggaagcctcacaatcatggtggaaggggaaaggcatgtcttacatggcagcagacaagagagaatgagagccaattgaaaggggaaccccttacaaaaccatcagctctcatgaggcttatttactaccacgagaacagtatggggaaaactgcccccgtgattcagttatctcccactgggtccctcccacaacatgtgggaattatgggagctacaattaaaaatgagatttgggtgaggacatagccaaaccatatcaggtaggatgctgtatctgtgaggatacagatacagcatcaagactttcctttctggcaggagacaggtagcacactcagaaggggcaattaaagagaggttaccaaaatatttacaaagattgtgaagggttaagggaaaccaataaggaatgacaagggttagtgaatgaccccagggctagcaacagagagggaagaaattgccaccctaaggtctgcagaggcaagaggagggagtggttaacagaatgcaaggatagctgtaaacctaagagaggcatgcctgataacaactggattatagaagatttagtaccttctactaaaccccagcccagtagggaaagagatgggagaataagtacacctctctctctttccatccatctgtcaagaagtgtccttatgttgcctcctattggttcatctcaacccaaagccaggggggcaggtgaacctatagctgtccctataggtctttctcctagagtatgcaactgggagaaaaaggatggagaatagatctggagtgaagcatgaaggatatttgatatggttgcagtaggatgactgaccttaatctgtccttcctctctttatcttcgagttcttacctaatagtgccacttggctttaactgtcgtcagctgttaggtgcaaaagttattgctgtctttgccattacttttagtggcaaaaacgacaattagttttgcaccaacttaataaaataactcaggcggaaaagaagggaacaatgaattctcgcaggcctggtgccaagaagccaccccattctcttcctgctttctctctttgctgctgcttctccccctttgactttgtgactactctgcctacaagttcagtttcattcctcaaagattgcggctgcctctgacgactgagcaaggggcacttgcagaaaagaaggtttcttgggtacacgaaatcatcccaacttgctccaacggcaacctttcctggctaagttaagaccaacttgagttcggctggtggacttgaactcttatttatctttgccaacagtttctggggcctgcaaaataagcacgttaaaataccagtgatttttttttttttttttgctgctttgttgaacctttgtggcagattaagtgggggtgaaaatggaagcacatggaccaaaaaatatgtaattcacaggtgtcacatcgcactgtgaggaatgatctttttggaggctgttaagtgaatgcctttcataatggaagcaataatgccacataaggagaaaaaaatctcattgggaccatcattccctgtgtctccttggtgggatatgcatgcatgcttagtcttaatttctatactgttttataaaaaaaattctccttctggcccctctgactgcattggaaaggctgcccagggggttgtgctaggcaaacacatctgaaatgcattttagctctaaggtggaatttaatgacttgggattggaagctctctatttagatggaacaaaagatatgctgtatcgtcaagtgaagaaaaagacaagccaacccaaccacacagattaagttagaggaagaatcagaggtttttctgtggaagctgcccagttaagtcaaaggtcaggaattctgtcccattctgatagtgtctcttgccttgacccttgggagtgtgtggcttgtgaggggaagttagcaagtactggggaagggaaagggaaaatccagggcgaatgagtaagagcacacagaataaagaggaaaaaagcatgcttggtagtcttttagctgtctttttcatcatgcagtattggacacattatatgtatgacctatatatgtcaggctgtaatcgtacactgaggaacagctgtgcccatctcgcagctttacagtggagcgtgtctgtattagtccgttctcctactgctattaaaaactacccgagactgtgtaatttatgacgaaaagaggtttaattccctcacttccgcaggctgtacaggaagcatggtttggaggcctcaggaaacttagaatcatggcagaaggcgaaagggaagcaggcacaatcttcacatggacagagccaggagagagagagagagagaagggggaagtgctacacacttttaaacaaccaggtctcatgagaactcactctatcacaagaacagcaagagggaaattcgaccccatgatgtagtcacctcccatcaggtccctaccccaacactggggattataattcaatatgagatttgggtaaggagacagagccaagccatatcaatggccatataccttggaggtcctttgggtgtcctccaagaatatatatatgtatatatatatgtatgtgtgtgtgtgtgtatatatatacacacatatgtgtgtgtgtatatatatacgtatatgtgtgtgtgtatatatatacatatatgtgtgtatatatacatgtatatatatttgagatagagtcttgctctgttgcccaggctggagtgcagtggtgtggtctgagctcactgcagcctccatctcccaggttcaaatgattctcctgcctcaacctcacaagtagctgggactacaggtgcacaccaccacacccggttaatttttgtatttttagtagagacaaggtttcaccatgttgaccaggctggtcttgaactcctgacttcaagtgatccgcccgccttggcctcccaaagtgctgggattacaggcatgagccaccgtgcccggctggacaagtgggatttctgaagtcaaacaggaaacttgaacacttagttattttttttccagagataaggtcttcttattttttattttatttatttattttcaaagacagggtctcactctgtcatccaggctggagtgcagtggtgtaatcatagctcattgcaggcttgaactcctgagctcaagcaatcctacctcctcagcctctcaaggagctgggactataggcacaggccaccacactggctaatttgtttattttttgtagagatggtgtggggtctcattatgatgcccaggctcctctccaactcctgggctcaagcagttcctctgcctcggcctcccaaagcactgggattacaggcatgagcctctgcacttggcctgcttgcttcttattaagacatttctctcttccttaagtctcagtctcttgaagtcttggggttcaaatatagcataactgagaggccgtgcatatagagcagaaaagaaaaaagtttcgccggatgcaattcctcctgtttggtggaaatagacaagggatagggtagtcagtgagcacttgctgaacattgcctatccttccccttcttgctcctgggctctcctctctgcaccctctgccacggctctagcctgcttgtcctgatggcagtgaggtttgtatctcaggccacctctgctgtctgaacctccattctcatgtgcttcaattttccactggactctgacgccatctggatgtcccacggatgcctcgtgtaccacatgtgaagaatggaactcattgtcttctcacactctcttctgtatgccctgtctttttgggcagtgttatcactcacctggaaactcagttttgctcagttcctccttctctttcagccttatctcttgtttatctcctaccctgggatggtatctcttaaacaaccctcaaatctctccattccttttgatcactgaccgctgccttaaaataagcttcctgccatctctcgcacaggctgctgcaagaattctgcaacaggtctcataatctgcctcagagcccggcctttatcctcctttaattgccatggaacctttaaaaagttcctatatttggccaggtgtggtggctcacgcctgtaatcccagcattttgggaggccaaggtgggagaatcatttgaggccaggagtctgagaccagcctggggcaccatagcaagaccccatctatacaaaattgttttaaaaaattagctaggttagtgtcacgcacctgtaatttcaggtacttgggaggccgaggcaggaggattgcttgagcccgggagttcaaagctgcagtgaatgcgctgtgattataccactgcactccagcctgggtgacagagtgagaccatcccttaaaaaaaaagttcctacgttcctacattctcagacccagtgtcctcgtttgtgaaacagagattgtaataataccttccccctgagcttgtcacgggattagatgagacaatggtagaataaaagtgaaaaattgctaaattgcccaccacatagtgagtactgaataaatggttgctgtcactactgttagtgcctggggtcagtccttgtgctgttattggccacacttcagatcttgttactttccttctttatttgtcacttatagataaaaagctaaagtcaagggacctagggctgcagaatgacttttgtgggcccagagactttagcctagatgggctccttcctccatataaaatactaaaaattagattttatgaccctgtttctatgattgtcttgagtactctctgaagagcttgtaatcttaaatggcaattctctgatctctggagactgtgtaaattcagacaaacatatgtgtagtctcaagtcctggattgcaatttttgcccctagttctgagcatatccatcttcttgtttgtctcattacgctgttccttggatttggggaaaaaaaaaaatccagtctttcagggacctaaatttttgcagatatttcagtttcaatgatatttctcaagagaacccaaaatctcatatcctgtgcacgcttgagctctgaaactgcagcttttagttaatgagcaactcatcctctccctctctgagagcagacatagactcaactccgattttaacttaccttgaggagtttccctttctttcttgcaaggtcacctatatattttaaatattttaaaatcgttttattgagtgtttttaggtatcttgctggaaaattctcatgttggatagcctttcatcttgctgtgaatagaattgtctatcataagtgttcttttcttaacaactggtttgagtttttgtttgtttttgtttgtttgtttgttttgtttttgtttttgagatgaggtcttgctttgttgcccaggctggagtgcagtggcgcagtcttggctcactgcaacctctgcctcctgggttcaaatgattctcctgcctcagcctcccgagtagctgggattacaggcatgcaccaccacacccagctaattgtatttttagtagagacgggattcatcatgttggccaggctggtcccgaactcctgacctcaagtgatccgcccacctcagcctcccaaattgctgggattacaggcgtgagccatggcccccagccatactgagatatacagctcatatcactcatctatttaaaagcgtacagtttagtggcttgtagtatcttcacaaatttgtgcacccatcaccatgagctaatgctgtcacattcccattactccaggaaaaagtgctatacatattaacagtcactgtccattttctccccaagttcccccttccctactgaaagcaaccatggatctactttcaggttatacagatttacctattctgtacatttcacataaatagaatcactatatggtcttccgtgactagcttcatttacttgtcataacattttcaaagttcactcatgccatagcttgtatcacaacttcattcttttatattgcccaatattccattggtctggagatactatattttgtttctccagtcatcagttgatggacatttagctaataagaataatgcaactgtgagcatttgtgcacaagtttttttggggacgaatgtttccatttttcttgggtggaaatttcttaggagtggaattgctgggtcatatggtaactatatttagcattttttgtttttgtttttgagacagagtcttgctcggtcacccaggctggagtgcagctgtgggatttttgctcattgcctcctaagtagctgggactacaggtgcacatcaccacactcggctaatttttgtatttttagtagagactgggtttcaccatgttggccaggctggtctcgaactcctcaggtgatcacctcagcctcccaaagtgctgggattacaggcgtgagccactgtgcccagcctatattaagcattttgaagaacagcccaactgttttccaaagtggcgggacaactgtacattcccactagtaatgttgcatcacaagtgattttaaaaccaagcacaggtgtttgtactcaacatgggaagaatctttgtggagttttgagcagagttcaggggttgtcatttgaagatgtgttacacatcagtgtggaagcagattcagcatgagggagcaggtagaaagtgctggagtactctaattctccgccgatagggtctctatggagatggtggcagcaagaaaagataccaggattcctgaagagcatattggacggtggaaatgattctcaagcagagaaatgatgctcgtctgacggtgctcgttcaacctttgcttttgatcttggtattacagaaaataaatttctgttttcagagaagcaggagagggaatacaagctttgccactaggtgatggggaaccgtctcactaccggagcaggtttcctggctcttgacttgcttaggggatgtcttcgtgggagatttggatccttctgggcgcttccggctgcccaggctgtgaaagccaaggaggctggtccttctttctgtcagtggcagcaatgaaacactggatattggatctccatcatttaaatggataaagtggtgtgtgtgtgtgtgattgtgtgtgtatgtgtgtatgtgtgctgagtagctggaacatttgaaatggcagaaggcaatgagaacccttaacaacaaaagttttctagttaagtaataaaacctcccataactccaggatttaaaaattgcccatcaagctgtttatcctctaatggaataataggtttaaggtgtcaccatcctgggagcttgcaattgctcagtgaggcttgttacagaggcctccaagtctacttggcactgttatcacccgtgtgggttttttcctctcctctgtgatttattctcaaacattttgtatttcctcttgccatttagataaaatttaaataaaaccattagggaaagagctgtgtcagaatgttggaccctttaaactcaagataaaaatcaatctgtatgtcactttctgttcaaatgaagcaaaagcatctgcagtttggcagttatctgtgacttgctgtttttattctgtgctatttcttcttgctgtagttcctcctagcaaaagggaaacaggcgtgaataatggccccagttctgtctcatttcctatgtcctctttcgtcctcatttctcccagtttagatggtctctcccttttacagacccccatctcatcccagtccccaaaaggagagagaggattcttttatatttatttatttatttttttgagacagagtcttgctctattgcccaggctggagtgcagtggtgtgatcttggctcactgcaacttctgtctcctgggctcaagagattctcctgcctcagcctctcgagtagctgggactacaggtgtgcaccacgacgcccagctaatttttgtattttttggtagagacagagggagaggattctaaccagactttaaccccagaactctctgtgaccttgaccttcctctcaatggaaatgttttcagggcctatacctgagttggataaattgaggacatcattttttctgtgacaagtaatgttaaaatgtctgttgaagctgcagcggagattgagtaatacatcctggtatggtggttttctaataattcttttttctcccactttttctaggcttatccaaatcccttgggctcattgaaggttatggtgggcggggtaaagggggccttccggctactctttccccggctgaagaagaaaaggctaagggaccccatgagaagtatggctacaattcatacctcagtgaaaaaatttcactggaccgttccattccggattatcgtcccaccaagtaagttctggttcagtcatttgcggagcttgatgggtcgtcagagtgggtgtagacccctacgtttgtgatattttccactgttatttgtaactcttgggggagtttttattttagtttcctctttaataaataaacttagtactcctgttgcatatgaaagattagctaaacaaaaaagttcagttgttatcaaagtgttccagaaacatatagaaagagcctcaatacaaaaagctttgtattttaattcttcttcttcttcttcttcttccttcttcttccttcttctttcttcctttttttttttttttttttttttttttttgagacagagtgtcgctcttgttgcccaggctggagcgcaatggtgcgatctcagctcaccgcaacctccgccttttggggtttaggtgattctcctgcctcagcctcccgagtagctgggattgcaggcatgcaccaccacacctggctaattttgtatttttagtagagatgggattttatgcctttggtcaggctgatctcgaactcctgacctcaggtgatctgcccgccttggcctcccaaagtgctgggattacaggtgtgagccaccacacccagccattattattcttttaatgtttattttatgttcaggggaacatgtgtaggtttgttatataggttaattgcatgtcacaggggttcagcgtacagatcatttcatctcccagataacaccatagatagtttcttgattcttacccttctccctccctccactttcaagtaggcctcatgtctattgttcccctctttatgtccatgtgtactcgtcgtttagccccgacttataagtgagaactggtggtatttggttttctgttctgagttagtttgcttaggacaatggcctccaactccaggttgccgcaaaggacatgatgtcattcttgtttatggctgcgtagtattccatggtgtatatgtgccacattttctttatccagtctactattgatgggcatttaggttgattccatttctttgctacagtgaatagtgctataatgaacatacctgtgcatgtgtctttatgatagaacaatttatattcctttgggtatatacccagtaatgggattgctgggtcaaatgggtctgctttgagttctttgcggcttcaccaaattgctttctacaatggcggaactaatttacattctcaccagcagtgtataaccattaccttttcttcacaacctctccagcatctgttattttttttactttttaatgataatcattatgactggttgaaatggtatctcattatggttttgattttcctttttctaaaaaaaaatcaccatgatctcatcccttggggacagcatctattgaagttttagtgtattgtctttgagtctattttctatacagattatgagcctatgatatctcactttttccctttttcatttaacattaaatcgtgagtattttctgatgttattgatgatctgtttccattgttggaaatttaggttattttcaatttttcattattatatataacattctattgaatattttttcactcatatctttatatgttttgatttgatatttattttctgaatccacacttctaaaggtatatagtagagggatatttttggagattcttgatacgtattataatattttcctccagaaaatctatagtaattctactcttgttagaattttactagacccttccaatactgggtactagcatgtaaaaaatgccaaactgataggttattgtttcaacttacacttttttgcatgagattcttgccttttaaaaagcgtgaggctggcagggcacggtggctcacgcctgtaatcccaacactttgggaggctgaggagggtggatcacgaggtcaggagtttgagaccagcctggccaagatagcaaaaccccgtctctactaaaaatacaaaaattggctgggcgcggtggcaggctcctataatcccagctactcgggaggctgaggcaggaaaatcacttgaaccagggaggcagaggttgcagtgagccgagatcacaccattgcactccagcctgggtgacagagcgaaactccatctcagaacaaacaaacaaacaaacaaacaacaacaacaaaaaaacttggggctgagtatggtggctcacatctataatcctagccctttgggaagccaatcgctttgggcagatcgcttgagcccaggagttcgagatcagcctgggcaacatggcaaagcattgtctctacaaaaaacctaaaaattgcgaggtgcggtggcctgtaatcccagcactttgggaggccgaggcgggcggatcacgagatcaggagatcgagaccattctggctaagatggtaaaaccccgtatctactaaaaatacaaaaaattagccgggcgtggtggcgggcgcctgtagtcccagctactcaggaggctgaggcaggagaatggcgtgaacccgggaggcggaggttacagtgagccaagatagtgccactgcactcctgcctgggcgaaagagcgagactccgtctcaaaaaaaaaataaataaataaaaaataaataaatatatatatatataaattagccaggtgtggtggtggtgcatgcctatatagtcccagctactcctgaggctgagggtcacctgagtctgggaggtcaagtctgcagtaagccatcgtggcaccactgcattccagcctgaggaagagagtgagacactgtctaaaaactatttgtgtgcatcttggttggattatgagaggtctttattttgtgctctcagatttaagaattacttattttctgcttgtaaaatagacaaaagaggatggacatagtgtcaagatgctggagagaaaacccctgtgttccaggcagaactccacctccgcttctcaaacagattctccattttctattagatttgtagtgtctctctttttctatttagagtgtgtccttgcttgaagtagattatttctttctcaaatgaattttgtacaaatcagttaagtgtcttggttactgagaaaaatagattcaaaataaagaaaattatcttaaatggatttaaatttgcagcattagctgagaaacctgttaaatctctctctctaccaaataagcatgtattcatttagaatcactaggaaaatatacatcacccctgctggaagctattttgtgtccctggacttttgctctccaaaacatctgtctgtttttatttcctgatgctctctcattagcctttcttattaggacattggcaaataaacatggccctatttttttgtacttctataagaatgaaaatgccttcaaaacgaggttactggaaaagagccggttgaacaagtattattgagcacttattatgagccagatagttttctccccactggagatagacacttggatgaagcacagtccttgcctacttacttcttgtctagggaggaagacagatataccagcagatcaggtcagcacaagggtatgtgccggctagagattcacacagcatgtgcagtgaggatctgagaaagtttcttgtttgagataatgcttgaaggaccattaagggatagaaagttgaagatggggggccaggcgtggtggctcacgcctgtaatcctggcactttgggaggctaaggcgggcggatcacctgaggtcgggagttcgagactagcctggccaacgtgatgacaccctgtctgtactaaaatatacaaaaaaagaagcggggcatggtggtgcacgcctgtggtcccagctacttgggagactgaggcaggagaatggcttgaaactgttaggtggaggttgcagtgagctgagatcatgccactgcactccagcctgggtgacagagtgagactctgtctcaaaaaaaaaaaaggaaaattgaaattgggagagggataagggtggaccaggcgggagaacaaacagaaggagcacacttggttgggtatgacgtggcatactcagggaggaacccatggcccaatattgccgtgtgatgtaacatgatggcttgaacataccatttacatgtgaaccttcctgaaaccctattaaaatgatagcaaaggaatagagagaatggcaacttacaaggaaaaaaaaccacaacaggttgggtgatgatcacagggaagagagacatgtacaaaattttggaagatggaaagaggatggtaatggcaactgacagagcaagctgggtgaagctgagacccaacctcccacatgaggtgggtgggggtttgtaagagcagaagaatgcagtctagccagaagcccctagagactcaagaattggagatgacaggcatttctgatggccgggggaggggagcagatttgaacagaagggatggttagcagttatgtccccagatcctttcttcaactctgcacagccagagactgccctttctcatctggcagaatatgggaggtttactccctagagaagatgaactatagttcatagaggtggccttggacagaggataacaaggctgcatatgaaatgggatgacttcccagctccattacctctctagtctctattactcctgtaagcaagagtttgaagaatccacttaaaattattcagcctaaggaaaaggctgatagatctgacagctggtggtacccctaaaatggctgggttctgctcattaactattagtatggcatgcgagttgtaaggcttcatccttttgcataaagcagtcctgctctaaaataagaaaggaaaggcaggatcactagacatctcagtagagtctttgttataaaagatgttaacaacaacaacagaaaacagtaaacagaaacaacaaactttgtttctgtttaatgacttaggagatcatagaatgttttgttttgtttataaaccaagagcaaatagatatattaagataataatcataaggccaggtgcagtggctcatggctgtaatcccagcactttgggaggctgaggtgggtggatcatttgaggtcaggagtttgagaccagcctggccaacatggtgaaaccctgtctctactaaaaatacaagaaaaaattagctgggcatagtggtgcatgcttgtaattccagctacttgggaggctgaggcaggagaattgcttgaacctaggacatagaggttgcagtgagcccagattgcgccactgcactccagcctgggcaacagagtgagactgcactgcacaaaaataaatcatagaataaaaaataaatcttaaaagttaaaagttagacctgtagtcctagctattcagaaggctgtgacagtaggaacacttgaacctaggagttagagtccagcttgggcaacatagcaagaccctatctcttataaaacaaaaattaaacggagataagtaatttaataaagagttggaagacagcattgagaaaagttctaaaaagtagaaaaaaagaaatgaaaattaggagtggaaagatcaaaagaaattagatcagtccagtaggttcaacatccactaatgagaaaatcagagagaacagagagaagaaagtcatcaaacaaatgatgcaagacaatttcccagaatccgtaggatgtgagctttcagattagaagatcccacccagttcctacataattcatgaaaagaaaaaaaactaaactcacatcaagaaatgtaaatttaaaatttcaaaacaacttggatgaagaaaaagtcctgaaagctttcagagaataaatgcagattacatatagttggcattagattcctctgtagaaacattagatgacaatggaagaatgcttaaataattttgagagaaaaaaataatgttccatttagaactcttaacagtcatctatagaatactttgggccaggagcaaatgcaaagtaaacccatcgcaaaaatgtaggctcttaacaattttacctcctctgaatttgttttgaggaagctactcaagcacatgctccagcaaaacaaaggagtcaagtgaggaagatgatgaagagatgctccagggtaacattctagggtgacagccatgtagcagaccaagagatcaattattcccacatctttagagagaaacctcctagaggctcctgtggatgcaggaggatgcagggctccaggaggtatgtctctaaaggaggtgggaagtggcaacattgtttgattgcctagagtttgtgactacattaagattttttcttaactcctcgttcaaaaagcttgggactgtttactgattgtgttaggccattgtgttgctataaaggaatacctgagactgggttatttataaatataagaagtttaattggctcacttttctgcagcctctccaggaagcatggtgcttggcttctacttggcttctaaggaggcctcaggaagcttacagtcatggctgaaagcaaaaggtgagccagcctgtcacatggcaagagtgggagcaaaagagagagagagtgggagatgccacacacttttaaacaacaaaatctcatgtgaactcactcatcatccagaggatggcactaagccatttatggagatccacccccatgatccagacacctcccactaggccccacctcccacactgggaattacatttcaacatgagatttggctgagacatgcatcccaaccatattactgatagacacaaaacagcttgtgaaaaagcaaagcaattaatacagaaaaaaaacaaaagctctccaataaacaaactatacttcccatatactctgtagctcagctctgagcaatatattgtagtcataaaaatgtaaatatttcatattgatttaaacacaaattatggtataattattggaagaaggaggaggcaaaatgtgtatgtgaggtgggggtttgtaagaaaactaaatctacatcttcagtagcaggaagtcaattgaaaatgtgtattacacatcaagaaatactaacataatcattgttatttagcaacatggagattacaggagttgaaggagactgtgtatgttttattttaacaaaatttcaattaaacaataaatataaatctataccaaaaaatgcaagatgtgtgggatgaaagtacagtagaagaatgagttggagaactagcttgaatgatatgatcacatttagattattctggccactatgtgttgggtaaatttgaaggtgaattttgagataaatttgagagcccataggccataggcagtaaccagagagactgttgtaaattctgagctccacagcaaaagttaccaaattaacctctcttcattgcaaactaatcctagccatcaaagagttgtaaggctcttgcctgtagaagcaactttgctgatatctgagccctggagatgtaaggagaggcagctgcctggggctgagcagtttccttcctccagagaaattattccccaatggataggatcctttttgttaagccccagacagctctcacaagtttttaagaagctttaagtaggctaatttcattgcaattttaaacagaacctcaagttgctttaattcttactgttttattgctatattacacttgagaaaattgtttttcttataaatatgaatgaatgtttaggtagcagtgagattaaccatttgtttgtcacatttcaggcaaatgaattccaaaatgctgttttccattttgttttaattccgtgactattttttttcttccactggacagatattttaaacttgtatgaatcccaagctgtcagtctttccattttcatttcttccctgctttaaagtgtaaaaagatattatccctcagaatacttataaatattctattctgttttgtgttgcttttctatgactcttttatatttcacccttccttctagagtttattttggaatatggttcaagtttgcatcttttgttccaaagatctgtccctctttttagagaagagctttttcaaaataatcttataaataacccttctctttctcttatttggaggtgctaaatatattacattttatgctttttgtatataagtaggcttattttctctgtggtgttcttttggtctgtatttctttttttttcttcttcttgtcctttcttggttttgtagaaattactaaaaatgattttttgactaaagtctccaatctgccaggcactgtgccagcagtttggagaagagcaaggcatcttggccccagaggacttcaaagagagtgggagaggctggtggctatttatagtccttttggtcacttttagagggccttagaaagtaagacaagggcgtgagccattctgtgggaggcagaaggtgaccttgatcttattggcaagcaggagttttccctctaaaggggaggcagggcatttgagagagagaacagcaagtgcaatgataagtagctcagcttgtgaaaaagcaaagcaactattaactacaggaaaaaaacaaaagctcttaaagaaaggaattgcaattccaggcactccatggctcaggggacagttcttggattttgggattaggggaaatggaaaacttttggctagagaatagtttccagattgaattgtggaagaaaaatttggagtggaaggaggaaaccaggctgggaagtgcctcatgttctagccctgggtggggactttcacattttcagtagatgccagtaaaagattagagtcaggatggtattattattataatttcttttttttaaataatgataactgtggcagaaatgtggagaattgaatggagaagatggaggctggtagcaggatggctaaatattaagtcatggttaccaacgtttattgagtgccaactgtgtgcgagacattgccagagagagaagaggggtgtttttaataatacagcaagcactttattattattgtgctacttttatacaattgttttcctgtaacaaactaaggactaagcagggataaggtggaagagctggattcaggaaaatcctagagagaattagtaaaatgaggcaactaattggaaatggatgaagtgggtgcactagcttgggagatggagtggaagtgatcttgttaaccaggagagagaatgctgtaggggttcacgttttgtaaggaagacagcagctctgcttgtccggcgtttcccaaagtattggttttcttgagtaaccacaggacataatctgtctggctttatttatgatttggctctgtgtttgtaagaagataacctttggtgacaccagaagctgggcaaggctttctaagcccccactgttttttttttgttgttgttttttgttttttttttttgtttttttttgctgagacataccattctatatcacactgtggcatagtaattatctgcttttccgattatctcgtactgtgagggagggaccacagaaatctgtctgtgcttattaaagccactgctgagatccccgcaccaattttatgatatgctttctcctctcaaaccatgtaggtaatttatgagcggtttctactgctgttatcttcaatttctcctttggcctcctgcttataaatccagatgtcaggtttctttggaattcattttgcttcactcagaaagtctcctctttctttcagcacaacaaattctaacccattttatcccgacaatgtctgctttggatgcggctggcatgatgaccctgtggagcatcctcatgtcatgcccagtgaacagaggcatgttgtggtctggaggtcaggaatgatgtctgggctgaccatgggtatttgagaatcatccaactccagtgggtattttaggttgggtctgtgtgcatgtgactcgtatgtgtatgtgagtcctggtcttataatgaatgagtggagcaaatctactcatggctcaatacccaactcaagtttccctccgctgtgaaaaggacacatctgattatagtagctgcagtggagctttttttatatgaatcattcctctaacaatagataccctgtgtctcacaggtcggtttttatatagggtgaaagtgccttaaaaagagtcaagaatccagctgggtgtgggggctcatgcctgtaatcccaacactttgagaggctgaggcaggaagatctcttgaggtcaggagtttgagaccagcctggttaacacagtgagacctgtctctactaaaaattaaaaaaaaaaaaaaaaaaaagctggatatggtggcttgtgcctgttgtcccagctactggggaggctgaagtggggggattgcttgagtccagagtccaaggctacagggagctatgatcgtgccactgcaccccatcttggataacagagtgagatgagtgtgtacatgtgacagtgtgtgtgtatatatatttatatattatacttacatattatatatattttaaaaggtcaaaaattctatgttaaactttctttttcacagactcacatggacacagagagtagctgtccaatgagtaataataataagtagctgtatgcttaggagtgtccctgaatcactaaccacaataatttttcccttttattgactaccttttatgtttttgtcgctgtatggcatgttttattgatctcatttaaatttaactgctctctgaaatagctattcccatcccttcttttgtaaatgaggcaaggtggccttggagaggttaagcaacctgcctgaggtcacacagctagtaagtgcagggacctggattcaaacccagctctgtgtgtatcttcaaggtctgtggacgtccccacatcaactgcctaaccttctgtgtctgcagaatggaaccttctcctctatgatggggttgccagaaggaaaagaaattctgagtcttacagcaagtggacagtttatctagggaatcttgcctgttgggggggcgggggtgggtgggtgggtgggtggagttacttctttagttttcctctcttggtacttttcaattctttcgaagctaacaaaattccaaaggagctttatgttaaatttgagtagctattgcctgtgatggccctagtatgtagtgtaatacagttgaaaccctctttaaggcatacagtatttttttttttaaataaaacatgggaaagaaaaattgtataatattatgtggcttaggaaatgtcttaccatagagtttataccgaggaggaacgttatttgctaacgcaggtcttcacgcagcaatgggatggaagagtggagtatgtaagttgaggggtgccctttcctttagtgtgtgagggtgatatgattcctgcagtacttatgggtgaatgttcatcccacttttgcagattccctaggtctgaagaagatatctgggccacctaaaaaccttcatgagagagttatacgtgaaggttaagagcctggattcagaaatctaacttctaatctcagctttgtccctttctagctatgtgaccttgggcaagttgcttaacctgtctgtgcctcagtttcctcatatgtaaaatggtgatgtaatcatatctactttatagaattgctgtgtggattaaattttccacgtgaaatgtatagaataatatacctatacatttcacacaataatatacctatacatttcaggcacaagccaccacacctggccataccccttatcatctttaaaacaccttacattaaatgacaggatcttcaggaaaatatctactgaaaagtgatatatccttagccttgcacttacatggaaaactttaatctaggacaatgggcatttccttgtccccaagcagcacagaaatccagagggtccagcctgagacagatgccagggtgatggtgagagtctggggagggtattttccttcataaggttcttcccaggcctggatcagagggggcagctgtggattccccacagccaacatattgaggaagattcagccctcactagggatgttctgaggtcatgggagactttgtgaaagttggaggatgggctcagctacctcctgcttctgcttcctccatagtagtcagaccagaagaaaaaaaaagtataatgtgtgtttttcctcttttcatgatttgattttttccacatattgaagtaatttttccttgaaaaggactgaatattaaaaaatacattttatgtctgtaatcctagcattttgggaggccgaggtgggtggatctcttgaggtcaggagtttgagaccagcctggccaacatggtgaaaacccatctctactaaaaatacaaaaattagctgagcgtggtggtgggtgcctgtaatctcagatactcagggggctgaggcaggagaatcgcttgaacctgggagaaggaggtggcagtgagccaagatcacaccattgcactccagcctggaccactgagtgagactctgtctcaaaaaaaaaaaaagaaatggatgctcttgagacttaactgtgtaagaaagaattcccacttcttttagaggcactgccagccccaaaggttatgaattggcaatgttaattagatcttttcttggaacttgaaagtattctcacctgaaatgcgtttaaaacaaagttaccatcaagattcccctctgtttctttctagagagctttctggacaagtttcaatgtctttcatggagaatttgaaaccagtggatagaaagcagtgtcaaccttgtcctgtttatgcaaatggatctgctctgtcacctgtttataacccccggggtcattgactctcaagttcacattccccagatgtagatgcagctatgggacatggaattcgcgatttattagtttgaatcaaaccaatgttgagatttacagtactggctgttgttgcttctgctggcctttgatagtttaagtaaggattgtagacagatgagagctgcaggaggggctagctcatctcatctaatattcagaaatcctcacactgttactggggacttgagagttggtacttaaacaacctttgtgtttctaggggattatcctgtctgcctagtccattgcttcctcactctagcagtgcactgagttaaaaccaacccatcctaaacttgcctccaggcgtctacatgggcacacacacatccccacaccctacaaggaaacccaagctggtttatacaagctcactttaggcagtttgccaaattatactccgattcgttcagtggacagatagttacgtgaaatacttgcagtacgggaaacatttgtttctcagccctggggataatcaatagaggcaaatgcctttgcaatcacaacgcctgtttatgtgtggagttcttcattgttcttggtttgtgagtacagtaaacattctccaagtggcagcaggagagaaccacggtgctttcgtaacaagctgagatttacaggcttgtaagagctggggttataaatcaggcttctggtggaatgggtgaaatggactaaattcaagtattaatgggagagccacgtgtgcgctgtgcagggagaaaggctcatcagtattacagatggcatgtccctttagttaatttagaagaaattccgatcacccaacagaactctgaggatggatgcaggaaaaagaagactgtggcatatggagggaacatatttgttcttggaaaatcagtagaaaatgtttaatgtcatcataacctcatttgcataaaaatagtcacatgcggtaaaccagataaaagcaaaggaagacgtgacggaaccaatgctgtttggagtttcgtttcattatgaataacataaataattcaattgaataaataaatacgaaattgctttaagtagatgtactacaagtgattattccttgaaaattccttaatggtacgtgccccaatgatgaagcaatgtgattatgtctccatgggcagccctttgctggacacttgacccttgacaataatattgagctctctgtagctctcaagtgttttatgaacacaaatgaagtttttagtttcacaatcttattcataaacatgatcttgaagttgtttaaatagacttatcttcattgtgatgaatgcagccccactttgcacatggttgcgcttaggcaatattagataatcagaagtttgaagagtcttgggctgtgcggtactagaaacataattctaaataaatatttggaaccctggtggcagaatttgagctgttgtttctgcctcacagagtctggtcaggggaattcttgtgtaaggacaaattgtggcatggataaaattgatggaaattatttatgagttaaataaaaataaagaaaggaatttatttatgatttcaacaaatgttttctagggttttgtagaaagccatgcacaggtactatgggagctataacagatgtgtatgacacagtccttgtactcatttgattttattcattcactcagtaaatactcgtcaatcagctcccacacaccaggcactatgttggaggttgaggttataagggggagacagatgataaactgggaaaaataaacacgagctaattatagattgtgataaatgttttgaagtaaatgaacaggtgctaacatacatctgacccttaaaatccctgggttttacatctgcaaattcaaccaactaaggatgaaaaatactagaaaaaaaataaaaataaaaaatagcaatacgacaataaaaaatacaaataaaaaaacactacagtataatgactatttgcatagcatttgcattgtattacatattataagtaatctagagattatttaaagtatccaggagatgtgagtaggttatgcgcaaatactataccattttatacaagggacttgagcatccttggattttggtatccatgagggggttctggaaccaatcccccttagatactgggggacaactgtagagagtaaatggaaacaagagtgtactttagagaaggtgaattgaagaggcagaagagatgaggataaaacagcagctcaaaactctggcagcggctgggcgcagtgagtcatgcctgtaatcccagcactttgggaggccaaggctggtggatcacttaaggccaggagtttaagatcagcatggccaacatggcaaaatctcatctctactaaaaatacaaaaattagctgggcatagtgttacacacctgtagttccagctactcaggaagatgaggcacaagaattgtttgaacctgggaggcagagggtgcagtgagccaagattgagccagtgcactcaagcctgggtgacaagagagaaactgcatctcaaacaaacaaacaaacaaacaaagaacataagtaaataaagcctctgtcagaaaacctctctggacagaaagaatagtgcctagaaaaccctaagtttggaatgggcttgatttaggaactgatagcagatactggccaattgtttgagggtgatggaagggaggtaggaaccatagcatgtgggattgtgggcaatgaatctgggatttatttcaatgggaacaaaagtgatatactgggttgataatatacccccaaattcaagtccatctggaacctcaggtcaccttatgtggataacagggtctttgcagatgtaattagttaaagtgaggcatacttgattagagtgctccctaaatccccaagatggttggtatcttaagaggagaaaacacggagactaagacagagacagaaggaaggaggccaagtgaagacaggcagagattggaatggagcatccacaagccaaggagtgctgggaattgccagcaatctccaaaaagtagggaaggcaaggaaggattctcctctagagccttcagagggtgcatgcccttgctgaccccttcatttgggacttctggcctctagaaccatgagagaataaatttctgttgttgtagtgcccccattttgtggtactttgctatggcagcctagggaacagatattaaaggtcatggtagccactggggatttgacatagcgaagtgtcctgatctggggtatgtttttagaaggtcattctgaatgatgtttggagaatggattgcagagtgcagaagagatgtaaggagtccagtttggaggatagtgctagtaggagatgatagtgattccgactagggtgtgcctagtgatatgtgcctagtgatttggctgtgtccccacccaaatctcatcttgaattgtagctctcataattcccatgtgtgagagggactcagtgggtgaaaattgaatcatgaggtcagtttcccccatactgttctcatggtagtgataaagtgtcgtaagatctgatcgttttataaggggaaacccattacacttgactctctaattctctcttgccgctgccatgtaagcagtgccttttaccttctgccatgactgtgtggcctccccagccatgtggagctgtgagtccatgaaacctcttttactttataaattactcagactcaggtatgtctttatcagcaacatgaaaaagaactaatatacatagtaagatgggaagaagtagagatttatggtggaggtcatcaaggaatactactgggttttaggttgcaacatatgggtgcacggtagtgccatttactgaagtggtaaaactgaaaaacagatttggagggctctttaagaattctacttgggatttgttaagtttgatttgatgtttagtcatatattgggagatatcaaatagatggttgaacaatttatgaatctggagcttgagagagagataggggttgggagatagacctttgaaggcatcaacatagacgtgaccatcaaagctgagatcactaaggagagagagctggagatgtggcagcagcccaggagtgagtgctgtgccactccaaaatttagaacgtgggtagaggagagaaattcagcaaaggatgtggagaaggaacaactaatgaagcaggtagaaatccaggaaaaagaagtgacgtggaagccagaaaaggagtgttccaggaggaagcagtggttactggtgatgagcgatagtgagatgccagaatcgttcagcagatttggcaacatgaagttcattgatgacctcaacaaggatattcaaccctgattggggttgattaaggagtgaatgggagggaagaaatgagagagcaaaatgactactctgatgaattttattgtgaaagggagaagaggcatgctagcctgagggctttggggggtgggggtcaaaggaggttattattattattattgttccttataaaattcccattttgtcataacataagagttacagaaaagttgcaagaatactacaaaaaattctctattttctttatccagtttccttaaaggttcacattttacaatatttatatatctccatgtgtatatctatttttttctgaatcatttgagtgtgagttgcagacatgatgcccctttgtctctgaatacttcagtgtgaccaacccaagaacaagggcattctcttacataaccacaggacaatatgatagtattgcctatccacatttcaccagttgtctcaataatgtcctttacagaaaaagaaagtcctagatcatgtattacattcatttatcatgttttattttgaaacagccctttagtctttgtctttcatgacattgacatttttgaagatgacagtccagttattttttaaaatgcctcttaattcatatttgtccaatatttcatcagaattagattcagaatgtgcttttgtggcaggaatactacaaaaatggtgttgcatctgttgcatcttatcaggacacacatgagggaaaggaacagctaatgaagaaggaaaaaattcagaagaatgtagtgacatagaagccactcattacttgtctcattactggtggtgataatattgattcctgggttaaatgtggtgtattaatctgttctggcattgctataaagaaatacctcaggctgggtaatttacaaataaaagaggtttaattgactcatggtgtcacaggctatataggaagcatgatgctggcatctgctgggcctccggggaggcctcaggaaacttacaattgtggcggaagatgaaggggaagaaaggtttctcacatggtgggagcaggatcaagagagagagagaaggaggtgctacacacttttaaacaaccagatcttatgagaactcactcacagtaccatgggggaatggtgttaaaccgtaagaaactacccccatgatccagtcacctcctaacacaccctacctccaacatcaggaattacaattcaacatgaaatttgggtggggacacagacccgtactatatcagatggtgtctgcatggtagtcaattatgtttcctaatacctccaggacaatgttgaattagtggagatagtgggaacccttgcctttcctgtctttgacagaagtgcctctagtgtttctcattaagtaagatgctatctctatggctatggtatagtttattgtgttaagaaagtattcattagttttaatgatcttgagggttcttttattaggatgggtgttgaattttccaaactcatttcagttttttcagtaactataccgaaaatcatcaatttctttcttcctatgtctataaatattttgcattataatagtggatttcttaatgttaaaccaaatttatattaatggaatttattccattaggctatggtgtattattttcttaatgtgatgttggattctgttcactaatattttatttacaacttgtgcatcaatatttgtaattcattctctctctctctgctttccttaagaagtttaattattaatacattacaaaaggaattaggttttcaatcctctggaacaatttatggagcattatgactatctggttcttaaatgtttagtagaagtcacctgtgaaaccatctgggcctgatgttttttatggggtagtttcttgatggtttttgcaatttttttcctgaggaaatagctctgtttaaggtttctgtctctaatgatgtcaaccttggcaaattgcctttccctaggaaattatccattacatctaggcttttaaatttatttgtatagggatctgcaaatgagtctttatttttatttttaacagttatttgtttcaatgattatttccccctttggtttcttatttatgtatttgtgctttctcttttttcccataagttagttaaatgtggtctactttgttaattatgttttaaaaaacagaattttgatttattcaagatcttgtatttttctattctctgacttattgagttctgctttttatgtttattattgccttccttgtattttcttttgacttactttgttgttgttttcctttctgaaaagcattctaagttggaaatgtaattcaagtatttttattgctaaaaggttttaaggctttgaatgtttttcttcttaatgcttaaaacttcccactgattgtgatatgtggtgttttcattaccattattttttagaaatgctttaacttcggtttgtatttaccttgtcactcaagacaggtttagtaggtttttgaaatttgcagatggataactttttaaaaacattattaataattttaaattttattgcatagtgatcagagagtgtctttttttttttaagatggagtctcactctgtcacctaggctggagttcagtggcatgatctcggcccactgcaacctctgcttcccaggttcaagcaattctcctgcctcagccttccgagtagctggattcacaggcgtctaacactatgcccagctaatttttgtgtttttggtagagacagagtttctccatgttggctaggctggtcttcaactcatgggctcaagggattcacccacctcagcctcccaaagtgctgggattacaggtgtgagccaccatgcccagcagattctattttacaactgttcccctgaggttgagaagatgtgttgcctgttttctgagagcagtgtgtatttctatcacatgaggcattctgattttctgttttcactttcttctcgatatagttactttgtatatacggagtctgcttcctttttttttctgagacagagtcttgctctggtcacccaggctggagtgcagtggcgcgatctcggctgactgcaacctctgcctcctgagttcaagcgattctcctgcctcagcctctgagtagctggaattacagacgcccaccaccacatcaggctacttttttggagttttagtagagatggggtttcgccatgttggccaggctggtctcaaactcctgtcctcaaatgatcctcttgccttggcctcccaaagtgctgagatttgcttacattcattaattttgttgatttgcaatgattcacaagatttgtagttcaaagggaccattgtctgttagtgtcacaagtacggtgcctttgtctgtgttgctgtcaaggaatacctgaggttggataatttataaagaaaagaggtttaactggctcacagttctacaggctatacaagcatgacaccagcatttgctgaggttctgtcaaaggcctgaggctgtgcccactctcagaggagggtgaaggggagccagcctgcagagattgcatggtgagagtggaagggagagaggggtggcaggtgccaggctcttttcaacaattagctcgcagggaactctcttgagaactcacagagtagagaacttactcactaccatgaggatagctccaaggcgttcatgagcggtcggccccatgacccaaacaccttccagtgggccccgcctccaactttgggaatcagatttcaatatagcgtgtcaaatatccaaaacatagcatataaattctgcagtgagcatatatatatattttttagatggtgtctcactgtgtcacccaggctggagtacagtggcaccatcttgagtcactgcaaccaccgccttctgggttcaagcagttcttctgcctcagcctcccaagtagctgggattacaggcacgcaccaccatgcctggctaatttttgtatttttagtagagacagggtttcaccacgttggtcaggctggtctcaaactcctgaccgacctcaggtgatccaccctcctcggcctcccaaagtgctgggattccagccatgagccaccatgcctggccagtgggagtgttttttgtgtgtgtttgcgatagggaatatgttgtgtcatctggcctctgggttttctcttatttagggacccccaacccacaggccatggactggtacgagtttgtggcctgttaggaactgggacgcactgcaggaagtgagtggcaggcaagtgagcatgaccgcctgagtgccacctcctgccagatcagcggcagcattagattctcataggagcgcgaaccctattgtgaactgtgcatgcattgcacgctccttatgaaaatttaataccttacgatctgaggtggagcagtctcatcctgaaaccattccccatccccccacacccttggaaaagttgtcttccatgaaactggcccctggtctcaaaaaggtgagggactgcttttgaagaggacactaagttttccccttttgcatattttcccattcaccactcagtgtttaaaggctgcctccccatactttttaactttcttctctcccagaaacaatgccttgagtcatgcagatttaaagtcccgtctttggctaggtgcttacgcctgtaattctagcactttgggaggtcaaggtgggtggatcatttgaggtcgggagttcgagaccagcctggccaacatggtgaaactgagaggtgaagcctgctggacttactgggttgagtggggacttggagaacttttaaggggattgtaaaatgcaccaatcagcgccctgtagctagcatcaggattataacatgcaccaatcagagctttgtaaaatgcaccaatcagtgctctgtaaaacgcatcaatcagcaggatcctaaaagtagccaatcgcagggaggattgaaaaaagggcactctgattggacagaaatggaacatgggaggggacaaataagggaataaaagctggccaccccagccagcagcggcaacccgctcgggtccccttccatgctgtggaaggtttgttctttggctcttcacaataagtcttgctgctgctcactttttgggtcggtgccacctttaagagctataacactcaccatgaagatccgcggctccattcttgaagtcagcgagaccacgagcccacaggcgggaaccaactgcggacacaaaacctcatctctactgaaaatacaaaaattagccaggcatggtggcaggtgcctgtaatcccagctactcgggaggctgaaggggagaatcacttgaacgccggaggcggaggttgtagtgagtcgagattgcgccattgcactcctgcctgggcgagagagtaagattctgtctcaaaaaataaataaataaataaagttgtttgttacagaacctgatcttatctaccagagctcgttttccatattttcacacttaagctgagtttccccttctgatggttcttttagctcagtcctactcttagcagcagcttcccactttctggttccacagttttcctagattttccttgcgctctgtatgaaggtttgcaataggagtgggagagagaaagctcactggtagtttgtggttttctactttgttgtaatttgttcttttaactgtatttattattatgttgtaaaacgtgttcagagatatgtggaacccagaattttcactgattatcataagtttgcttttctttcttttttcttttcttttctttttctttttctttttttttgagacgtggtttcgctcttgttgcccaggctggagtgcagtggcacaatcttggctcactgcaacctctgtgtcctgggttcaagtgattctcctgcctcagactcctgagtagctggaattacaggcgcccaccaccacatccggctacttttttggagttttagtagagatggggtttcgccatgctggccaggctggtctcaaactcctgacctcaagtgatcctcctgccttggcctcccaaaattctgggatttgcttccattcattaattttgttgatttgcaatgatttacaagatttgtagttcaaagggaccattgttagtgtcacaagtacagtgcctttgtctgtttgtgttgctgtcaaggaatacctcaggttggatactttataaagaaaagaggtctaactggctcacagttctacacgctgtacgagaagcatgacaccagcatttgctcaggttctgtcgaatgcttgaggctgtgccacctctcagaggagggtgaagaggagccagcgtgcagagatctcatggtgagagtggaagggagagaggggtggcaggtgccgggtgccaggctcttttcaacaattagctcccagggaactctcctgagaactcacagagtagagaacccactaccatgaggatagctccaaggcatccatgaggggtcggccccatgacccaaacaccttccagtagacccccgactccaactttgggaatcagatttcaatatggcgtgtcaaatatccaaaacatagcatataactactgcagtgggtataattttttttttttttagacagatcttgctgtcacccaggctggagtgcggtggcaccgtctcggctcactgcaacctccaccttctgggttcaagcagttcttctgcctcagcctcttaagttgctgggattacaggtacctgccaccatacccggctaatttttgtgcttttagtagagatggggtttcaccatgttggccaggctggcctcaaactcctgacctcaggtgatccacctgcctgaaatgaacgaataaataaaaattcatgataatccaatccagggttgatttccgtttatattgctgaaaccatgtaaggtttcaaccagatgagatgtggtctccacgatctccccacttggttttaagtggggagatactagattgaaggcttatgtggatgggaatacttacctacatcagtgtagacagctacattaaaatcccttgaggctcttattgaagtacagattcccaggttccaagtttcaaagaactgaagtattaggttgcactgtatgaaattgctatttgtggccaaatatcaacaatctcacatgatccaaccaaatatgatgaaaatcccacagtactgaagtaaacctactgaatacaatttgatatcttagctgttttataaggacttctagtgaactcatttgttcaaaaattcattcatccgatcgaccagatataaattatgactactaactcggataagatgtgatctctaccatcataactactaaataaaaggaaaacatgtgatttccagttcagatgagtcactgaagcaagaaacccagaaggaagaaccaacttgtgatgaaaaagtcattttccaagttcctgggactatggataccgaacttcggttatcactttaattactgcagatatacaagccacgacaaactggcctgatctatatataattacagacacaagaaatgctttggttttactaaatttcagatatcacattgccattgttcctctctcctaataagagtgtgtaaattacagatacagatgtttttaaaactttctgatagccagcgggtgcagtggctcatgcctgtaatcccagtactttgggaggccaagatgggcagatcacttgaggccaggagttcaagaccagcctggccaacgtggcaaaaccccgtctctactaaaaaaaacccacaaaaattagctgggtatggtggcgggtccctgtaatcccagctacttgggaggcagaggcacgagaattgcttgaacccgggaggcggaggttgcagtgagccaaggtcgtggcactacactccagtgtgggtgacagaacaagacgccttgctccttaaaagacgtccttaaaaataataataactttctcgtagctgtatttcacatcaagaaacaaataatcctgataaaacttatttgactagctacttattggtatcaacaagctcttattgaataaatatgtaactgaatgacatcctgggggctcattattattatatgagttacccaaagttcccagaatttctggtatgcagtgctgtagccaacagtggtcattcctatatctgcttttacagtttttactatctataccagttactctcaaaacttcatgggcataagaaacacctgggggggtgtcaattgaaatacaaaataaataaaaaataaaaaaccactatcaacaacatttgagtcttgcattttacctgtgatatgggtgcctacagactttatcagtgtgcttctcatgggaagttttagcacttgaaacccagggacaccatttctattatctgagaccgccttgaaggtttcttcccctttcgatattcctctctgttctttctcactaattcttggaaagtcatcttcaattcagttcaacaaatacctattgtatatttactatatagtagacacagagctcagagcttaaggaatgtgaaaatgcacaagacctgccccctggctacgaggagttttttcatctagtaggagaagcatatgtgtctggctataatacttggcagaataaaatagctgtgatgttgagtttcgttgagttttatttctattgcatagattgaatgtcttcagcttcaggttgcaaatcctggtgactccagcacaatatgtgttataaatagcattgcatcttgactgcaaatgaactcagagagagagagagagagagacagagagagagagagagtgggcaggcaggaagataaaaggttgagcacaatttgggcgtttgtttatgtgattgaactacggctggggctgggctaggtgctgttcatggctggaggaggcaggttcttttcctgtatgagatttttactttttatttttattttttgagatggagtctccctcagttgcccaggctggggtacagtggtgcagtctcagctcactgcaacctctgcctcttgggttcaagagattctcctgcctcagcctcccgagtggctaggattacaggcgcctgccaccacgcctggctaattttttgtatttttagtagaaacggggtttctccatgttggccaggctggtctcgaacccctgacctcaagtgatccacttgcctcggcctcccaaaatgttgggattataggcgtgagccaccgcgcccggctttgtatgagattttgtctttgtgactaaatcacttctttgtgtacaaacttacattctgcccctgagcatgtgtgttcatgcttaactgattcaaagactacatttcccccaacatattacaccaaatgtacttaacagcaattagaatgtttgccgcctgctgtgtgcagatctccccagaaaacaaaattctcctaaatggcagtataagtaattctgaagattaaagctggtgatttgcagagtgcttggttcgctggcttcctgcaaatatcaagattaacaaagaaattcattgatcccattttgcctccttaatgcctgtgcacaggcctaagggaacgcatcccacgtggctgtgtgattcagatgaagacttgctgttgctttttttcatggccaagatgctgatttagtggcatttttcttggcaaaagtgccccaagaaaacaaatccatttgtgtatatttttacgggaaacgctccacctaaccctgccccgctgaaagccttccccgtgagtcgtgaaggaaacatggctgatttgctactgttcaaagggcgactcaggtcttgactgaaagaccgtacacgggttgtttgatgctgtgtaaatctcagccacgctgaacactcctttccccaactctaaatacaggacccctgaacatgttgccctccacaccttcttccatttctttctttctttctttctttttttttttgaggcagagtctcacattgtcacccaggctggagtgccgtggcccgatctcagctgaccgcaacctccatcttctgggttcaagtgattctcctgcctcagcctcctgagtagctgggattgcaggcacgcaccacgatgcctggctaatttttgtatttttagtagagccagggtttcaccatgttggccaggctggtcttgaactcctgacctcaagtgatccacccacctcggcctcccaaagtgctgggattacagtcgtgagccactgcacctggccactttgttccatttctaatgtgttaatgtactcaataagcaatagttttggagtgtagatggtgtaccctgaaatgcaccaggcactggaaaatacagtggtgattgagaggcaaagtccttaccctcagagcagagcaatcttttgcaaacacacgttgtgtcctggtcactctagtgagaccagcagccaatgccagccgccagtttggcggctttctctggacagctccatcacccccattccctttgattgagacctttctgtgtccatgatgatctccccaacttggaattctgctccattctctgatttcttcattctccgacttcaaaaccagccttctttagtattcccttccagcagttaagtaactttcgtatagctgatattaaaaagaaaaccctagacaaattaaatgaaacagagtttaattgagcaaagaaggattcgcagatcggacagccgcgtggtggataaagatttaaggacagcaaaaggagagtggtggacggaaaacagaagcaaggtagagaagcagcttcttgattacagctcagtgtttgccttacttgagcacagtttgaacagttggccacctttgattggccgaaactcagtgattggcacaagaataggtgacagtttgtttccatatccagtaaggttacagtccactatttatggagaaaccttgaggtttaacttaaagtatgcaaggaggcagctttaggctaaacttacatatatacatgtttttttccataagttattggggtacaggtggtatttggttacatgagtaggttctttagtgatgatttgggtgcacccatcacccgagcagtatatacagcaccctatttgtagccttttatccctcacctcccctcccacttttaccaccaagtccccaaagtccattgtatcattcttattaggctaaacttaatttaacagtagttagtggcaggccagagatttgaagtcaggcctcagtacagatttggtgttctgccttcctcagttcttggcatgtaggatcttggtgctcccacacagttttatcttttccttctctgagtgtcctggatggagtgtctcgcttcagtcctggttttcacaggactcagtgccctccaccaatatcctgctgggcctaattctgcctctcttctgtgaggtcgttgtatggggtgggattcccaaggcaacataccattttgccaggtaaatggcattcctggcaatattcctttggaccagtgaggaaagtagaacattttatggggtagtgcagatgtgtgactaaatatttttcattagaacccgttttcaatgactcattaaagcaatttttaaacccaggcatggagtcagggagcaaaactgtcttagggagaaaagagggaggtatgtcaggacactcattttgaagaaggcatgactttgcctactagagcttagcatgctttctgcttacaatcccacctgctggctgagtggagagcaaaattctttaaagatgtaggaatgtaagatgagaggaactcatttgctggggctgaatgccaagtgaaaattccgcttctttaatctacttcccttctcctatctttcccctgcattcccagatttctaaaaggaatcattttaatacttttttttattatttttattttgagatggagtctcactctgtcccccaggctggagtgcagtggcatggtcttggctcactgcaacctctgcctcctgggttcaagcggttctcctgcctcagcctcccaagtagctgtgattacaggcctgtgcaacaccatgcctggctaacttttgtattttcagtagatactgggcttcaccatgttggccaggctggtctcacactcctgacctaaagtgatctgcctgcctcagcctcccaaagcacggggattacaggcataagccaccacatccggtcatggaaggaatagtttttgtttttttgaaacagagtctcgctctgctgccagggtggagtgcagtggtgcgatctcagctcactgcaacctctgcctcccaggctcaagcaattctcctgtttcagcctcctgaatacctgtactacaggcgtgcgccaccactcccagctaattttttgtagttttagtagagatggggttttaccatgttggccaggatgatctcaatctcttgacctgtggtgatccacccgcctcggcttcccaaagtgctgggattataggcgtgagccacagcgcccacccaggaggaatagttttaatctgttgcatccatcactccctccacagctcagcatagtaagcactgtattgaaatgtgcagatgtctcctatgatttcctgccaaatttaatagttttaatagagttttaaattcttttttttttaatttaaagaaagtatccaaatgacagttgaatatgttatttatgaattgtctagatcagcagttcccagcctttttggtaccagggactggtttcatggaagacaatttttctatgaactgggggtgaggggtgggttggtttggggatgattcaagctcattccattgattgtgcacttgtttctattattattacattgtaatatataataaaataattacacaactcattacaatgtagaatcatggggagccctgagcttgttttcctgcaactagacggtcccatctgggggtgatgggagacagtgacagatcatcaggcattagattctcataaggagctcgcaacctagatccctcgtatgctcagttcacgatagggcttgcactcttacgagaatctaatgctgctgctgagctgacaggaggcagatctcaggtggtcacgtgagtagatggggagaggctgtaaatacagaagaagttttgcccactctcctgacgctcacctcctgctgtgtgacctggattctaacaggtcacagactggtattgttccgaggcctaggggttggggacctgtgatctaggtgtatacatagaaaaagaaaccctcggctgggcacggtggctcacacctgtaccagcactttgggaggccgaggcgagtggatcacgaagtcaagagatcgagaccatcctggccaacatagtgaaaccctgtctctattaaaaatacaaaaattagctaggcatggtggcgggcgcctgtaatcccagttactcgggaggctgaaacaggagaattgcttgaacctgggaagcggaggttgcagtgagctgagatcgtgccattgcactccagcctggcgacagagcgagactctgtctcaaacaaacaaacaaacaagaaatcctcttcaagccccagccccagatctctctcttctcagcaaaggtgactactgttggctgtttcttgtgtgtccttctgctgttttcttatgcatgaatatgttagacatgtccatttttaatcttgaaagattctgccgacttgctctctaaaggactctgcctgtttatatgtcacccaacagtacatgagtggccttcctcacacctgactccctaggtaagaccagtcttcatttgttttgccaacctgaaggctaaaaaaatatttctttatagttcttggatgcctttctttgactattacagaggttgatcatctcttcatgtatttattgaatatgtgggttccttctgttgatttctgagagacatttgttcatatcactcactcggaccgagactttttgtcttttagttcatggattttcaatacattttgttctacctattggtgaactatgttgttaggtatgtatattcatgactatttaattgtctcaagcaatacctttgatcaataaaaaacattcctctttgaccctggattccttcatgtctcttgtaaaaccactgccgtaatcttatccatctacttctcttgcctctcctcatcaatacttcttccttataggcttctgagtatctttgtaaaacatcagtaggttctagctgggtgttagcctgaggataaactgatgaagggtatgggaccaaaaaacatataggtggaaaccccaaatcccaagcgctggccatgggtttaccttgacatgtgtgcaggggaggtgggaaggggacagtctggaccactggcatttggaccacacatcataatgacagccgagaagggaacctatttggtatagaccgagcttcccttctgtttgacatgtttgttggtggtttccagacaagtgtccctaatctatgtggttgtttgcctttaacagatggttccaggttacagtggggcccccaatgcctgaggccaccgggaaattgagaaatcagatctagtgagttgccaatttctttgactggtctcactagccactgacgagtccaccagctcctttcaaatttaatttcaggggtcaaatgcccccttctatttggggctcttcctatcagaccaaatgccttgtttgtagttctgatgatttaggctggaaaacaccgttttctgccaacgatgcagtcagctgcatagaacaagctgccattgttaattaggtaagttatgtggtcaaggaagtaccttttactggtggtctttattcagaataaggaagaggggacttgtgatggagccacacagagaactagcaggtcaccagccagagcactggaccctaggagaggacttgggctctctgagccagttctgactgcccacggaagatgtctccacacattccccattgcttggggccaaaaggcagtggcagaatctctggggccgtgggaggagccgaagaacagacgtggggagggggaggattgtgatctggggaagagagcgtgcacacacgcatcttggttggacctgaagggatgctatgttgttctttgattaacacacatgctctgtgtaatgtcacttctctggtctaaaacccttgacactgggacttcccatgactggaggatcaagtctgaattttataaggtggcttcagaacacctggtacactgctgtcttcttttcctcgcctcagtcccttcctgaaacatctatttcagtttcttggcggtacattgtacattttctctcctctgtttttacacatgctattcatttttttcctagagagtttttcccgtcttcctgtctccccctttgcaggccctcacctggaaattacttactcatgcttcatgacccagttcaaattttgtcacctctgtgaaaccttccctgggccccgttgatctccttgaaggcagaaataagctcccagagcaggatgaacaaacgtctcttgtcgcatttatccttccgtgtcataattatgatttacatatatatttttttcttaaggagctgtgagcttttccagaataacagtgagattttagaaatttctgtatcctcaacactttgcttgcccataattgatgctcagtgtttgcaaatgtcacagttaagctaatgtttctgggtgatatagacatacttgttcttcggtgtgttaagaaggaagaaacagatttttaaactgatacaagatccatattaaaatcaaaggctaggcatggccctccatcagtgataagcattgaggcgtatctatactgcccagtttcctcgggggtgggggggggtgttcctctctcctagcttttaccactgagatgaaataagaatcggaattaaataaagtcaccatcctcagcaagagatgagtttcttctccagtgatctgatgtggcattttcagccaggaatgagatatcctgggaggggaatcagtatttctacaattataggttcttcaataagtcctagaatactagaactctgtgctctgcacaacctactcttagtacacatgaccagaatgccttttctctgttacattgattaatgtattaaaccaatacttatcaagtatctgggatgagcctaacctatgtcagtagatatatcagccaaagattagtggtccctgacctcatggaacctgtaggctagggatgcaaagggtaagagtcaggaacaaaggctatggagagatttattgttgctaccctgagttcctgcctcatgtatccactaccatttctatagcttcctcaatagcccaaagtgtgaggagtaaagttaatatggcagtctccaagttcgtaggagatcttccctgtggggttttggaaaggaaggcactgctagttggaggaaggttgaaaagaatgaaaactatgtgccaggcgtggtggctcacgcctgtaatcccagcactttgggaggcagaggtaggcggatcacttgagttctagagttcgagaccagcctggccaatatggagaaaccccgtctctactaaaaatacaacagttagcccggtgtcatggcacgcgcctgtaatcccagctactcgggaggctgcgacacaagaatcacttgaacccagaggcggaggttgcagtgagctgagatcgcaccattgcgctccagcctgggtgacatagtgaggctttttgtcaaaaaaaaaaaaaaaaaaaaaaaaaagaacaaaaactatgtattattgacctgtgtcagagggatggtccagatggcagggagaattctacaggacgttcaaaagccagtggaaatgggatttaaagaggattgaaaacgttcttttgatgccattctgtcctagggtggaagtgaggtctagaggaagcaattggccatgtaagttattagattgctttacaagtgggtattagtgaatgagacccaatgccagggatgctcagttagagagttcggcttcttaataaaacacccagccccggctcccatcctgtatggcattgtcatcattgtaaacagcagttctataaccttaagaaattggcatacagctggagctaactcagtttccaaacaagattttagtcattgtatgtttaagtctctcatgcttcttcagagccacctgttcaccaacagaggaaagtctccaagtggagtgactgattttatgtttattttattttagtttgttactttttgaggcgggggctgaagtgcagtggcagcatcatggctcactgcagccttgaactcctgggctcaagcgatcctcctgcctcagcctcctgtgtagctgagactacaggtgtgtgccacccaaggctggctaattttttaaaatttgtattatttatttttacttttttgagacagagtttccatctgtcacccaggctggagtacagttgtgtgatctcggctcactgcaacctctgcctctcaggtttaagtgattctcaagcctgagcctcctgaattgctgggattacatgccctaatttttgtatttttagtagagatgggttttcgccatgttggccaggctggtcttgaactcctggtctcaattgatctgcccacctcagcctcccaaagtgctgggattacaggtgtgagccaccaccgcgcctggcccttatttttattttttgtagagatggggtctctctttgttgcccaggctggtctcgaacttctggcctcaagtgatcctcctgcctcagcctcccaaagtgctgagattacaggcatgaaccactgtgcctcgtctgactttatgtttcttatacaagcatatcgtgggattgctcctgggtagagacagaagttggaggtcccctttagtggtatctgtatttgttttcaagaatgaataatgtgaggtcaagttgtatctttcttcccccacatctgcctgtcaaaggaatagttgtgatttcatttttgattcagaactgttgctgactgtggcatcagtgggcaattgtagggtaacacagtgtgtctcttatttaatgcctcttcatgtcatgcccatgtgaaaatctcaggcttttagtcaagctttgcagttccctttgattttgcaatatgattttgtcagccatgaattgatctaaatcgatgtgtttttctgttacatttgcttatgataaaaaaagaacagaaaaagtataaagaagcaacaaaaatgatttataatttcaccacccagaggcaaaatgacatttcattgttttttactttgaatgtcttttattactcatgaagttctacctgtttttataagtttgttagccatttgtctcttttgttatatgaattatgcattcatgttttttgtttatttatctaattgtgctctttgagttttcattatttgaatagtgtaagatctttcactcttttgttattgctgtaaatgacttttttgcaatttgccgttgtcttttaatgttattttgatgatcagaggttttcggctattattaaactattacttttaaacttggaaattctttcatatccagaatttgtatgaatattcacttatatcttgttttattttccctatatttataattctaaatttaatggttttatctatctgcagttggttttgaattgtgtttggaagggagacgtgcactattataccccatggagataggaaaggacccccaacaccatttattgaatgattctctccttgcttttggtttgtggtaccttctaggtatttattctctaagagcaggtctgcttgtggcctcttggttctgttgcacttgccagttggcttgttctggagccatcctgattaaattatattagccttagaattagagttattatgttgtgtgtgacagggtctcactctgtcacccaggctggagtgcagtggtgccatcatagctcactgccatcttgaacttgtaggctcaagtgatcttcccgcggcagcttcctgattagctaagactacaggcacgcaccaccatgcccacctaattatattcttttctatttttttattttttgagatggagtctcgctctgttgcccaggcccaggcccgagtgcagtggcacaatcttggctcactgcaacctccacctcccggcctcaagcgattctcctgcctcagcctcctgagtagctgggattataggcacccaccaccaagcctggctaatttttgtatttttagtagaaacagggttttgccatgttggacaggctggtctcgaactcctgacctcaagtgatccacctgcctcagtctcccaaagtgctgggatcataggcatgagccaccatgcccagcatgttttacttcatttttaagatagaatcttgctctgttacccagtggtaacatcacagctctctgcaacctcttcctcccgggctcaagtggtcctcccgcctcagcctccctagtagctgggactacaggcatgtgccaccacacctggctaatgttttaaaaaaattttgtagagatggagtttcaccattttgcccaagctgatctcaaccctctggtctcaagtgatcctcttgcctctgcttctccaagtgctgaaattatagatgtgagccactgcccccggccataattatattagctttatattggattgaatatcatatacagatgtgtagcatacaacgatgctttggtcatctgtggcctacacacgatggggaaaagctgaaaaatagttcccaggtagcatacaagaaagggatccccatgctagctcccagaagggcttagctcttgttattttaaggaaactgaggcccaaaaaggagtgatccgcatgtcgaggtggggagcttttagtatcaacacagtttgataacatgcttctttatgcattgcgtgtctcattagcatgtgaaacctctactcctgggcatgattttcagtattataatgagattatattgaggaaaaactcagtgaaaggtcagcgcttggagcccatcttgtcttgagctggctggattcagtcaggctcttttcaggaatgccagcgtctcacttcactagccttggaagatggccacgttcttaccaggaatggtggagtccctctgtaacaatctggggagaagtaattcaaggagagaaacaggttctttcttttatggttgggaattctgcttggttagctaagttaggagggcctgctttctgcggtgtgactcaggtcagctggtgaagggaggcagggaggttggggaggggaagatgtgaagggtcttggtgaccatgcctcttgtctgccaggaccgagtctctataccgggggtccccagaccttgggcagtggagtggtttcggtctgcagcctgtggcctgataggaactgggccgaacagcaggaggtgagcggcgggtgagcaagcgaagcttcacctgtatttacagctgctccccatccctcacttgagctctggctcctgtcagatcagcggcagcattgaatgctcataggagtattgtgaattctgcatacgagggatctatttcataggctgcacactccttatgagaatctaatgcctgatgatctgagatggaacagtttcattcttaaaccatcacccccacgccacacccccggttcatggaaaaattgccttccatgaaaccggtccctgctgccaaaaatgttgggggccgttgctctatactgtctcccaatgataaaatctaaccacacgtttctccaaacatatcatattgttaaacaccatatgactgtgcatctctgggtttccttataccctttccttttccacagttttgttatttattgttacctattctttcaggtgcaatgttgaaatcatttctcaagtgctaaaattgtttccatagaaatatttacaaaggtaacatttatagtattttttaaattataaaggtaatgcgtttttggtgtggaaaactggagaccacagtgaaatataaaggagtaaacagaagcaataaaaaattcctccactcacaccttccttgatgaataattccttcttttcagaagcaggagctttggagtcaggtagataaagtttaagtctacccaccactttcttggctttgtgaaagtgactctgagcctcaattttctcatctgcaaaatgaggaatcctacatgactggcttattgtgaaacagaatgagataatgtataggctgtacggttccagcatagcagccagaacggctgggctcacccttgcacatgtccagctgggggccgcctttctgctccttgtgtttcaggaccagtgggctagcccagtcttctcattatgaaggcaagagagcccctcgtgaggctcacgcttggagctggtacgtagctcttcacctggtcaaagcaagctatgtggccaagcccagatccgaggggtagagaaaacagactttgcctcttgagtgggaaaaacttcagtcacactgcaaaggatgtggagacgtggaaggtgaaggattgggctatgaatgcattttcccacatagtagaaacaggatctgctcaatctctctggcagttcaggatgggaaggcattttagatggactgagataagaccaggttaggactaagctggacctggaggggctggggtataggatctgactgaaaggtgcatttggcttgttcttgaggaggatttttttttttttttttttttttgagacggagtcttgctctgttgcccaggctggagtgcagtggcgcaatcttggctcaccgcaaactccacctcctgggttaaagcgattctcatgcctcagcctcctgagtagctgggattacaggcgcacaccaccatgcccagctaatttttgtgtttttagtagagacggggtttcaccatgttggccaggctggtcttgaactcctgacctcagatgatccacccacctcggcctcccaaagtgctgggattacaggcgtgagcctctgtgcctggctggaagattttataagtggagataacaataatgaaagtaacacaaggacatagggatggcccagatgtgggaagaaacagaagtgtttcagggtcaatgtcagtaaaaacacaagcttgcagggccaatttgggcagaacagtaaaaggaaaatcggctcatttggtaatacgtttctcatttctctgctgacgttgcagggtaacaacttttaggaccagtttggagctctgtaaagggccaaagaggttggagggtgagacattgagtgagagcaaagggttttatggccttcagagatggtctcgctctgttgcccaggctggagtgcagtggtgcagtcacacctcactgcagcctcgaccttcaggactcaggcgatcctctcacctcagccttccaggtgagtagctaagactacaggcacgtgtcaccatgcctatctaatttataaattatttttagagacacggatctccctctgctgcccaggctggtctcaaactcttggggtcaagtgatcctcctccctgggccttccaaagctctgggattacaggcatgagccactgcccccagcctttggcttttagtttctataaagaaacctactgggccagacgtggtggctcatgcctgtaatcccagccaaaaatctgtggggctcagctttccttggccagatatgccagtttcaacgtacagtaggagggcagaacacttgaggtcaggagttcacgaccagcctgaacaacatggtaaaaccccgactgtactgaaacttcaaaaattagccggtgcggtggcgtgcgcctgtcatcccagctacttgacgggggctgaggtaggataatcagttgaacctgggaggcagaggtcacagtgagccaagattgtgccactgcactccagcctgggccatagcgtgagactccatctccaaaaaaaagaaaaagaaaaagaaaaaaaagaatcttactggccaaattttggatctgctgctgcttggcgtaaagctatttattatttctaatttgcattatttcctgatgtattttcatccctcttgcagcagtcagggttgtcccctcgtttgacatgtaccatagaaaggttataggattgaatactatgtaagaataacgtaggcagcatttcctgtgcatgcacaggaggattttttttttttagctctggcctgaaactgtctgcattaatttacccttaattgtttttagaaattctattcctgagccattgcttaataaaacttaaggtttggagttgttttttttttttttttttttttttttttgctttagttgaattcatcaagataagctgtattatactcagattcatttactgaactgagaatctgaaggacgcctcccttctgctcccgtatgtgtgcgagtgtgtgtgtatgtgtgtgtgtgtctgtctgtgtgtcttttcttcccttttagagaaagcagtgctgtacaaagcagggaactatggtagaattgagggtaaaagaagaaaatccttctaggcacagtggcccacgcatgtaatcctggcactttgggaggcccaggcaagaggattgattgagactaggagttcaagaccagcctgcgcaacttagcaatgccccatctctgaaaaagaaaattaaaattagttggtcatggtgtcgtgcctgtaatcccagcactttgggaggccaagacaggtggatcagttgaggtcaggagttcaagaccagcctggccaacatggtgaaaccccgtctctactaaaaatacaaaagttagccaagcgaggtggtacacacctgtaatctcagccattctggaggctgggacaggagaatcacttgaggccagaaggtggaggtggcagtgagccaagattgtgccactgcactccagcccgggcaacagagcgatattccatctcaaaaaaaaaaaaaaataaaaataaaaaaaatatatatatatatatatatatatataaaatctccttctgatgataaagggttagtttgtttgcccatgacaggccctcctactgtaccttgaaactggcatatcaggccaaggaaagctgagccccacaaatttttggctaaaggcaattacctcatccctggaaaagcaactctttatgactcaaagaaaaatacatatttcccaggtagccgtggagccagtaggtgaatattcggagaatattccaaaataaatattaataggagccaggctgtcaaagaagacatagagctttgttgagcctaaagtgcttggcaacagaacctgggctagtcactggcctgtgaccatggtgttgggggagactcacactgacagtgatgttctctgggtgtgtagactgagttcatctcttcctgccctgcttctgagggaagctgttaaaaggtatgaattctctccccagcaaaaacaaaacaaaacaaaaattccttgtccatgcacccacaatgatatggtttggctctgtgttcccacccaaatctcatctctaatcgtaatccccatgtgtcaagggagggacctgtagtctccacgtgttgagggatggaggtgattggatcatgggggcagtttcccccatgttgtccttgtgatatagtgtgtgagttctcagatctgatggttttataagtgtttggaagtccctccttccttctctctcctgccgccttgtgaagaaggtgcttgcttccctgttgctttctgctatgattgtaagtttcctgaggccttccaagccatgtggagctgtgagtccattaaacctctttcctttataaattacccagtctcgggaatagctgtgtgaaaacggactcatacaatatcttgcattcaatttctaggagttttgctggggctccatagaccacaaaatatctcatgctttaaagcaggctaaatcttgatgtgtgaacattgccccaatatgactaataggcaggacacacttggactcaaatgctagagtagacagtttgtacgggagactgctctgtgagggaactgagctaatgaggtgtgttgttgcttcctggaagaactgcagagctcaactggaggaaattaaaccactcagcaaagtgtgcatttttcctaataatgagagctccaaaagcggggcctcgcacctctcagtgattccaacccccatctcattttgcaaggttcgctgttgccaaaaatgataccactctttcccgagattatagggaagccttgatgaggagggaagcataaagggaaaattgggctggttaatgcacttgacccaagcagctttcagagtttgagccctgattagtaaatcaagggagacagaagtgtggttgtgttcgggatggtatcttttaagcgttgaggtgccatcactgatgctttaattgaggtaggaaataagtgatgcctttgatcataagagaagcagagggaataaataggaaagggattttcatttgttcattcagtaaccatttatctgccaagcattctgccaggctctaggggaacagaaagaaataaggccagtcactgtggctcgtgcctgtaatcccagtgctttggaaggtgtacgaggaagaattgcttgaggtcaggagttggagaccagcctgggcaacacactgagaccccatctctacaaaaaaaaaataaataaataaataaaaataaattagccaggtgtggtggtgcacgcctgtagtcccagctacttgggatgctgagacaggaggattgcttgcaccctggaggtcaaggctgcagtgagctatgattgtgccgctgcactccagcctgggcgacagagcaaaaccctatctctaaaaaagaaaaaaagaagatgctgtagctcctgaacgcctgcactcttggagtggggatgaccagagtgaagagtgccatgatggcagcccacagagggacagaaagtaacaaaggagaagtgcctgataccaggctgggctctgggaaggctagggctggagaccagaggaagtgcctagcaggaggaaggtagtgttgggcagatagaacagtttgtgtgacttgagagacagcattctcagttctaggaaataacaaattcatagtggctggagaaagggcagggagaggcgatgaggttggagagatggatcgggctcaacttgggtgccaagcagaggaatttaaacctaattctgaaagcttagaattaggagaggccaggagatcctttaagtagaggagtgacgtgatcatatgtactctagagaggtcattctggtcgcagtagggtaagtgggatggggttggaggcaagggaccagttaggtggcttttggtgtcattcaggaggtaaccagtgaggactggaactaaggcggtagcaatggaggagaagggacaaatgtcacacagagatcctgaaaatggcagaatctgcaggatttggtgaccgataggcatgttgaggggtcatgacttgaatttgactcctgaagagacagggtggtggccttcagcaaagacagggtggtacaaaaagaggaggtttcagttttcagcatgctgaatttgggatgtttatgagcgctccacgtggagatttacaagggggagctgaagtttcagtgaaggtccaggctagagatgtgggtttgggagttgccagggtacttggagctgtagacttgcatgaggtcacccaggacccgtttatgaagagagaacagtgaagggcaaaagaaggagcttaaggatttggggaatttaaaggaaagggtaacctgtgcaacaaaaccagtggccaaggaagatcccagaggagaaaaagcccagataggaatgggggaggaatattgagtgtccaggatccgagaggaaatagcgattatacaaggagagggatggcggtgttgcatactgcagaaaggatcatcagcgatggtgaggttgggaaggtccctccattctggccacgtagagtagatgtcactggaaactttaacaagagcagtttcagcaaaataggttgcacaggagccaagtgctgggtgaagcgaggaatgaatgagaggtaaagaagggagacagggagggaaaggaacatgtcaattaagccaattaaggctgtggaaaaagagactatttacttattttttattagtattaatattattattattatttttgaaacagaatcttgttctgttgaccaggctggagtgcagtggtgccatcatggcccccagcagccttgaactcctgggctcaagccatcctcctgtctcagcctcctcagtagccaacaccacacccggctaattttttaaatgtttttgtagcgatgggatcttgctttgtcgcccaggctggtctcgaactcctggcctcaacaatcctcctgcttcagcctcccaaaactctgggattataggcatgagccaccgcaccaacccagtttttttacttaaatgggagggagttgagtagaaaaggttggcagagggagagcgaagatgcaagagagagagtgatggacgaggcaaggctctgaggtgggaggaggctgggatccacagtaaggatgcaggggtcagccttgaactcctggactcagcttccatcaagagaggaggtgaagacaaagaatgggttgagaggtaggtaagcttgcaggagggaagtgcttctcccatttccagtgtgcaggaaccacccagagagcttgataaggggtagattgctgggccccacctccagggattctgagtccctaggtctgggaggagcctggggtttttgttttttttttttaagacaggatctcgctccgtcacccaggctggagtgcagaggcgcgatattgactcactgcaatctctgcctcccaggctcaaggtatcctcccacctcagcctcctgagtagctgggactacaggtgtgtgccaccacgcccagctgatttttatatttcttggtagaggtgggatttcaccatgttggccagactggtcttgaactcctgacctctggtggtccgctgcctctacctcccaaagtgctgggattccaggcgtgagccaccacgcctggcttggtcctagggatttttatttctaacaagcccccagacgatgctgttgcggatgctacagacctgtggaccacatgtggaaattagggctgatggtattgatttctctgtggagtaggaggcactatcccttgcggactgggaggttggcccaaggaacttggcaaaaggtagaggacagtgaagggtaatgaaatccagggttctgacctagaacagaaagaagcctgcagagcaggccaggtgcgggggctcaggcctggaatcccagcactttgagaggccgaggcgggcggatcacctgaggtcaggagttcgagaccagcctggctaacatggtggaaccccatctttactaaaaatgcaaaaattagctgggtgtggtggtgcatgcctgtaatcccagctaatcaggaggctgaggcaggagaattgtttgaacctgggaggtggaggttgcagtgagctgagatcatgccatggcactccagcctgggctacagagcaagactccgtctcagaaaaaagaaaagaaaagaaacctgcggcgcaaagagtggagcccctggaggtgtctcctttgcagctgcatgaatgtgagacttggtcttgcagcctgcagtgtcagctgtgtaagaaaaggggagaagaggcaagtgggtggttctgtctagagctggggtccttcagcacttgtgggaaagaaaggcagagggacaggagaactgtggggttggcaaaaggcagagcctggttgaaggaagtatggagagtccagttggactggacgaacttgaaaccagggaagggctaatagattaaaaaaacaaaacaaaatggctaggcgtggtggctcacgcctgtaatcctagcactttgggaggccgaggtgggcagatcgcctgaggtcaggagttcaagaccagcctggacaacatggtgaaacctcgtctctaataaaaatagaaaaattagccgggtgtggtggcaggtgtctgtaatcccagctacttgggaggctgaggcagaagaatcgcttgaacccagggggcggagggtacagtgagtcgagatcacgccattgcaccctagcctgggccacaaaagcaagactccatctcaaaaacacaaaaacaaaaacagaacaaaacaaacaagtgtcccagggcctgaaagtctaagagtaagggttttgggactacgaggctggagaactgggatgaagagagattatgactgttgaagtcaaaggtggtccaactgcagctgttctgggtgtcagtgaggtccaggaaaagccatgggggtctgagataattgcactgcagtaaccgaaacgaggtggtcctcctgggcatccctgggtgtggggtcagaggctcttgaagtggtgacaggaaggagaggttgcagtgacaaggttctgatgaggtgtgacaccgcaatctggtgtaatcttcttttccaaaccaaagggcagtgcgttcattcgggttccctagagaaagagaaggaattgggcaggggcaggatggggaggtagagagagagaatgaatttatttatttttcccattttttattgtgttaaaatatacataacataaaatttaccatcctaaccatttttaagtggttcattggcattaagcacgtttacattgtcatgtaactgccaccaccgtccatctccaggatattttcctcatctgaaacagaaacactgcacccaatcacaataatttcccattcccccttccctgtcccctgataacctcttttctattttctgtcaatgaattggaccattctaggtaactcctgtaagtagaatcatacagaatttatgttttgtgattagcttatttcacctagtaatcctcaaagttcatccatgtggtagtatattgcagaatttccttcctttttaaaactggataacattccattttatatatacacagccatcccttggtatctgaaggggattggctccagatcccccttggataccaaaatccctggaagctcaaggaaatccctcacataaaatgacataatatttgtacataaactacgcacatcctcacatatactttaaatcatctctagattacttacaatatctaatgcagtataaatgtcatgtaaataattgttacgcttattgattttatatcattattattattgttattgagactgagtcttgctctgtcgcccagactagagtgcagtggtgcggtcatagctcactgtaaccctgaagtcctggcctcaagcaatcctcccacctcaggctcctgagtggctgaaactgcaggcatgtgccaccatgcctggctaatttttactttcagagatggggtctcactgtgttccccaagctggtcttgaactcctggcctctagcactcttcccaccttggcgtcccaagtagttaaggctacaggtgtgagttgctatgcttggctctgtgttttttttatcttgattttggggattttttccctctgtggttggttgaatatgaaaatacagaacctgtggattagaaaggctgactccacatactacattttcttgattcatttgtctattgatgaacacctggattgcttccaacatttagctgcgaataatgctctatgaacatgcgggtacaagtatctcttcaagactctgctttcagttcttctgggtatatacccggaagtggaattgctactctactgttaacggaccacccaccatactattttccacagcggccgtaacatcctccccttccatcaacagtgcacaagggtttcaatttctccgcatcctcttcaacacttgttattttcaggtttttgttttgttttgttttgtttttttgttttttgttttaacagtagccatcttaatggatgtgacgtggtatctcagtgtagtgttgatttgcatttctctaatgattagtgatgttgagcagagagaggtttattttaagaacctggctcacatggttgtggtaactggcacatcccacgtccgcatggtaggtggagaccttgggaagggtgtctggtggcagaatttcctctggcagtggaaagagacgatgtgaagatgggtatgtccacagcgtgctgcagttctcaagggttttctcattgtcttgcagctactctgaggatgtcaaggtggtgttctctgactcaaactaccttttccatcagaatcccacagtttccgtcccatgttgccttccagagctctgagagtttgagggtagtatgtggtggagaggcctgagtgcccagagaacacggaccttcatcagcggtaaagactttattaattaatgctcatgatcttctgcatgtttatggagcactttggaaatgaataggaattagcccggtaggaatttgcagagcctggtgtgaggctgtcattgcattgtgagtctagctctttactgtgtaatctctaaagcttacaagatttctcctggaaggtcaaggaagagtgcctctgtactcagtagagctctgatatcacatttctccctctgttcttgaccatgcaagtctaattcagtgagatctatccattcagatccagcctggagctcaccgtccccaccttcctggtccagcttagcccatctattacagctgttgtagatacttcgtttgacacttagcatctcctgcattgcattgacaactgccttgttagaagtgtttaatgtgctttagccctcatatcccagaactctgggtgattggggtggggcagtgcatggtgattggtcctgtcccttgggtgtggcagatgttagggcagagactgaggggcatcactgcacttgggagctagagttgaggcaagcagccaggaaggcctgcagatcagccacacagtttcgcccatgtgagccaagcgataccgagaaacccaggtagaccctcgaaaggggagcgctcgccttagacagacccaagagacaagggctggaggctgagctcaggcccagtggtcacctgcccagcccggcagtcatctgcccagccgtctgagcatgcacagtgcagcttccatatccagcccctttaagatcctcttctgtgcccctgccctgagggatgatggtgacgacagagtcaggccttggtgcacagtggctgaagtgctgcagtggctcattagcacaggacttttgcaaggcctagagtgactgagggcaaccttggctcctccctgcctgggattcttcagttccagggcttgggggcagaacactctcccacatgagctttatgcacattcccgccagcctgattaaccccaggggaggtggagccggcttctgctcacccacatcccccttgaagggaaatcaaacctgacccggctcagtgatactatgtgggaatactttgcccccagcaggccatgggcacggtgcacctggctgcagaggaccttctcctagttggggcttttagggcagagatgaagaaatcaagaaattggctgggtgcggtggctcatgtctgtaatcccagcagtttgggaggctgaggtgcgcagatcgcttgaggtcaggagttgaagaccagcttggccaacatggtgaaaccccatctctattaaaaatacaaaaattggccaggtgtggcagcacatgcctgtaatcccagcacttgggaaggccgaggcaggcagatcacctcaggccaggagttcgagaccagcctctgagggaccctctggagtgctcttgttttgtggaccaccacacagtcaatgagatgattcctgccaactgcctgtgagcccgtcaataatcactgtaatctccctggcagcccccagaagtagatttacagcagcatggtaaaaatgaggctgcttgatcaatgcatccctggacgatcttctccaggagacaaacacatattgtaacaaaactttattttcttctgaaaattgcctacatgattaatatggcctgacatagcccaagctgctcagcataagaaacagctgtatttcttgctccctcttcagctctgcttctctctcactccatggcttcatctgttttctttgttctgctccctgttccgttgtgctatatattgtgcaatctcccataaggagaagaaggatgcattaaagtgcaggtacctcggcactccattccactgtgtttctctttgctatttccaatgtggcttaggcgtaagcatgaaatgaaattcctcagtgctccctggacggactctcggtgcacctgtgactgagagaagcagagcacgttccccgggtactaaatcatctcttacatcacctggagccgtggagaaggccaaagctctatgctctggagtccatactggatgagaggaattcttccctttaatcactgcgctcgggcatatgagggctgctgggtattctgagggagggatgtcagcaggttgtcctgtctcctgtctccagggaggttctaggacttcccgaagaagagctggtgtgccttaggttgcacactcctccaggtgtagggtccttttccttgactatgattattggcgtgggtgttttatttcctctcctggaatgttagctctgtgatagcaggaacctctagtataacataatacagagcacttagtgggttcagtagatgccttcatttgggttcccccagaaacagagcctgaaacaaagggtttgagtgcaagtagtttattttggaggtgaagagagcatcactaggggagtggcgagtaagactgggagggaaagacatcccctctccaaagggtgtgttatgaagattgctcctgtgggtgatgggggcttaatcctgctgcggaaatttacatttaacctgctcttgggctgagggagctggggtatttgtattaggttggtgcaaaagtaattgagggttttgccattacttttaatggcaaaaaagtacttttaatggcattaaaagtaatggcaaaacccgcaattacttttgcaccaacctaatacatcagttcctggtgttctttttttggggggcggggagggggaacagggtctcattatgttacccaggctggagtacattggcatgatcatagctcatggtagccttgacctcccgggctcaagtgatcctcccaccccagcctcccaagtagctgtgaatacagccatgcaccactgcacctggctaattttaaaattgtttataggtacaggatcttgctatgttgcccaggctggtcttaaactcctggcctcaagcgacgctcccacgtcggcctcccaaattgctgaaattacaggtgtgaggcactgcaccgtgttccgggtggtccctagttgagagatttagggggtggagtaatcgcttaggcatcagcaaagaaggtttcaggcaaggaaatggaggggctggagtcagaagttgtgcggtgtgccctgaagctcagggcacaggtaggcagcacaggtagatgcgggtagatggcacaggtagatgcaggtagacatatgcctgggactgatgcctgggactcccctagtgatgctctcttcacctccaaaataaactacttgcactcaaacctttgtttcaggctctgtttctgggggaacccaaatgaaggcatctactgaacccactaagtgctccatattatattatagtagaggttcctgctatcacagagctaacattctaactcaccacctgtagggtggtgaatctgggagaagtggggctgcatctgttaatgctgtcctccttagggtttattctcagttcttagccaaggagaagcctaagggaaccagtgattcacgccttgggacgactggatgaggattcggctgaaatcttacactatgtccagctgcagtgcctgagcttttatccttcctctgactctgcatttccgatctctccttccccaggtgtaaggagctcaagtactccaaggacctgccccagatatccatcatattcatcttcgtgaacgaggccctgtcggtgatcctgcggtccgtgcacagtgccgtcaatcacacgcccacacacctgctgaaggaaatcattctggtggatgacaacagcgacgaaggtacaggggtggctgacctgtgcacaggacatgatgacagcagggggaaatgccactttcattccaacgcgagcccgagcatctgtgtctcctggtccctggagcatatctggggaagggatattttttctttttctttttttgagatggagtcttgctgtgtcgcccaggctggagtgcagtggcatgatctcagctcactgcaacctccacctcccgggttcaagcgattctcctacctcagcctcccgagtagctgggattacaggcacccggcaccacgcctggctaatttttgtatttttagtagagatggggtttcaccatgttggccaggctagtctcgaactcctgaactcaggtgatccgctcacctcagcttcccaaagtgctgggattacaggagtgtgccaccgtgcccggcccaagatttttttagaggaagatatctaggcttaccctagtctattattccttgagtcctctagagcaggggtccccaaccccagggccatggaccaatagcagtctgcggcctgttaggaactgggctccacagcaggaggtgagtggcaggagagcaagcgaagcttcatttatttttacagctgctccccaatgctggaattactgcctgagctccacctcctgtcagatcagcagtagcattagcttctcataggagcatgaaccctgttgtgaactgcacaagcaagtgatctaggttgtacccctgccctttttttttttgagatggagtctcgctccatcacccaggctggagtgcagtggtatgatcttggctcactgcaaccttcacatctcaggttcaagcgattttcctgccttagcctcccgagtagctgggactgcaggcacacaccaacatgcctggctaatttttgtatttttagtagagacagggttttgctgtgttggtcaggctgatctcgaactcctgacctcaggagatctgccctcctcaacctcccaaagtgctgggattacaggccatgagccaccgtgcctggctggttgcaacctttttatgagaatctaatgtctgatgatctaaggtggaatagtttcatcctgaaaccatctcccctgacccccatgttccatggaaaaattgtcttccacaaagccactccctgatgccaaaaaggttgaggaccgctgctctagggctcataagaatcattgactggccatggatctagatgaacttccttcttctcattagctaaagcagatgacagtgaagagctgaattcctcctccactccccaccccgcaccccatctttgttgtccttctccaaaaagcgaaataaaaaattccatcccgtgttaggaactgtttatctacattggaattctcctctgggccactgtgcccaaaatgatcttaagtagaagtgagtggtgtttgctcatcttctggaattcagcgctactaggaatgatggctcaatgaaaactgtacaacaggcaaatattgcatgtcaataacaaaactcctgggagatccttggagatatttaacagttggacaaaggcgtggcatccagggcaatgggggtgggtgctgctgatggtgcctttgtgttggatcccaacctgcaaaattcagtgtgctcactgctgggagccacccccacaagctcatgagataaaagaaagccagctagagtgagtgcctgaaggccaagaaagcttatcttctcagcaactacaggattaggagtaggctaaaccccttcctttcatcgtgctgggtaggagagggattaccctgcaagctgctccgtcgtccggaagatggtgaggaggaggcaatgccacgggtcctgtttaaaaccggattatcttgaggagcacaggaatgagcctctcctatttaatcagcctgggagctgatatccctggccccttctgaaccggcccactcttctgaagggcttgggtgcacctgggcccagtggtttgccttctctgggacctctggcttacagagatgggtcatttgttggatttttcacatccttagttttatttccttacctttggccattagttatctatagattcttctaaacctgagaatggttgtctccttgtgagaaggaggctctttcagttcctggaagcctctaagttgtgcagcaaagtctctttccttgacatgcccacggctctctgctctgtggcctttctctgcacctaccacagacctcttgctccagcagtccttccacacacccctgcatattttccccaggccagaaatctcttctctcgaactccctgttcctgtggcccccttcatcagccttctaagtcccacctgtttcccagctgtctccagcagagcacttcctcagagaagcctcctctgatctctgagtggggaagtaagactgtgaagggaagccattgtaaaaagattggtactgtcagtgtcagagcttaatcccactggggaaaatccaggagcaagtgtaaacccagacctcagagttaacttgctccaagtgcgagggagctgtggtatttatacacctttaggataatgaggccccggttctgtgctatcttagcaccttgctactagctgtcgcacttactagcatgtggtgtgtctgcacagtggactctctgaactgggtgggatgtttcccagggcctggctggtggttgaaactcagtaagtctttcaacaagggagtgcatgatgaagccaggtagcactaagaaaagtgcaggtgtgagctagtggcaaaaagactggaggtggcccggggctagaacacccagagaggagcatgaactgcagatcgggctggattggggtgaagactcactgccaatggcgcaccctctcctgaggaaatctaggtagagcccagcccaggaggaggaagggaaggttaaggcaatctcagccataactccagctccttgaccgcagggatctccagtacagggttagacacttagtgggttcagtaggtgtattagtcccttttgtgttgctataaaggaattcctgaggctgggtgattcattgattgacagattgattgattgattttgagacagggtctctcactctgtcgcccgggctggagtgcggtggtgcgatcacagcttgttgcagcctccaactcctaggctcaggtgatcctcctgtctcagccccctgagaggctgggaccacaggcatgtgccatcatgcctagctaatttatatatatattttttgtagagatggggttttggcatgttgcttaggctagtctcaaactcctgggctcaaatgatcctcctgcctcagcctcccaatgtgctgggattacaggtgtgagtcaccatgcctggccttgggtgatttatttaaaaagaaggttttatttgtctcacggttctgcagaatgtacaagaaccatggcaccagcatctgcttggcttctggtgaggcctcagaaacttctagttatggcagaagggaaggggagcaggtgagtgtcacatgatgagagagggaacaagagagtggtggggaggtcccagactctgtgagaacttcctcattaccatgaaggaggcatcgagccacaaatgagggatccacccccatgacccaaacatttcccaccaggcctcacctccaacattgggggtcacatttcaacatgagatttggaggggacaaatattcaaaccatatagtaggtatcttcatttagtttcccccagaagcagaccctgaaataaacatcttcaagtagatgggtttattcacatcaagagtgcaagtagtttatttgggaggtgaagagagcaccagtaggggactggggaagtaagaatgtgaagggaaagcatccccaaaagattggtagtgtgggtgatggagcttaatttcactggggaaattccaagagccagtgtaaactcagacctcagagttaacttgctccaagggtgaggaagctggggtatttatacacctttagcagcaaatgttttagtgtaagaaccccctgggactccaccctggaggaagttctgcttcaggaggcttggggtaaggctgaaaatgtgcatttcttataagctcctatttgatgcttacgtagcttgtgtggggagcacactttgagaaccattgggttaggtaaccacgccttgagccctgtctgtgagtcccattttaatggttcacatttcagttctacatgaagatgttcagtgagtaagaaaatgggaggaggaggtatttggttcagccagaccataaatcaatatccattcatcatcctcctcctcctctcccaaatacccaggggaccgggagttgacgatattaacatgatctccctcttttcagttcctggttctgttctctatgttttttccccgggccagaaatctcttctcttgaactagaagaggaatctaatatttttcattttattaagatgttctttgtaactggtattatcgagttttgtaaatgttctacgtctatttaaaaagacccccacacactgtaatcatggaattgaattcctgccagacatcaattttgtgtattctggtaggctatgagtttattttttttaagtctttttgataatggtgttttaaaatctccttttataatgactcttccttcctgtgttcctaatacttgttttctggtatcttgttgtcagtttctttggcaactatagatttgtatctgcatggcttcattaatagtgatggttgttaccattatgtaatgctctctttatcttagaagcatactctgttttttttgccttgaatttagttcttcttacattaatattgttgttcctgcttgctagttcacatttgattaaaacttttttttcccagccttacaattttgttttctgatcttaaaagtaatgcgtgctctttgttggaaaattcgaatgtatcaaaaagcaaatataattggaaaaaaataaatactgaagagactaaccagaggcaactgctcattcgcccatgcccttaccctctttaatgcacattttgcatagttaagatcaatagtataaacaagttgatgttctgctttttcccccgaagtgtaaagcataatcagtgccccccttttttttttattaaaaaatctctgcaaacatcattttaatgagggcagattgatctattctcagactcactaagctctggtcaagatgggctcagggaatgggtgtacaaagccggggcactctggagaagcagacgagatgagactgcagattttcctttgtcagggaattttgtttttattttaagtcatttgtttcactcagtttgaatattgacattggcctgtgttaagcccaggtaagatgcaattctttgtactctgtacatccagctgaaatcattcaggcaacatttgccagaaatcactgctcaccaagtccagcgagcattttgctgcccagatcttttggcaccatctgatattgtcacgcagcttccttgatggggtgtatcgctcctcctggtgccccgacactactctctgctgattctccccgatcttctttttgcagctgttcttctcttccttggtttcttagtccatttgtctttctacaaagaatacttgagtctaggtaatttataacggaaagtaatttatttcacacacggttctgtagactgtacaagaagcatgatgccagcatctgcttctggtgagggtttcagaagcttccactcatggtagaagaggaaggggagctggtgaggtcacatgatgagtggagagagagaggggaggaggtgcgaggctctttttaacagtctgatttcatgggaactaagatggagaactcactgaattccataagaatggcaccaagcctttcgcgtccatgacccaaacacctaccaccaggccccaccttcaatattagggatcacatttcaacatgagatttggaggggacaaaccatatcactcggccccctcccttcttaaactgggatcacttgtgattctcagcatcaggacacactgggcagtctgctccactttatgtgttctgacagtttcccattggaattgtccaataggatctaccactcaagcccagaacaattcaaacctgtaaggcctctgtctcccagatggtcatcctgggtctttgtagctccattggtccaatgatgaacttactgtgtttgccttgatctttgtttgggtgaccaggatggaggaattcgggtgcacagaggtatcacagtcataatacttgacacactccatcactggttcatgcatagccattctttatttttcctcacttctgattgagatgtaattcacataccataaaatatactataaaaataaaatagaccaggcactgtggctcacacctgtaatcccagcactttgagaggccgaggcgagcagatcacttgaggtcaggagttcgagaccagcctggccaatatggggaaaccttgtctctactaaaaatacaaaaattagctgggtgtggtggcacgtgcctgtagtctgagctactcgggagatgggggcaggagaatcacttgaacctgggaggcggaagttgcattgagccgagatcatgccattgcactccagcctgggcatcacagcaagagtctgtctcaaaaaaacaaaaaataaagtatacaattcagtgattttcagtatattcaaatgatttgcacctatcaccactacctaattccagaacattgtcatcacctgcaaaataaaccctgaacctgggagtagcctctcccaattctacccttaccccattccttgccaaatattaatgtattttctgttacgataaatttgcctcttctggacatttgataataaatgaaatctacaacatgtggccttttttcctggcttctttcactgaacataatgttttcaaggttcaaccaaattgtggcatatataagtacttcattctttttatgactgaataatattctgagtatagatacagcacattttatttatctgtttatcagtttagttgatagacatttgggttgtttctactttggggctattagggataatagggctatgaatattcatgtacacatttttgtttggatatgttttcagttttcttgggtacatatctaggagtagaattgctgggttatgtgataattctgtggttaactttttgagaaactgtcaaattgttttccacagccagactgtttttcacctcagctgcaccattttacatgatcaccattcatatatgagggttccagtttctccacatccttgacaattgttacttttttaaaattatggccaatctagtggatataaggtggtatcttgtagtttggatttgcatttccctaatgactaattattttgagcatcttttcatgtgcttatttttcattagtctatcttctttggagaaacatctattcaagtactttgcccattttaaaattgattatttgactttttaaattattgactcataattattctttattctctttatactcatctttatcaaatattctgcaaccaatttttgcaaatatgcttgcaaatattttctctctttctgtgggttgtcttttcacattcttgataatgtctttggatgcacaaaagtttttaattttgataaagtccagtttttctttttttcctttgggtgcttgagcttttggtgtcatatctaagaaactgttgcctaatccaaagtcacaaagaattgaacctttgttttcttctaagagttttatagtcctagcacttccatttaggtttatatccattgtgagctaatttttgtatatggtttgaggtagggatccaaattctttctatttttcttttttacatatatagttatcccatgagcatttgttcaagagtccaatttttcctcattgaatggttatgtcacccttgtctaaaatcaacttactgtaaatatgaggagttattttgggactctcaatcctatttctttgatttatgtgtctatgcttatggcatgatcacactgtcttgataactttttctttatagtaaattttaaaagtgggaagtgtgagacctctcaccttgttcttttttcaagattgttatgtctattctgggttccttgcatttacatattaatttcaagaccagcttgaacatttctctgagaaatagctgttagaattttgttgggattgtattatatgtgtaaatcaatttggagagtattgtcatcttgataatattaatgcttgtaatccatgaacatagatgtctttctatttatttatgtctctaatctctttcaacaatgttttatagttttcagtatacacattttacactgccttggttaaatttatttcttaatgttttattctttttaatactattataaattgaattgttttcttaatttcatttttgcatcatttattgttattgtatagaaacacaacttatttttgtatgttcatgttgtatcctttaactttgctgaacttgattattagctccagtaggtttttttgtagattctatagagctttctatatagaatattgtgttatcttcaaatagtgataattttacttattactttccaatctggatactttctatttttcttgcttaattacctcctctatttatttttaaaaatgtatttattaataaatatctcttttcctaccatgtcaaggatgagaacattcacccatataccttcctaagggtttataaaagcctcttctggagaagacggctaagtcatgagtgagctcagtaaacatgggactcaccatagtgggctattgtgtggaccaggtactggacttaaggcaaaaatctggacagaatgcaatgggcttctctgtatttactgcttctgatcttatcaagacctactgcctatcctcaggagcaggtcaaagcagaacatgtcttgagagatacgagatatgatacagtgaatgtcttccactgatccaggcagtagacagaaagcctgtagtcagaacatccaattatagataagaatgggtgctatactcattcaggcaatccatcctcagcttaaaatgaggtacatttgcaggagcagtgttaaaaatgacaactctcgctgcatctatctgaagtcacactgccctgttatggaggttggcctctgtggctgtgcgttgttgtcgtcttggatctcccttcactgtcttcttgtggactctctgaccctcttctgtgctgtctcctgtgctcttctcttggtttatgttcttattttggtggaacacaacacctggaagcttcttaagagagactgcaaggaagagaaaatctttcaagttcactcatgcctctaaagatggctttagcctcatcttctaggtgaatgatggtgtcgttgagttagatgttgccttctttcagaattttgatggttttgctccattattgtctttgttgttgttgttgttgttgttgttgttgttgttgttttagaagaaccaaaggcattctgatttcctggttttttgcatgttcttttttcctttctggaagcctgtagagtctttatcttgtcaccatagttttaaatttcacaatgatgagccttgatatgggtcagtttgcattgattagatggggcatttagtggcttccatcctcaatctattgtctatccatttttggaaatttcttggaattttaattgataattcctcctcattttttctgttctctctttcagcatctttcattattctagtttggggcctcctaaattgaacctctaattttcttatttttctctgctatcttatctttcgctatctgatatttttgctctgttttctttattctcgcttcagtttttttattcttcccttctatccattttttctatttctgctatcatagttttacttccaagtgatcatttttattctctgaaagctccttttataacatattgtccttttttattggaagcaatatgttttcttgtccctggaggatgttaataatattttttgttttaactttttctccctgcatagtctgtttctaaaagttacatttttctcattgatgtttagtttctatctttcatgttggaggctttccttagatatctggtgagtcttttctgcttatgattatctcttaaatagtgattagacagccaggggctgggtggagggggaatggggagttattgcttaagggtatgggatttgtctgaaaagatgaaaaaagttgtggaaatagatgatgatcgcacaataataggtatgtacctaatgtcactgaactgtatacttaaaatggttaaaatagtaaatttcatgttatgtccattttatcagtttttaaaaagctgatcagacattgtgcacttgagttggacttactggatttgacaatagagtgatttgtgtgggctgaaacaagaagtgggagtgggggctggacgtggtggctcacgcctgtaatcccagcactttgggaggctgaggtgggacgatcacttgaggtcaggcatttgagaccagcctggccaacatgatgaaaccccgtctacgctaaaaatacaaaaaattagctgggtgtggtggtgcacgcctgtaatcccagttactcaggaggctgaggcagcagaattacttgagcccgggaggtggaggttgcagtgagctgagattgcgccacggcactccagcctgggcaacagaatgagattccatcccccctgccctcctccaaaaaaaatgtgggagtaggaatttaccgatcagtttcttttcaaatagccttcgtgctagtcttccttattctggtctgtccattttacccccagttccaaaggcacctgctgctgccggttccattgcctcttgagtgtcctctggtatatatcgagttgatttctcagttttgggcattgttagcttgggatcatctgtcacacatctgtcacttggttaaccctctgattctgcgttctagcttcctcaatttcatggctgttgtcttgtcttgcatttcctctggctttggagggttatggtttttgttgttgctgtttgtctattttagaaatccttttactgtagtttttttgtgaattttgactagtggtctctgattcatgagttaaattcatcatcttattctgaaagttttatattcatctttgagaatgtttaatataaattgataaactgtcttccaggtatgtggtaatgtcacatgaagagtatatgaaaggcttttttttctctgtattcttaccaacactgaattttattaatctttgccatctttgttgttctggtgcaggggaaatggcattccatttttaagtgtgcatttaaaaaaatagtattgatgatgaatactttttcatatgtttatatattttttagaggtttgcctattgatgactccttatcccttttttattggagtatttatctttgtcttattgatttacaagaactttttattttattttactttaagttctgggatgcatgcgcagaacgtgcaggtttgttacataggtatacatgtgccatggtggtttgctgcacccatcagtccatcatctaggtttcaagccctgcatgcattaggtatttctcctaatgctctccctccccttgtcccccaccccctgacaggccccagtgtgtgatgctcccctctctgtgtccgtgtgttctcattgttcaactctcccttatgagtgagaacatgcggtgtttggttttctgttcctgcattagtttgctcagaatgatggtttccagcttcatctgtgtccttgcaagacatgagctcattttttttatggcttcatagtattccatggtgtatatcaagaactttttatatattaaacaaaccttttttacatcactttgcaggcatttctctcaacttttgcttctcactttaattcattcataatcttttttggcaagtataaattttacattatatagtcaaatccatcagtcttttctttttgataccaaagtcttaagaatgtgattcattatgcttagactatacaaatatcgacaactatttttatgagtaaatgtttctttccaaaataaattccagacagaggaaatatttttatataaagtgtaagaattttttaacacagagactctgtcccaaagtatggttatctcaatttaatagtaagtcctttaaccaccgatatgaaattcactgtttttatctgctgaattatttaatatttggaaacactgaagctgaatcacatgatgactgattggttataaagaggaggcaggagtcaaagaggacccccagggtccctgctcaggtgacaagatgggtattggtgcttctcattaagaatgggatatgctaagaattaagaatcacaggtttgggaaggcaatggacttcactttttggatttgtcaagttccaacatcctatggaaatttactgtgcctttaaaacttaggtgagttgtaactttagccataaagttttccttaaactactatgagaagcttctttgtttttacaattagtgtcctcaatactcttttctttttctttttcttttttttttttttctgagacaggttcttgctctgttgccttagctggagtgcagtggtgtgatctcagctcactgcaacctcccacctcccaggttcaagcgattctcctgcctcagcctcccgagtagctgcaattacaggtgcccaccaccacacctggctaattttaatatttttagtacagatggtgattcgccatgttggccaggctggtctcgaacttctgacctcagatgatctgcccaccttggcctcccaaagtgctgggattacaggcgtgagccaccatgcctggccctcaatactcttttatatgtcttattaatacttcacttttttaatttaccttgttaccttctttgttgtaaagcaggggtccccaaccccccaggccataaactggtccatggcctgttagggactaggccgcacagcaggaggtgagaggcgggtgagggagcaaaacttcgtctgtatttagagccactccccattgctcgcgttaccacctgagctccatctcctgtcagatcagcagtggcattaaattcttacagaggcatgaaccctattgtgagctgcacatgtgaggaatctaggttgcgcgctccttatgagaatctaacgcctatgatctgtcactgtgtcccagcacccccagatgggatcatctagttgtagaaaaacaagctcagggctcccactgattctacattatggtgagttgtagaattacttcactatgtattacaatgtaataataatagaagtaaagtgcacaataaatgtaatgctcttgaatcatcctgaaaccatccctctgctctgtccatggaaaaatggtcttccaccaaagttgttcctggtgccaaaaaggttggggactgctgttctaaagcaatagcatggggaggaaagagaggaataaaatcccagcccaaactttagctatgtggtcttggccaaggcacttaacttttctgaccttgtgtaagttggggtaatagtagctttcattcagggttttcattgtgaggtttagaggtaatacttgcaaggcacatagtgcaagtcctaacaatatcataaagggtactgttgagtgtgctcatgacattatttgatttgctaactccagttcattcatcggtattcaacttgcatatcatccacactgggaaaccatactgaattgcattcatttatctgcctatctctaagtggtaagacacttgatggtaagaccaatagcttgctctgtgccataatcccaggatctagcccacagctaaattacagtaattgctgaataggttaatttcaattgcacatgtgcagagatttttttccccacttctggaattgttctggaagcttttgcatttcacattgtacatattttggcttgaatgctacagttattttggtttaggtgtcagaaattgcctatctcccatcaccatcatttgagtttcttgatgatttggacagttgtacatcttgtcactaatacttccctgtacgacaagcatatctgatcaacatcttgtctcggttggttgtattcaaaggttgaaagcaagatggctgaaaactttttggagtggaaggttataccctctgcacttccaaaagggattttggagaagtcacactggcattgtttgcttttcttcttggtttataattgcagagatgggagaagtcttgtgtttccaagagataacattcttcctgtgtcgctgaggctctgagtgaaatagccgagagacaacttgttatcacacagctccatgcttggccaggctctctttatttgaacatcacctgccttcccccctgcctgtaaagagccttcctaatcagtaagaatacttgtttttgcccccaaccagatcatagcaatgtgacagcatttgctatgtgggtctgtaatcctaactaggttgtgcatttacatttctctttgtgtttttttaggccccagggaggaaagaatgagagtgtgtatctttacacaagcaatagtgtgtgaaaaccccagctaaagcttcagccactaactggcttttaaaaacaagaagaacaacaacaaaaccctttttagttcaaactaattataggttcacagaaagttgcaaagatgaacaggaaattccatgtagccttcgctcagtttctcccagtggtaacatcttgcaaaactctaggatactgtcacaactaagaaattggctttggtacattggctttttagcccagataattgagaagtgtgggaaggtcaggtggtttggtattagcagagctgatgttcagctggaatgtgctacagtgccattccagtccacatctgctctgatgttatatagctcgatagtctccgctagctagaagaaacatgttaggttctgcagcccttttggatgctaataagagctgctattgatagaacactcgtatgatgcattagtaacttaacgtggacatttcctgtaagcaggcatgagcatttcgtttgcgcataggattcacactgcctttgaccttggaaacttcagggtcctgaatacggagcaccccagaatgctagagaaggatgaactggccggatgcctcacctcagttattccactcccggctgccaaacgcgtttaaagaaaactcgaggaagaagtgaccaagcaccagcgtgtaaccctgttctccccagggctttacatttcttgtgttctgttttgctctctctttaatgactgtgactttggctatttcaaggaagagattcgccagcttctgagcatttggaatcaatatcaccgtaaataagaacataatgaaagaaaaacacagcccagcctgtagacaaatttgattgctgaaattcacgtgttattattagaatcagctgcaaatgccagactttcaaatgcctttgatggggtaaggtaggggaatgctcttttaaattggggagacaacttggagctctcacctggatagcctatagcttatgcgtactatgatgtttccttgtaggtttgggctactcgtatttattttctaaaaggtaaaatgtaaatggaagaagcagtagagatgaatttctcaacaaaggaattggaagctgagatggctttcctttacaaagtgcccctcatgaatgcacaactcagtgtgatatatttggtttaacactttggtattttgcacctcacatctctttgcttttcttttcgtcttttgctttcttttgtcctttttgtccttgctttgatctcactatggaatcgccctcaaaatgctttcatacacagcaaaagcttccctctttaatctctctcattcttcctgaagtttctcactcttgcctcatttttgctccagcccatagtcagcaagtgcattatttaagtctgcaaagctgagagatgctcagagaataaaatatgcaatgcagccacctcctgggttatttcatcttgcagttttagatgcttggttcctcaccatggctattcttcaagcccaggatttcagagacagatgggcccatgccatagtggcaaggctggggtggggtgtgtgtgtatcaccatatatgtggctcctgtatccctgaggcttcttcagagcttcattgtattgtttagaagagttggaggcccaaaagattccctggatgcccactcttttgaaacctcttaatcagcccttaggcctcttctctgcggagcactgaccatagtcagcagaaggcagcctagaaaaaggaggcgcctgcctcaagtccagagcctgctgctcccatcctgcagcctggccaactttccactcatggttacagccctaatcctttatcttcactctctgaaactggtgctgatggctgcagattcagaagaaaatgggatcatcatactggtgctttgcactcacatttggtcctcatgcaaccctgtgcagtggaataatgttgtacacactgataattagtctgtaatcagaagtgtgggtgcttccaagctacttgagggagccagctctcaggacaagcccaggccaggccacagcagctttgtattagcagacaaatgacttgagatttcacaacatcacattcacaggaatcagaggtaacaatggtgatgcatgtaggcatgccacttacaaatggtgtgacctagggagagttgctggccctctgtcttagtccatttggggactgctataagaagtacctcaggttgggcattgtggctcatgcttataatcccagcactttgggaggctgaggtgggaagatcacttgaggccgggagtttgagaccagcctgagcaacataacaagaccccatgtctacaaaaaataataataataaaatattagccaggcatagtggtgcatgcctgcagtcccagaaataataccgtaactactttgtatccataaaaataaaaaataacaaagttaaacaaaaatgccttagactgggtaatttataaacagtgaaatgtattgctcacaattcagggggctgggaagtccaaagtcagtgtctggtgagggcctagtcctcatagatgtctctctatgtgtttctatgtcttgtaagtggtgaaccagctccctggggcctcttttgtaaggacactcatcccattcatgagggtagagtcctcctgacctaatcagctcccaaacacttgccctcttaataccaccccattgaggcattgattggcatttaacatgaattttgagggaacacagacattcagcacatagcacacgctctgtgcttccgttttctcatctgtaaaatggggtcgatcgtgcctttacctcacagagtctttaagaggtatgaaggaattgttgtaggccaacagcatgtggctcttaataaggacccagtaagtatgaagacaaatgttgtggaatgttacgagtttccaagacagcccattcactggttaaattaccaaaggagatctaatttggctgactagtgttctggagtgtttcctgattagctgacatttttagtgagcttggttagcaatttggggatataaatatttcattatagacacagacaagcatagtatttgaaatgtttgaaaaatagtgattgtcagcagaaaaggaactctggcattggtggaatctgcctccccagttggtattctcactgagaaactaacaaagcttccgcattgggccccttacttgcacgggtgcccttcgaggtcatctgatggccccttgttgtgtgtttacatgtcatgcatttttggagaacttacaaaagtaagcttttaaaatgtttctcaaagagaatgcctcaaattgtgtaaatttcaggtcccacaaaacccaggttcatttctgggatttgctatctccattggacagataagaaaccccctaggttgcatgagcagaatatgcaaccgagtttctccccgcgccaccatcttttcgttcatttttaaagataatattttaaaactttgtctaataatatttttaaaatattttaaaatagtctttgtagggctgcttttatacatttagctgattggttatttcaggcataaaggtattctcaggcgcacctgtatttccaggtggtttttttttttttgagatcgcatcttactctgtcacccaggctggagtgcagtggtgcaatcaccgctcactgcaacctctacctcaagctgggctcccacttcagcttcccaagtagctgatacccaagtgttttcagtctgtgttttatgttctttctagggcatcaaagctaattcttacatatataaaatattgaaatctctctgaaaaaaagaaaaaaagagatgatgcagaaatgtcaagtgtcctgactaatgtctgtgccaaactctgcgttgaagaccattttttcactgtgatctctgtcataaatccctaagcacagagaactggaagtttccattggggtggagagaaaggccggcatctgggagggcccagggtatggtcaccatgcaggggctggattctctccacatccagtcttgaagagctcaggaactcaagtcccatcaggatgaggagtcttatctaagtgtctcaccaaatgcttccagacagaggtagacttggaaacccatggaacaagctaggagcagagatgtgcccagggagaaggtggcctaggaggaacccaggggaggggcaggccagctgaccagactgggctttaggagcaagcctgcagtccatcaattaccagcatgggggttggaagaaccccctggccacagaatatgaatcagaccttcagcaaggtcaagggttttaaattcacacacacggtccaggcatggtggctcattcgtgtaatcccagcactttgggaggctaaggcaggagcatcacttgagcccagagttcaagaccagcctcagcaacatggtaaaaccctgtctcttcaaaaaataaataaaattagccggacatggtggtgcatccttgtagtcccagctactcaggaagctgaggcaggaggatcacttgagcccaggagttggaagctgcagtgagctatgatccggccactgctttccagcctgggtaacagaatgagaccctctctcaaaacaaaacaaaattacacacaacataaaatcacctcttctgcaccgtcaaaattaacagacataaaagaccacatattttacgactccattttcatgaaccatgtgtattaggcaaatttataggggcagaaagcatgttagtggtcaccaggggttgggaaaggggagatggggagcagctgctcaatgggtatggggtttatgtttggggtgatgaaaaagttctagatagtggtgatagttgcacaacattgcgaatgtactcaatgccagtgaattgtatattgtaaaatggtcaaaacattttaaacatggtaaaaacaatgaaaaaagtgaaccagtgcttttgagatgtttggggtttgcgtgagaacgacctgggggtgctggccagttccactaaggcccactgaattagggataccgagaaaggagcctcggaacctgcattttcataaggtccccagtgattctcactctgggaatactggcaggcattttcattctattttgtttcttaattggaacgtgccatatgtgctatgttctcgtccccagctgtcacaacccatgcattcacagtgagcagcatgcccaaacctcagcagctgctggtggggagaggtgttggtgataagcgtggcagtggtggcaatgggagttgatggtgtcagaaggagtgttgatagaattgtggcagtagtagcagtggtagcaggaacagggaatgaaagcagaaggcaggaccatatgggatccttgtccagggactgacctaattgtgagattgccccacgcagaggtggccagccatcaggatcccagtattggagccaagcttggtggctcacatccataattccagagctttgggaggccaaagtggggagcgggggagggattgcttgacgccaggagtttgaaaccagcccgggtaacatagcgagacctcatctatacaaaataaaataaattagttgggcatggtggtgtgtgcaggtagttccaggtactcaggaggctgaggcaggaggatcgcttgagctcaggaggtcgaggctgtagtgagccgtgattgcaccacttcactccagcctgggcaacaaggccagaccctgtctctgtctctgtctctgtatatgtgtgtgtgtgtgtatgtatgtatgtatgtatgtatttatatgtattttatatatatatactgtatatgtgtacatgtgtatatatacatatatatacacacatacatatatatgcacatacacaaacacacacacacacacacacacacacacacacacatttaaatatatctatattttaaaagattccagttttggaaatggcatgccaaaccctcaccatgtaggccaaagtcacttccaaggggttcagttttttagatgaggcaggacaagtaggtcgtaggcagtggggaaagtggagatggacagggcaacactgggattctggaatgtcagctcagttggagtaagctctggcccacactcagggtctaattcatcccagatggagttaggcaggggggtaaatgctaagccagagccacccaatatgcacttagcagaccagttgatgcagcagctccccatttgaagcttgtaagaaatacaagttcttgggccacctcagacttactggtgattcggatgcaggttaaaggtagaggaacactcactcatctaagcttagacagattctcctgaatctccatactctgaagggcaattgaaatattcagtaagtctcatcatcaaggcttaacaactgtgtgagggttgagaggtcaggttgcccaccattgtggatgtgcagacttggccaagtcctggactgggtggccacttcccaagtacacataaaaatcccaagcactgacacttttgcattggttctggaagcaggtggagctgagtctgttttaggaccaccaggttcgtatgtccactgtgcagtaacagatcaattatgctgagacagcaggatttgcaacagagaaagagtttcatgagtatagggtagccaagtgaggagacaggaagagatcctcaaatccacctccccaacgatttctgggctggggctttgaaggggatcatggaaggtgagaggctggagaatcaaggtcattcattgatcagggtaaaggggatgaaattatcaagatgtggaaactgcgttctttggtgagtcagcttcttgtggggtccttcagaccagctgatgtcagcagtttcattggtatgcaggacatgaaagaatatctcaaagggaaaacttaatattttataatgttcaagttgttatctatagagcagttaaaggggactgtaatcttgtaacagggtctattgtcctagtcattctaggacaataggcactaagaaactatgatgaaacaggtcagagactaatgattaatgctgaatgtgctgcacgcttggtttattttaattttcccctcacttctttcctgatttttttttttttttgagacagagtctcactctattgcccaggctatagtgcagtggcatgatcttggctcactgcaacctccacctcccaggttcaagggattctcccacctcaggctcctgaatagctgagattacaggcgtgtgccacaaagccaggctaatttttatatttttagtagagacggggtttcaccacgttggccaggctggtcttgaactcctgacctcaggtgatccacccaccttggcctcccaaagtgctgggattataggtgtgagccatcacacccagcctcctgattaattttataaagtgtataggggcaatttcaagtctactaggtcaatacttgctcctgagcagggctctgagcccagggatggtaccgatagtttattctgtcatatcactgaaagtgcgggattgagacagaattctgtaatgttctttgctttagttcttaccgttttgtagctttctttttgccaatttatgctccatgagcctggatgacatgtgtttgttttattgttaaggagcaggtatgcatacctccctctccagtccttcctgatcacaggcagtgttcgcttctccccctcaacctcctcaaatgctgtttatcaaaatcttaaaaaacacaatggttcccaaatggcacttggccaattttgtattggattttataacatttatttttgtcgaaatgagtttctgcatttatttttgcagaaatgagtttctgttttcttctctgagttttttgtgaggaaaaaagaaagtaagatgtttttcttagtgttcttataatgtcctagaatggtttcatctgttaaggatgataaaggatcttaggtgaaggggtgactttctttttttttcttttttgagagagtctcgctctgtcacccagactggagtgcagtggcacaatctcagctcactgcaacccctgccccctgggttcaagcgattcttccaccccagcctctcgagtagctggggttacaggcatgtgccaccacgcctggctaatttttgtatttttagtagagataaggtcacaccatgtggctaggctggtctcgaactcctgagctcaagtgatctgcttgtctaagcctcccaaagggctgggattataggaatgagccaccgtgcctggccaagggggtgactttctaaccagtgtcaggttggggatttgtgtgcttccatgggagcctgggggccttgttttacttggctaatttatagactcattcactttaaggtgaatttgggctcttgcaccccacctcttcttcggtttctctccgttttcaaatctcaacaccctaatgctcttaggctgtctcagatgtgttccaccagagccaggcttcctggaagtccctcttgagatgtcccactcatccagttctccttgtattgaccctgcccctgcaggagacagctgcatctgcagggatttcttttttctcactggtactatcaggggccttctgtttgtcttgatcaacggaccattctcagcttgcattttctctaatgcatttgactttcctgaccctggaggttgagcagcttttggaggacagggactctgaaccttctcacccacagaggctcctttaaatatttataaaatgaatgcacatatccttcttccagaaactctgccaaacacttcacaggataatgcttcggaactggtgtcataggagcattatcctgtaaagtgctggactctgtttcaacacctgcagatgatgctcttgggctctcaggtttgagaacttcatttcctccttggagtcccgtctgtaccgccttgagtatggcttctccagcccttcttccttctacattctctatccagccctgtacaaaataaaagacattagctgggcatggtggtgcacgcctttagttccagctgctcgggaggctgaggcaggaggattgcttgagcccgggaggtcgaggctgcagtgagccatgattgctcactagccctccttcctgcctcctaaatacatgtgttccacaacgtgtggttctaagtcttcttccctgcatttcctggaactgtcaccttctctcctaggccatcatctccctttttttttttttgagacggagtctcgctctgttgctgaggcttgagagcagtggagcaatctcggctcactgcaacttccgccccaccaggatcatgcgattctcctgcctcagccccgctgagaggctgggattacatatgcccgccaccacacccggctagtttttgtatttttaatagagacggggtttctccatgttaggacatcatctcttatcactcagtgcctgacacctctgccctgttttctcacctccagaccattgtcgtggttcagctgcctaccccagaatgtcctctggccccctcaacctgtcctcagagaaactcatcaacttgttcttctcttctcttctttttctctttttaaatcaatcttatctggctaagtgtggtggctcacgcctgtaatcctagcactttaagaggctgaggtagggggatcacttgaggccaagagttcgagaccagcagggccaacatagcaaaattctgtctccactaaaaatacaaaaatgagccgggcatggtggcaggcacctgtagtcccagctacttgggaggctgaggcaggagaactgtttgaacccaggaagtggaggttgcagtgagctgaggtcacgccactgtactccagcctgggtggctgagcaagcttccatctgaaaaggaaaataaaataaaaataaaataaatcaatggcatcttcccagtttcctagactgaaactttgatgctcatgatactgtcatctaagtagatccaatttttcacttaggtgttttttggtgtggtattttagaatagtgagagctcacgtccagatctgctgcataacttaaacaactttttccgttaatgctcccagccaaaacagtttctctgtctgtgactcctcacagcactcttcctccgtgaccattttttttgggcgagtgggggccattagcctcatttaccttataatattgaatattataatttgtttttattttattttttttttaggcagagtttcgcccttgtttcccaggctggagtgcagtggtgcgatctcgcctcactgcaacctccgcctcccaggttcaagcaattctcctgcctcggcctcccgagtagctgggattacaggtacccgccaccatgcccagctattattttttgtattttttttttagaagagacagggtttctccatggtggccaggctggtctcaaactcctgatctcaggtgatgcacctgccttggcctcccaaagtgcgccttcctataatttttaaacgtatctcatctccttaactcgattgtaagcatcttgagggagcacttgtgtctgaattgtctttgagcacaggccagagcacaactcagtatcttataaagtccagaatcacactgcagggactgggaaggaagcctgctcagtgtcacttgttcttaaaccctgatcattggaggtggcatctaccttgatgtttccatacactgttgtttggaacagtgtatccctgtacattgtaagagtgagaatggtgtctactgctatacagtaggccctagactttataaatcattttggtggccaggcacagtggctcatgcctgtaatcccagcactttgggaggctgaggtgggtggatcacctgaggccaggagttcgagaccagcctgaccaacatggcgaaaccccatctctactaaaaatacaaaattagccggctgtggtgacacatgcctgtagtaccagctactcgggaggctgaggcaggagaatcacatgaacccaggaggtggaggttgcagtgagctgagatcgcgccactgcatttcagcctgggcaacgaaagagaaactccgtctcaaaacgtaaaaataaataaaaataaaaatgatattggctagttagaaagacaatctgttgttcataggaagttatgtaattgatcaacattaataattatgataaaccaattattattagatttaccatttattgaatgcatattgagtgctttctatatagcttttcctttagttgtagcagccataaggctagtaccaaatgattaggccttatccttttactcctttaatacctcccaaagctctttagatgtgagaaggccagtggtaatgacccacactttcttttgccaaccttgccaatccctacccatatatcttccctgaagtctcgcaacttcttaacaaatgaggaactcatttgatacccggatgtggtgagtgatgtagccaggagctgacatcctgttcctgggaagagccacgactaagttgcaggtcacgtggcagctaagaggtaacagtgcctccagaactcctggcatggtgcccagcgctcagcattcagaatattctccctgaacttacagagattcctgcagtcacaagccaaccctggtcagcaggcgggattccccttgtagcattccatgacctgtggcctttagtgacatgtccctgagtcccccagcacccatgcaggacatgtacctggagtgcaagtatctaagaatcccctccctgttagcccctccttttcctccctatacctggtgatttttatgcacacaaagtatcactttttttttttaaatgcctttagttttatttattcttaaaattagacaccaggtctttctctgttgcccagaatggagtgcagtagtgtaactatagctcactgcagcctcctgagttcaagtgattcttctgctttggcctcccgagtagccggaagtacaggtgcacaacactgcactcagccaagtatcagtctttatgtctatagagttagattcagttgagttgtgtttcagctctcccgttagcccatatgtgaccttggaacaggttagcctccctaagattatgtcttcatttgcaaaatagaattaatttagttaattaatgaaattaatctagcaacctcctagggtttctgcaaggataaaattagctcatagaaatgaagcactttgccacctgcttgttgcagaagggagggtattcaatccctggtagcattagttctgcctccaaggtagcatttctactactgagcaaagacttacattgcatcccaaggcacgtactgtaagaacgagtctgtgtgcagatggaaaagcccatatagaatttgataaaccggacaaggattctggccaagtttggaggaagggccactaagaaaaggaatcttgaaggacgtctgccggctcatagcagccgggatataaaagccaggcctggttcccatcccgctgtacggattgcaaactgtcagaagatagctgtcctgggtgaatgcatcagagatgtcttctgactcctagactgatgagattttcttttctgccagaattactaacatgcgattttttttgagatctttgaactccctgaagatctgtgggcattgcagtgggttagatgcaaatttgaaatgacatgtttatagaccttcttgcatttttgtcatttgcagaggagctgaaggtccccctagaggagtatgtccacaaacgctaccccgggctggtgaaggtggtaagaaatcagaagagggaaggcctgatccgcgctcgcattgagggctggaaggtggctaccgggcaggtcactggcttctttgatgcccacgtggaattcaccgctggctggtaggtcatgagctgaaactcaggggtgctcaagacctgcattgtggttgagaggggctggaatctgggaggtgggacatttcacctgttacctgtagtggcactgggagactagagagagactcgtcaaagaagaaagtgagaccattgtctgggataaagctagggagcagggagaaatttgtctgccgtctgttcagttcaccatcattggcatcatcgtcatcatcatcgtcatcaaaatccccagtgaaaatgttttatcaggctgggcatggtggcttgcgcctgtaatccctacactttaggagcccaaggtgggtggatcatttgaggtcaggagtttgagaccagcctgggcaacatggtgagaccctgtctctactaaaaatacagaaattaacctggcatggtggagcacgcctgtagtctcggctacttgggaggctgaggcaggagaatcgcttgaacttgggatgccaaggttgcagtgagcctagatcgcgccactgcactccagcctgggtgacagagagagactccatctcaaaaaaaaaagaaaaaaagaaaacggtgtatcaattagataaaactcaacagaatccttgcaaatggtacaagacagtcatatttttcttgttctcttttccttctttgctgctctgtttgcagggaaggatggttgtctgtcattgtgagaaaagagatatagttataattctaactactcaggtaaagctccccagaatgtatgggattatctttcacatcattcggaggaaggtgaagcgcattttctgcagataggccctgatatttttccaggtgaaaagaacagaatgtgagaaattggttgagtgtacggggagtagaagattttggatgcacaaagagtgaggccacaaaaatgccagaatcatgttaaaattggaataggactttccagttttaaagcatggtcagataattgttgctaagtaaccaatgatccatcaagttagaggttaaataacctgtaccctgggttgcttaattagtaagaagcagagtcttgtatttcacaaatatgtttatttacactcattgaggccttcttgagtaagtgttgttcactgtactagatttgaagaaccaatatcccatcactaattaacattaaaatgtctgttcttcttcatttgcaacaacctctagaatccttttaatggcaggataaaaagacaatgtttatgcatgtgaccacgtaagaaacccagggccactgataacactgaccccttcaagtgcatgctggggtctattgccatctcggccgccaattttccctcccagttttttgctgtcatcaaaccctggtgacacccagctgcatgtcttcagccctcatctctctcctgagctccagagctgtttatctctagtaataatcattcccaaagtgtggcgccccagacccacagcatccgcagaatctgagaacttgtcggaaatgcaaattcctgggctccactcagtcccctgaaatcagaagccgtgcaggtgagatccagcgatctgttgtaatcagccctccagaggactctgatgcatgctacagtttgagaagcactgagccataatggaagccttctgaaaaagattcaggcgaatgttccgttacagcctcaggcctggcataccttgtcttttccttggcatcattgcctcctcgtttctttcctttcaaaactgaaaggacatggccccgacacatgtccctttcccttgattttccccttgccatcatgttactcatcctgtcaacctccacctccagccagttttgtctgccatttctcctgtctccctctttctctctatcttgaccaccactctcctagcttggttctttcttgacattcacctaaaccaatgcggtcactgctggaactcattcttttggcagatacttgctagatgcctaccatatccctggtgctgttctaggtttggagtttggcactgagtgatttctcaggactttcagtggtaaggctggaagagtactgcacaaactgggacagttggacactaagctggggttcaaaatccagcaggtttggtatctgccctcaagtctacagtctaattctagtctacctaatcaaatccacctatcatctaattctcactgatgtctgtgactttagtctttgccattcagacgcattttccacacttctacccgggtggcatagaaccctctctgaattaaaaccccttggcagttcttcattacaaggtagacagtgtgtctcaacttttaccaggttctactgcaataaaagtctccagtcacaatgacttacaacaatacatgtttctctcttgtctgcatggcacgtcagctgcggttgtctggctgtggctgtgcttgatttctcctctgtgttctgagagtcaaggaatcctcctgtctaggacattccatctttgtggctcagggaaaagaacagtggctgaacttcgaaatggctgtttctgctctgatgtgacaccgtcattttgctcacatcccattggcaaaccaattcacatgtccaagttaaatgggaattggagactgggggaaggagtgtgcttctctaaggaagcattgcaggccacctggtaataggcaggacatccccagggaggagggagcaaattattgggaatcgtcatacattgtctagtagacagtaagatcaaaattctcagccgcagaaatatcagtgggaccaggcgtggtggcttacacctctcagcactttgggaggctgaggcgggcggatcacctgaggtcaggagttcgagaccagcctagccaacatggcgaaaccctgtctctactaaaaatacaaatacaggcgcctgtaatcccagctactcaggaggctgaggcaggagaatcgcttgaacctgggaggcggaagttgcagtgagctgagatcatgccattgcactatagcctgagagacgagtgaaactccgtctcaaaaagaaaaaaaaagaaatatcattggaaccaaggtcttctgcctccatactcagtgactctttcgctgctgatagatgggctgaactgaatgcttctaatgcatgatctggacttgcatggggttcatcatggttcatcaaagaggtagtggagcttcagaattaagacatgaaccagaccagctaggttagaaacctccttctaccaccacttggctgtataacctggggcaagctacttaacctccctggtcctcagtatcctcatttatataatgctgatcattgtatctacctcatacgattatcttgggggttgcattagtcaacacatgtgaaatatttcgaatggcccccagcactagtaagtgcttaataaagatcagctatcattagctcataaggaaaaataattcgtgttcagagttgattagcaaaggcagctgcgcagtcattgtgacttgaataaggtggggaaaatgatctaagagttgagaggaagaactcccacgggagaggtggtacttggtcttgggaccaggtggtgagagaggtgtgggaggtggtacttggtcttgggaccaggtggtgagtgaggtaggagagatggtacttggtctaagcctccttagatggctgtgctctctgccagtagcaaagggcatccccaggggagaatttcatgagtggaggcttggccagggccatggtcctaagcctgcctggaagccttggaaaattagtgccatttggcttcagcttatatggtgtgtgcagaagtattggaagcaggtaatggcccagggtatattttattgctcattttaaatagaaagatgagatgagccaacaggtaattcaatagctgcaaatgaaaagagatgggttgtcgactgtgtgttctcattattcttcccgataatgcagaggaatgggattttcgcttgactctgttccaaagcctgcattctgttataagctgggagattaatgccctggcttaggagagccatcttctccttctcgaatatgggaaatgatcccttcccgcgcctgcctcggagacacacgatggtggaggtgtctggccatctgctgtctcctaagccagtcgggctacaccttgaacctggagccagattcctgacgaattacctgctgcagcctcgagctggggaagtgagcaggaagctgggattctgcctgcctttgcatttaattagtttccagtctcctattgctaaccaattcaattagatccctttaagaaatcaattaaatcatcaattaaaacaactgaaataatcacacacacacacacagagaagctagtgaaatgtgtgttaaaaccaggccatccgggcagaagtgacctattttgggaaagggaattcagtgccagcagaaaaaacaagcggtggcagtcagtgccctggggggaaactgacgacactgtataaaactgtcatgcaatgtgaatcatggagtccaccgtcagtatgagaagtgagacttggcactttcttgggaaggagaccccatgttctgaactcctcttgctccaggcttttcgggccagagcaggcatcactctagtgattccaacaaggggaaaggggtgcgctgatttcacacgcttcacagcccaggagtgaagctgcaggatccagcgtgggcaggtccctgggagcctcagtttgcatctgagttccagccttcccaaagcccagccttaagtagctaaatgctgttcattccgtgtggtcttgggaggtgtgcctcacgggagagaagagaggtttcatgtctatttctctatgtttcagggctgagccggttctatcccgcatccaggaaaaccggaagcgtgtgatcctcccctccattgacaacatcaaacaggacaactttgaggtgcagcggtacgagaactcggcccacgggtacagctgggagctgtggtgcatgtacatcagccccccaaaagactggtgggacgccggagacccttctctccccatcaggtctgtggctggtgagcctggcggccaacgagcccccaaattcaagggtaaaaaggagctactgagagaggccaggaaagcctgccttgggctcgagcagctgtgtgcacacagctctccaggagccgccgttgtctcaggatcacagctttcctgcagagggaggatgttgcattttgcacctttatgtaaagttttcaagtgcagctttccaacagcgatactgagaagtttcaaactgatagtaatgttcacacttctttattcttcctcgtataggaggaactgcgttcaggagcttttaaggatgaagtttgaaagttattttttctggggctattttatacttgaagccttgtactgttgtcatgtttgcactctttttcatgatacaagatcatatagaaaaggacaagggggtgtggcattctgaggaactggagggatgttggggagctctttatggctcttgccccgggtcccacccagctgcctctcgggatatggagatcaatatcttgaggcataccagttgcagaactcaaatagaaaggaggttgaggccgggcctggtagctcatccctgtaatcccagcactgtgggaggccaaagtgggtggatcacttgaagtcaggagttcgagatcagcctggccaacatggcgaaaccccttctctactaaaatttaaaaaattagatgggcgtggtggcaggtgcctgtaatcccagctacttgggaggctgagacaggagaatcacttgaacctgggaggtggaggttgcagtgagctgagatcatgccattgcactccagcctgggcaacaagagcaaaactctgtctcgaaaaaaaaaaaaaaaagcaaggaggttgaatgaaataggttgatttcaatgctatattagtttcctcttgctgctataacaagttactatgaaaataatgacttgaaacagcacagattgatgctgctacagttcttgaggtcggaaatttgcaatgagctgatggaactaaaatgaagaaggggttgggtcaggagggctgggtcaggaggtctggtccttctgggggctcttgggagatccatgtccttgccttttccagcttccagaagctgcctcctcccttggctcatggctatgtcgcatctccctttctctctggcacccttcatcacgtgaccttttcctcctttgcttccttccttcccacttataaaggcttttgtgattacattctgggaccatacaagaatccaggattatctcccatcttgagatccttaacttaacaacatctgcaaagttcttttcctaaataagggaccattcacaagttcctaatctctggaacctgtgaatggtcctttatttgggaaaaagtgaaatgggagtgttcccttatcccctttgcggggcatatgacaggggtgtggcttgcttcttcagtgccccactgctcaaacccctagggggatcatgcagatgggtaggttgcggggagcattttggggctccgaccccatggcggtctccaggattgagtgtttacagctcccgaagccccagtgggcatgtgttacagtgtgctctttcatctttgccatctgcagggagcttgtgttaatcagcttacttagaccctctgccttatcacaaggacagagggctttctgtatcctgggtccttgccctagtgtgtcagaaaaaccagatcacatgtgggcttagagaatgagtgcaaggtgttcctgagtggtggaggtagctctcaatgagatggatggggagcaggaagggggatggagtgggaaggtggtcttcccctggagttgggttgcacagcagccagactctccttcaactacccctggccgaactcccctcagcatccacgtcattctgttgttgctagcctgctggtgtctgctggtgtctgtccatgtgttctgctcctctcaacgtccagccgcttgtgtctgtgcccactgtggtcccgggtttttatgggcacaggatgggggacagggtatggtgggccaaagggcaactttttcagtgcgaaaacagaaatacctgtcctcatttaggtccgtgggcacaggcccgagggtggagcccttgccagggaccctgcccttctctacccagcacttccctgcccctgttgcatatcaaaaggactttgcagatgtgatatggaaatcctaatctctggaacctgtgaatggtaccttatttggggaaaagggcttggttgaaaaccctctgatccccgagttatagttcagtactttatgtgagttctacttgaggaccaaactgactctaaaatcatggttctgtcttaagtagggagaggcaggagaggcctgtgtacctgggctcggttttaggggtgtgcttgttggtgttaagtaagatagcacgatggaataatgaagtagggatgaagactttttacagataatcatgaagttctttctcagtttaaacatttgtgattaacaagagtaaaagtttagccaggcccagtggccctcacctgtaatctcagcacttcgggaggccaaggcaggaggattgcctgagttcaggagtttaaaaccagcctgggcaacatagccagactgtgtctccactgaaataaaattaaaaaaaaaaattagccggggtggtggtgtgctcttgtaatctcagctacccaggaagctgaggaaggagggttgctggagcccaggaggtcgaggctgtagtgggctgtgatcactcctctgcactccagcctgggcaatagaaggagaccctgtcacaaataataataaaaaaagagtaagcttttgaaaagttcgttatttttctgctgacaccaaaagctgaaaaatagcctttgagtagagcatgggcaaatttgtacagcagagaaggtaatcttttgggtctacaacttcctcaagctgtcttgtggctcagctcccacaccaactgttcatcatgcagtgtttcaggaccatattcttggctatctgcaaataatattaatagtgtaaggttaactaaatctaagccttcagggatatttgagctttaatggcgagtgcttgaagacatgttgaccttcagatctcaaagggatgaaactcaaatgatggactgacagacagtgagtttcatgtgttggctgaaagatactttctcccaagtcttcacactgatacacgggagactggcctccagccaggacagataacagtatgagggtgtcaccgtaagtgctgtcaacagagaaaaagaagtgcttgcagtggagtgccttcggatgcccagcaaacatctgtaatgattgtctctgggtgtgtaaggttctaagcaaaaagttagcttgtatttcataagttacggtaatattaacagatgattaatatgcactttaaaaagactcaagaaagtagagtcatgatcatgagtcattaatgtgacatgcatctctgttgtacaaaatagaatcaaatgccaatgatgtctttttaatgtgtcttaacttacggaatgcttaatttgttaatagttgatggggatatttaattgcagggatgaatttttatggtccttctgaaattattaagcggatacaatatgctttcttaaacatgaggacatggcagtttctctttcttgctgtgaagccaacattttaatagtacgattttgctccagtaaaagatgggccaaagaaaacatttcatcatccaaatggtgttagattagatgagtctttagatactgagacttcccggtaagcaacataatataggagatttgcattaagggaattgataattccttctgtttcagttcttttcctgtttctttctatatattaatattttttttgtcctgcctgctaaatagctgttttctcaggttttctctttgtcctccacttttatttttccacaccagagtttccagtatagcaagtgggcaagtgccattaaagagggcaaaggccgattgtaagggtaagaggtgggggaactgaagaacacaggtcctgcccaaggaggcagctgttcccagctctgcttggtggtgccagtgtggtcaggtcttcagaatttttttttttttttgagacaaagtctagctctgtcgcccaggctgagtgcaggggagcgatctcggctcgctgcaacctctgcctcccgggttcgagcaattcttctgcttcagcctcctgagtatctgcgactacaggtgcatgccaccacgcccagctaattttttgtatttttagtagagacagggtttcaccatgttgaccaggctggtcttgaactcctgacctcgtgatccacccgtctcagcctcccaaagtgctaggattacaggcgtgagccactgcgcctggcccagaattttaagagaagccataaatctagagcctttgtgaaatctcctgccttctaaatgttgacaataaacctctcttcttcaaaacttcaaggccccaaccacatgcgtctagactgcatttgaccacccggcccccagaacttgatcttgcctttacactcaactccttggagacctgtgttgttcccaggatagctttcatttatgcaacttacaccggcagtgggcacctgtggtatgtattgtgggtgccatggaggatgtattagttcttgccctgctgtaaagaaatacctgagactgggtaatttataaagaaaggaggtttcattggcttaggattcagcaggctgtactggaagcatggaggcttctgcgtctggggaggcctcaggaatcttacagtcatggcagaaggggaagcaggcacgtattacatggccagagtaggaggaagaagagagaaggagaaggtgccacacacttgtaaacaaccagatctcttgagaactctatcatgagaacagcaccaaagggatggtgctaatgcattcatgaaggatccaccctcatgatccaatcacctcccaccaggccccacctccaacactagggattacaattcaacatgagatttgggcgggggtgcagagccaaaccacgtcagtggggctgggggatttggggaaagtgtcactcaaagccacaggagcaacatggccagacttccttgaactccagttcaacctgtagagattcccctcatgttgtattattgtgtgtccacagccctctctgctgaggttcgtctatgtaagactttgtgcagcactgacccagctcttgcctctgtgtagagaagcttcttaaatctgctgtcttaagctctgattgttctccaagagcaacttcctttctgttaggcggttcttgaattgctacaaagaaatgcctgaggctgagtaatttataaaggaaagaggtttcattggctcacagttctgcaggctgtacaaacctggcactggcatcttggcttttgaggaggcctcatagagcttttactcatggcagaaggtgaagtgggagctgacacatctcacggcaaagcaggaagaagaggcggtggctcacacctttaatcccagcactttgggaggccgaggtgggctgataactgaggtcaggagttcaagaccagcctagccaacatggataaaccctgtctctactaaaaatacaaaaattagctgggcatggtgatgcacacctgtaatcccagctactcgggaggatgaggcaggagaatcacctgaacttggaggcggaggttgcagtgagccaagatcataccacctgcactccagcctggctgacagagcaagactccagactccgtctcaaaaaaaaagatattggctagttagaaagacaagcgtgttcttcataggaagttataccatcaatccatattaataatgataatataccaattattattagatttaccgtttattgaatgcatattgaggactttatatatagcttttcatttactcttttttttttttttgagatggagtcttgctctgtcacccaggctggagtgcagtggcatgatcttggctcactgcaacctccacctcccaggttgaagcgattctcttgcctcagcctaccaagtagctgggactacaggtgcgtgcctccacacctggcttttatttttattttaatttttttttgtatttttagtagagacgaggttttaccgtgttaaccaggttggtctcaatctcctgacctcgtgatctgcctgcctcagccccctaaagtgctgggattacaggtgtgagccaccaccacgcctggcctcatttactcttaacagtcagaagcctagtaccaaatgattcggcagtatcctttttttgttttcaatgtccacaccacattggggtgtaggaaatctgaacctccaggttgcttttttgaccccatgcaggcagtgactcccttcagctggcctctcctagggtactctcgacttctgccttcttgtttgccccatgtactcttattgctggagtctccatgctctggtaagccactgtccagggcagtggtcctcaacccctgagttgcggaccagggctggtcctggtccatggccttttaggaactgagcctcacagcaggaggtgagtggcaggcgagcgagcaagcaaagcttcatctgtatttacagcctcttgccatctcccacattccctcctgagctcggcttctcatcagatcagcaggggcattcgattctcataggagcacaaatcctattgtgaattgcgcgtgtgaaggatgtaggttacgtgttgcttatgagataatctaatgcctgatcatctgaggtagaacagtttcatcctgaaaccatccccacccaccacccttgtccatggaaaaattgtcttccatgaaaccagtccctggtgctgaaaaggttggggactgctgatctagagcatcccttttggttttgtttatgatgttcttaatcgtggcaatatatatgtaacataaattttaccattttatccattgtaaagtgtgaagttcagtggcaataagaacattcccagtgttgtgcaactatctccacgatctacttccagttttcttattcccccaaatagcgacccagtgcccattaagcagtcacttcctattcctccctcccaccaaacagtgaaggctgccaatctactttctgtctctatggatttgcctattttggacatttcatataagtggagtcctgcagaatgtggctttttgtttctggcttcttttattagcatacagtttatgaggttcattcatgcatcagaaatccattgcttttcttggtggacatcccttttattattttttttgagacagaatctctccctgtcacccaagctggaatgcagtggtgtgatcttggctaactgcaacctctgcctctgggttcaagcaattcttctgcctcagcttcccgagtagctgggactacaggcatgcaccaccatgcccagctaatttttgtatttttagtagagacgaggtttcaccatgttggccaggatggtctcgatctcttgacctcgtgatctgcccacctcggcctcccaaagtgctgggattacaggcatgagccactgcgcccggctgacatcgtttttaaagtggttccaagtccacattccttctgcaggttccatatctggtttctgggatttgcacacctttgtccctcttgggtggaaagacggcttccctgaccagggctcccctgtgttccagagggcacgttccctttcgtaagtgtgagtcgcacaccagtgagcatgtgtctccacttccagggacaccggccactaggcttggggttagatggtaggactctcgtccctcccttcaggtacagtttgcttctgggaaaccctcctgacaccttcttttcctggactccacttacttatccaaagtattcggctaatctgtttgtctgtctattgaaatttttgcaagatctcttttaatacagcatctattgtcagaatgtcttcagccccagtgtggacacgaagagccctgttttaacacagtacatacatctgaaggcatggaacagggagaaggggaaagtctgaaggcagaaaggaaggggtggggactgattgggaaagaaagaccctgaagaaggaggcgtgggtgggctaaggacatgaacaatggtttggtcttgaatggtaggaagggaaaggtcatgctgtctgactcacattttccttgtgaatgaggagagaaaatcatttgttaagagtgagagctgggcctcagataggaggctacccaaaaggggtaaaagtctggaatcattgctgaaagttcaccaagaacagaaaaaataatggctatttcaaggtgcaaagaatataaattcaacaaaatttccaccaggatttctttttcttagttatttatatttttagagataagatctcactctgttgcccaggctagagtgcagtggtgagatcatagttcatcatggcctccaactcctgggctcaagcgatactcctgcctcagcctccagcggagctgggaccacaggcatgtgccaccatgcacaggtaatttttaaattttttcttgagacagtctcactctgtctcccaggctggagtgcagtggcaccatctcagctcattgcaatctccacctcctgggttcaagcgattctcctactgcagcctcccaagtagccgggattaccagtgcccaccaccacacccagctaattgttgtacttttagtagagataaggttttatcatgttggcaagactggtctcaaactcctgacctcaagtgatctgcccgcctcagccttccagagtgctgggattacatacgtgagccaccgtgcctggctgtaatttttaaaaaatgtttgtaaagtcaggggtcttgctatgttgcccaggctggtcttgatctcctggcctcaagcaatcctcttcccttattctcccaaagcactgggattatgagcaagagccactgcacctgaccccaccaggatttcttgacaaaaaaaactaccataaattcagttgtgttttgttatgaactcagattttgttattcatgacattatgtatatatggggaaaagagtgaggtgtaagataagaatgaaggataccatttatttagcctgaatgcacctaggttaggtgcaccataagttcatgaaaacctggcttagttctgctgccttcagagaacttttgctcgtagcttgagaactgctgatctgtacacttctctccagctgcaaaagcctgagactttcaccatgagagggaaggttccaaaatgccacagatgggacattttacagcatatgttgctttcagggcactggctgaaagctgagtcaggcatcttctgtgaggtgacagtggttcctccctgctgtatgttaggtggtcctataattagtgacattgctcatgaataactaattaaaggcaatgattaacaatttagcaatccttaatccaacatataatttgataataaattataaggtatgggtgctgttagagcctgttagactcctttagttgaaagggatgccttggatatatagttgccgggatctcaaattctgtgcacagatatgtacaaagggagaaggttattttttcctccctaaaggaatatgactggcttacagaggaggaaagctttaagagaagaaatcagactttaaaatagaggtatctttcctatgcatcagcaaatatattttaggggccaattgtgtgctcagctttggggtaagcatttccagcagggatagtattggtaaatgaaatgattatcctgtcttgatggagttcatgggtggtgacacaggctttcaaatgtgtgtgatagcacttcagggcaatgaaatgtggaatcatgggagggagggaatttttgccattggagtggatggaaaagctcatagccataactaacaccacagtgttctatgtgtcaggtacagttcttgtatttagcacaatacacatctattcgctcctcattctcaccctatgagtatttttttttcttttcttttcttttttttttttttttttttgagacagagtcttgccctgtcacccaggctgggtgtagtggtgtgatctcaactcactgcaacctccacctcccgggttcaagtgattctcccgcctcagcctcctgagtagctgggactacaggcatgcaccaccacagctggctaatttttgtacatttaatagagatgggttttgccatgttggtcaggttggtctcaaactcctaacctcaagtgatacaccctcctcagcctcccaaagtgctgggattacaggtgggagccaccgtacctggccaagatgaatattattatatcctttttacaggcaaagttgctgaagcatgagttaagcaccttacccaacgtcacacacctggtaagaagtggagctgggattcggatgtagtcaggcccagagtctgtgttcttacctgctgttctgtctttcctggaaaagatttgactagctggaccttgccagctggaggagatttttaccggctgagtatatgcaagataacacaatgcagggtatagttctgcaaatgagtgtgtttggggtcttaaagcccactgtcatgtttcatgattcaccaggagaactctcgaaactcagaaaagctgtacaatcatggttattatttgttaatgatgaaaagatacagattaaaatcaacaggctgggcatggtggctcacacctataatcccagcactttgggaggccaaggcaggtggatcacctgaggtcaggaattcaagaccagcctgcccaacatagtgaaactgtgtctctactaaaaatacaaaaagtagctgggtgtgatggtgcacacctgtaattccagctactcgggaagctgaggcaggataatcacttgaacatgggacgcggaggttgcagtgagccgagatcacgccattgcactccagcctgggcaacagagcaagactccgtctcaaaaaaaaaaaatctgcagagatgcatgaagagtcccacagaagtcagttgcaagcttccacttgtcctctcccaaatggagttgtatgggtagggctgatttgctccgcggtggcacataacaactcatttcaagtcctgccaatcaggaagctcacctgagccttggcatcccgggtttttactgtgggtcagtcacataggcatggagagccttgcatgactctccttagctactcaacctccagcccttgcccaccagaagttaaactgcagtagcatcgtccagggccttggcatgcaaagacactcttatcaggtaggatattccaagggcttagagattgtctcccagaagctgatccagggccagttctttctctggattgtgcggggtttagacaacccaagcccactgagttaaccctttactacataatgaagatgagttgtttagtgtcttatgaagatactgaaggtgggaaatatgcattaaaaaacagaagaaagaggttgagtgcgatggctctggtctgtaatcttagcactttgggaggccaaggcaggaagatcacttgaagccaggagttcaaggccagcttggacaacacagtgagatcccatctgtatttctttttgttgttgttgttgtccagacagagtctcactccatcacccaggcgggagtgcagtggcttgatctcgactcactgcaacctccaccttctgggttcaagcgattattgtacctcagcttcctgagtagctggaataacaggcatgcaccaccacacctggctaattttttgtatttttagtagagacagggtttcaccatgttggccaggctggtctccacacctcaggtgatctgcccaccttggcctcccaaagtgctgggattacaggagtcagccactgtgcctggccccatctctattctttaaaaatataaagtaaaaatagaggaaagatggaagactatccggtcttcatctggaagtcgtcatcttccagataaaaacaggaggtatgctgtatagagggctctaaaaaccaaacagcagagcccagactcaccccactagtctggtgagtctaactaaagatgaataaaaaaccaaccaggggagacagaaagtagaatagtgcttacccactactaggggtcacccccatctgtggaggagggatggatagaggagtgactgataatgaagatggggctttggggtagaagtgatgaaaatgttccaaaattggtttttgtgacattgcataactctatgactatactaaaaaccattggcttgtacacagcaagcaggtgaattatgtggtccgtgaattctttctcagaagctgatggctatcggatgaccagtccttcaacaagatgaagacagattgagtatcaattattggttcacaatggcctggaacgtttctctctggttaaccctgagattttgcctgtcccttcttttgtcagagcagcacagagtacagcaggtgatccaatcggggtcaaattttaaaccagcagaactggtcatggtagagtcctgagtgggaatttagaaaccaagtctgatggttaatactgggtgtcaacttgattggattgaaggatacaaagtattgtttctgcatgtatttatgagggtattgtcaaaggagattaacatttgagtcactggactgggagaggcagacccaccctcaatctgtttgggcaccatctaatcagctgccagcgtggctaggataaaagcaggcaggaatgtggaaggactagattggctgagtcttctggcctccatctttttcctgtgccaaatgcttcctgcccttgaacatcagactccaatttcttcagcttttggactcttgggcttacaccagtgaattgccaggggctcttggaccttctgccacagattgaaggctgcactgtcaacttccctactttagaggttttgggattcagacaggtttctttactcctcagcttgcagacggcttattgcgggacttcaccttgtgatcatgtgagtcaattctccttaataaactcccctttatatatacatctatcttatgagtcctgtccctctagagaaccctcactaatacaccaaggaacatccttggtgaaggtttagcatcacacaggaccagaccagctgaggctgctgacctccctgggcctggtagagaatcctggtcaattgcagtgtgttgtgggtaaggtcaggttgaagactggtacttttccttggtctagcaaaggagagttcgtaaagcaatccagccaggggccaagtgaatgctggcacatttcaggaagagaaaagtcacagtgaagaagatagacattctccacctttctttttttccctgtcctgctagtcttccaataacagagaaatggcctgttcacttttgccacccgtgggttctgtgtccttaggcagatcactcacttgttgtgtaaatgagcttttaattttcttgtccttaaaacttcaccagcattgaaatgtcgattgttccactagtagaaaattgccgtaacaaaacttttggtcccttagatgaaaagcactaattataaactctctggagttgtggcatgggctgttgtagataattaatgtttcagttaatagaattctactacagaagcaagacatggagagatagatggtaaaaaacaaacaaacaaacaaaaaccctccacaaaattctgtttgctttcttcaggggaccagtctggagaaggctggttgacagagggtgttgcttccattgagggaattcacatcacactagaagaggcattattataaaatattactcaggaatatggacagatgcagtgggtcatgcctataatcccagcattttgggaggctgaagtgggaggattgttgagaccaggagttcaagaccagcctgggcatcctagcaagaccccatctctacagaaaaatttttaaaattagatggatgtggtggtgcgtgcctgaaactgcctttgcaaaattatgactgagacggtgaaaaagatctaacctaagtgactccatcttccttctaacctttaacctgtccttgttccttctgggtcataggctgaattagcttagggaggaacttagtttatagtttaaaacaaagatgataacagccctttcccaaaacaaacctcctcttgcctggggactagaccgcctttgtaggactaacaaattagccataacattagaaattatggtttaggagtcatgcagctggaggctacaagcttctgaccctccctaaaccacttcctaagatcagtgcttgagatattttgcagaccctgcacttgatggatcagctggtgccacccagatctataaactagttcatctgatcttcgggcccccacccaggaactgactcagcgcaagaggacggcatcaattccctatgatttcatctccgacccaaccaatcaacactctcaactcactggccttcccccaccgaagttgctctaaaaaactctgatccccagccaggcgcaatggctcacgcctgtaatcccagcactttgggaggccgagaccggtggatcatggggtcaggagatcaagatcatcctggctaacacagtgaaaccccatctctactaaaaatacaaaataattagcagggcgtggtggcggacgcctgtagtcccacctactcgggaggctgaggcaggagaatggcgtgaacctgggaggtggagcttgcagtgagccaagatcacgctactgcactccagcctgggttacagaacgagactccttctcaaaaaaaagaaaaaaaaaaaaaacaactctgatccccgaatgctcagggagactgatttgagtaataataaaactcgggtctcccagacagctggctctggtgcgaattactctttctctgttgcaattcccctgtcttgataaatcagctctgtctaggcagcaggcaagatgaacccaccgggtggttacatggctgtagtctcggacactcaggaggctgagatgagaggattgcttaagctcaagagttggaggctgcagtgagctgtaatcattccactgcacaccagccttggcaactgagtgaaaccctgtctctaaaagaaaatgaaatgaaataaaatttaaaaataaacttgttctatggaggacactcttattgtatgtcagtcctctttaaaaatgtatccatgttggctgggcacggtgactcacgcctgtaatcccagcactttgggaggccgaggcaggcagatcacgaggtcaagagattgagaccatcctggctaacatggtgaaactctgtctttactaaaaatacaaaaaattagtcagggatcgtggcgggcgcctgtagtcccagctactcaggaggctaaggcaggagaatggtgtgaacccgggaggcagagcttgcagtgagctgagatcgcaccactgcactccagcctgggcgacagagcgagactccatctcaaaaaaaaaataaaaaataaaacaaaaataaatgtatccatgtttccacactttcgagaccccaaatgcaaactctgaatgaaaacaactgctagagaaacagtgtgagtttgactgtctgtaagatggtctaatggaaggcatatccatttctctgcgggggtccatcctgcagaccctgacccaacaatggatgaataacgtacactgacacagatattctgcttatcagtccagctgagcatctgggctcctcacagacaccaaggaagatgtgtgaagagtcagcagccacatcttcgactcgctggccctcccggcatttattcagcacacattaaatgacagaggtcttaagtaaacaccactagaaggtaattaccgttgctgacccccctgagtagagagcaatcatgcaaccacggatggtcaaaggttagtcttaggaccacatgagtaaacaagctatttagataaactactctgcatccttttgtatctgcaccctaagctctctggctcctgaaaagagaatctggctgccttcagccaaactacctaaagttatgcaaaactccccagccttccaagatttgcttttttctattcctgtgattttacaatttctcccaccatcctgactgaatccccatatttctttaaaacatttgctatttgttcaaacaatcagctgggaagaatgcctacgaaccatcacagttgatcaggtccctaaaggagcatcatgatcaactttatcactttctgggaaagtaggtacagttcacaaggtgacacgggatatcactccctagttggtcggctctgcgtggccgtccacagctgactgctgccttcccacagggctcaacgaatatgtaacttcacagatgaggacaagtgattcttcagtgacttcaaatgtcagcagcatgatgtgatagaacatctcccaggttctggagcctgtttcagtttttgttgttgtttttgtttgtttgttttaaattttttgagacagggtctcactctgccacccaggctagagtgcagtggtgcaatcatagctcactgtaaccttgaactcctaggctcaagcaatcttcccaccttagttgcccaagtagctgggactacaggtgcatgccatgcccagctaattatttttattttttgtagaagtagggtcttgctatgttgtccaggctggtctcaaactcctggtttcaagcattcctcgtgccttggcctcccaaagtgctgggattacaggcatgagccactgcacttggcaaagagacctgttttctaagccagatttgaaccacaaattttgatattcagtttacttccctgtaaaatggtggatttggactatgtgatattagtcagggttctctagagggacagaactaataatatatgtatgtatgtatgtatatgggtttaataagtattaactcacaagatgacaaggtcccacaataggctgtctgcaagctggggagcaaggaagccagtccaagttccaaaactgaagaatttgcagtccaatgtttgagggcaggaagcatccagcatgggagaaagatgcagtctgggaggctaagctagtctagtcatttcacgtttttctgcctgctttatattctagccatgctggttagtgcccacccagattaagggtgagtctgcctttcccagcccactgactcaaatgttagtctcctttggcaacaccttggcagacacacccaggatcaatactttgcatccttcaatccaatcaagttgacactcagtattaatcatcacagatgcattggatgagatgtcttcagattcttcatctgtaaaggggataataatagtactgtcttatagggttgttgtgaagattaaatgagataatacatgtaaaatgcttaaaacagtccatggcacatagtaagtgctctagaaataacagctgttcttgctatcaatattattagagcaattctctattctacaatgctcctcactttgggaatattataatagcccttttctttttatttggtctaggtcatacaaccaaatagttataacaaataacctgatcattggattatcactaatttatgtcctacacatgacagactctggtcgctaataaaagatagacttttttttttttttttggagacaaggtcttgttttgtggcccaggctggagtgcagtgatgtgatcatagctcactgtagccttgacctcccaggctcaagggatcctcccacctcagcctcccatgtagctgggaccacaggcatgcaccaccaccatgcctggctaattttttaaaattgtttgtagagatgagtcttgctatgttgccctggctggcctcaaactcctggcctcaagtgatcctcccacctcggcctcccaaagtgctgggattactttgccaggggtgaaccactgcgcccagccaggccaggagagacattttaaatgccaagggatttgcacagaaaagaagggactcatgttcttgaagccactctcttcagaaagctattccttatgaaatgggagtgcacttacagaatggtgaacaccttgcttttgggtgaaatacatgctatttcttgacatcacctaggtaccttctgcaccagcctgggtagatcaatatttctttttgcgtgacacgctgatattgctgctagatagctttcctttggaagcaaaattcccaggcagtgccctagagctggagcaacattagcaacgtaaactttctctgcgatgacaagcagagaggcctgcctccatcaaccgacatgcactgtgacagctcccagcggcaggtagattaatctgaataatgtcagaatgacttttctcctcccttgtaaagaggttcagtgttgcgggctgccaaggagcagacacattttattttaaatttaaggatttttaaaaatggaggacactttacctctgaattaaatgctcagttcctgagttattgctggacataaatagggaagcagccatcccattaattttatggagctgatctgtggggagagagtaataggcttcatattctccttctgttggtgctagatgtagactatagtgaggggtggaaaggggtaggctccagctcttattttggtagctttaatccccctttctagatggttccagagtgtttcatcttccaggccctcttttttttttttttttttttgagacagaatttcactctgtcacccaggctggaatacagtggcacaatcttggctcattgcagcctcgcttcctgggttcaagcaattttcctgccttagcctcccgagcatgcgccaccacgcctggctaatttttcgtatttttagtaggggcaggatttcaccatgttggccagactggtctcgaactcctgacctcgagtgatccatcttttcaggccctcttacatatctttcttcttctgccctttctttttattcctttttccactgtatcctgaaaggctgaaaagtaactgcagaagactctgaaattcagttcagggcagaaaataacctttcttccttgctcccccacgacctctgatggtttttttctacagcacagttcagaactctttctttcttaattttttttttttttttttgagatggagtttccctctgttgcccaggctagagtgcaatggcacgatctcagctcactgcgacctccgaatcctgggttcaaccaattctcctgcctcagcctcccaagtagctgggattacaggcatgtgccaccatgcgcggttaactttgtatttttagtagagatggggtttcaccatgttggtcaggctggtcttgaactcccgacctcaggtaatctgcccacctcggcctcccaaagtgctgggattacaggtgtgagccaccgcgcctggccagttcagaactgttttcttgtctcctggcccttctggtcctccacgaattattatttcttagttgtttccagggggtcctttagaaaagaaaacgaagattatcacttgttctcaaacccaaacagccttttttgtttacctagtctctccagtagcacttgctggagttttcatcctccgaggtgtggcaatgagtaacttctcatcaggccttaccagtcatgcaaggtgtgttacgtttgaggccatccatttctcctcttgtttatggaaatacaggaacatatgactatttcatgtcttgtgcgttggagagaaagcatatcagtttttttgttgttgttcttttttttttggtttttttttggagatggattcttgctcttccgccaggctgcagtgcagtggcgcgatcttggctcactgcaacctccgcctcctgggttcaagttgttctcctgcctcagcctcacaagtagctgggactataggcgcccgccaccacgcccggctgatttttgtatttttagtagagacagggtttcatcatgttggccagtctgatctctatctcttgacctcgtaatccacccaccttggcctcccataccaaattttatttgagattgggaagtcaatcatgagtaccgatatcagagcctgcagagccttctcttccaaccaatgaactatctgcagtacagcatacacaaatgaccatttgtggttaaccacccggacaccatttccatttttcatcctgttgaccctccacagttttttttctttttctttttctttttttaattttactttaagttctgggatacatttgcagaacgtgcaggtttgttaacacaggtatacatgtgccatggtggtttgctgcacctatcaaccggtcatctaggttttaagccctgcatgcattaggtatttgtcctaatgctctccctcccttcgcccctcacctactgacatgtccccgtgtgtgatgttcccctccctgtgtccatgtgttctcattggtcaactcccacttatgagtgagaacatgcagtgtttggttttctgttcctgtgtttgctgagaagcatggtttccagctacatccatgtccctgcaaaggacatgaactcattctttttaatggctgcatagtattccatggtgtgtatgtgccacattttctttatccagtttatcattgatgggcatttgggttggttccaagtctttgctattgtaaatagtgctgcaataaacgtatgtgtgtgtgtgtgtctttatagtagaatgatgtataatcctttgggtatatgcccagtaatgggattgctgggtcaaatggtatttctggttctagatcctggaggaatcgccacactgtcttccacaatggttgaactgatttacagtcccaccaacaatgtaaaagtgttcctatttctccccaacctcatcagcaagttatttttttgactttttcataatagccattcaagcctgcagaagtgttttttttgttttgttttgttttgagatggagtctcactctgtcacccaggctggagtgcaatggcccgatctcagctcactgcaagctctgcctgccgggtttacgccattctcctgcctcagcctcctgagtagctgggactacgggcgcccgccaccatgcccggctaatttttttgtatttttttagtagagatggggtttcaccgtgttagccaggatggtctcaatctcctgacctcatgatctgcctgcctcggcctcccaaagtgctgggattacaggcgtgagccaccggcctgcagaagttttaagcagactttcccaaagtctgaaaattgggttggtactttgcaatatctttttggagtgttgggtcacagtctttccttttttggctgccaacatgactctaaaaatagcttctgctaccaggcacgcagagagtcaggggtaattgacttcattttcttccggaagtgtaggctcctgtgtcattaagtcattctggtagtacatccttacagcagcagagaggttgcaacaagcttgcttaactgttgtgaataacataactaccagtcacgcttgataaagcagtggccccttcaaagccctccgaaaacaggcagtgtgtgagacccgggagagctggcctgcatgggaggtcctttatacacttggtaggatgccccagtcagtattttggagtttaacttccgtgcatgaagttcaatggactcccaggctcttaagaacttcaacttaaaggaaagaggagagaaatgtttcttgagtgtcttttatgaacattgaatttccgactgtggtttctgtggcggctgcaggaggtttcagctggtggcatgagcccttcccatgctataagcaactctgaagtttcagttgcatggacagggtctgagaatgactcagggcaggttacagctcttcattttcgaggtcagcttcgtcgccaattcaaattcaggttattctagttgaatactgggtctctgcaacttctcagttctttgcctcctgccccattccttctctaggatggcttctgggtacgtggggagagggagggtttattttgtgatcaaggggaagcatgacggtctttacacgcactgtttctctgtagagttaggatatttgtcgcttccgaatctcatgctgaaatttgatccgcagtgttggaggtgggcctggagggaggtgtttgggtcatggggacagacccctcatgaatggcttggtgccctcctcctggtaataagtgagttcttgctctattagttcatcttagagctggttgtttaaaagagcatggcactttccttctctctctcctgctccccttatttctccacgtgatgcctgccccatcctccaccttctgccatgagtggaagctgcctcaggccctcaccaggagcagatactgatgccatgcttcttgtacagcttgcaaaaccatgagccagataaacctctattcttcataaattacctagtctgaggtgttcctttttttttttttgagatagagtttcgctcttgttgcccaggctggagtgcagtggcatgatcttggctcactgcaacctccacctcctgcgttgaagtcattcttctgcctcagcttcccgagtggctgggactacaggcgcctgccaccacccctcgctaattgttttgtattttcagtagagacggggtttcaccatgttggccaggctggtctcgaacttttgacctcgggtgatctgcccgccttggcctcccaaagtgctggaattacaggtgtgaggcaccccgctcggcctgaattgttcctttatagcaacacaaaatggactaagacatcctcttgccctctgggcagtgtccctggcctggctggccactccttgccctgctggcattcccagaagacatctgccatgggcctaacttgggatctgacctctcagcttcctcagggcccatctgacccagatctctatggctcatgctggctgcaaacacctgagccttggccacattcccctacccatcccagccccagctgcaggcttcattcctgcccagggaaaagccatcaacaactcttctgccttccctcgccacttcccctttccttcctatgagaaccaagcagaggggctaatgtacgtggcctcctgccatgtggccacactaaaccatcaggttcatgagggtgggcttaggaggatatagacacctgcaggcagcttcatgacacacccaccgtggaaaacaggggtgtcttccgtagcaaactcactatccaacacatctctccctctctgggccaaaatgttaactgagggccgggtgcagtggctcacgcctgtaatcccagcactctgggaggccgaggcaggtagatcacttgaggttaggagttccagaccaacctggccaacatggtgaaactctgtctttactaaaaatacaaaaattgactgggcagcgcctgtaatcccagctactcaggaggctgaggcaagagaattacttgaatccgggaggtggaggctgcagtgaggcgagatggtgtcactgcactctagcctgggccagcgagactctgtctcaaggaaaacaaacaaacaaacaaacgaaatgttacctgaaaaaaactggagttcatttgcctgaggattaacaaatgactctccaggagaacgcaggctttgatcagtaggtgttttattactcatcacaagtaaggacagcactgggaatattctccaaagcggtgtctctggagggaaagtgacaggagggttttatgggggaatggagaggggagagggtgcatcagcacatgtagaggaggggtctcagtggtgcagatgcggagagccatcatgccatcacccagtcacatgggatggtaatggagctatagcacctcccagggtggagccacctttttttttctttctttctttttttttttttttttgagacagattctcactccgtcacccaggctggagtgcagtggcacaatctcagctcactgcaacctccacctcccaggttcaagcgattctcctgcctcagcctctcgagcagctgggattacaggtgctcaccaccacgcccggctaatttttgtatttttgtttgttttttttttttaagtgtagatggggttttgccatgttggccaggctggtctcgaactcctgacctcaggtgattcacccaccttggcctcccaaagtgctgggattacacgtgtgagccactgcgcccggccagggtggaggcttcaacatggtcatgaggaaggttcattcaggttcatctctaagttgctggggtctgtcaggagctggttccagacaactaggtaaccacattttgcacagggcttgggaagaaacaggctgcaaggtaggagactgtaaaataggctgattgctgaaatcgattaaattcttataattcctggagactggagactgtccctttctgcttccagaaacatgtcatctcttacctctcccagctccctggaccttctttgcttcccacaggaccttgggcgggaagctgggctttcccctggagtgctccttaatgcctctgcacactcagctttagctgtgatgacaggagagagtcctaagtgatccgcctaccttggcctcccaaagtgctggtattacaagtgtgagccactgccttatagtattttcttaaaagtaactttattcagggggaaaaaaatcccctaaatcttgtagtcgtttctgagaaacgggaatattttcttgaagaagcttgaaattgcagaggcttaaatcttaaattatatgaggagggaggagcagaggctggcagccatgaaattagagctccataatttgtctacagccattcaagaggggaagaaataagaatgattttctgctctgcttccaatccagatgttgtcttccagcccagtagagaagaacaagaccagagcctaggagaccaatcactttaaaaattatagtgtaaaaatactttttttattatgtattcattataaaatttatactgtatccattataaatttaatattcactgtaaaaatcaaaaatacaaaagatcattagataatcactgataatcataacacccaacgataaccataaccaatgttaatatttcatgagtagctttaatatttcacattattttttactcctacaaataatgtaaaatttatattttcatataaacattttgtatgtacatgtttaaaagtcaaatatatattctacaaggctctacctactctttagaggtaccactttatttatttacttatttattttgaggtggagttttgctctagtcgcccaggctggagtgcaatggcatgatctcggctcactgcaacctctgcctcctgggttcaagtgattcttctgcttcgacctccagagtagctgggattacaggcatgtgccaccatgctcagctaatttttgtatttttagtagagacagggtttcaccacattggccaggctggtctcgaactcctgacctcaagtgatctgtctgcctctgcctcccagagtgctgggattacaggcatgaaccactgcggccgactctattcttttaaatatgccttttgtttacctctatatctctaaatagtacactttagtcctacatcatgcattttgagatgtgggcattacttcttgactttgactatgggagacaaggtattaactgttattcactcacccgcatccacctctcccgcaaattcacacactactcattcctttgctgagggcttttcccgccacaccagccaaatcttcagttctctgattctcaacactgggtttcctacaattcaattcaattatgacactgattacccagagtaagcattcgaatccacaggtttaagggctcagtcccaaagactgctcccactttaggcactagtcataaatatcaggtctccaggctatccatatttttgtccaacatggctacaaatttggggtttcccaccacctcccttcaggtttgatgatttgctagaatgaatcacagagctcaagaaaacactgcgtactgttacaggttgagcatcctaaattggaaaatctggaattcaaaatgccccaaaatccaactttttgagtgtccacataatgctcaaaggataatgcttattgggaagtattttgcattttctgacatagaatgctcagttggtaagtataatgcaaataatctaaaatcaaaaaaaaaatctgagatttgcaacatgggtctcaagtgttttggttaagggatacttgacctacaccagttcataataaaagatgcaaccccagaatagctgaatggaagaaatgtgtgcccactcttacaccacttattaatacttatattattataactatttgcatctgatccacatggtatactttggttatttttcccttccctgcacagctttttgtttttcctgtatttaaccattgcctttctgtttgtttccttaatttgttttctatatactgttaactaattcagctacatgctttctaccacttgtctgaattccctctcagtcctctcagcaaccttagatattctgtctgctttattttcatgaagagagctccccagggtgctatggcctcatccatcaggactggctgccctctagcagtgatcctgggattcctttcacttctcttctgtgtcccggatctcatgcctttatcttttttagcttattctctcattttattggtgcatatcttcaaataactatttttagtgcttgtatgtgtaaaaatgtctggattctgccttccactttgaatgaccttggcttagaatttgaagacaatattccattgtcttcttacttccaacatggctattggagagttcagagacattctgactcctagttctttcaatgtaacttgtctctttctcttttgaaattcttttattctgggtgctctgaaatttggtgatgctgtgttttggagtatatttctttttattcattgcactggcactcaatagaactttccatttgaaatgtgtgtgcattgttgatatccttacttcgtgtgtatgtgtgtgtgtgtgtgtgtgtggtctctatttttggaactctttttgtttttgtttgggtgttgaaccatccttgtggactgtttctttgtttttctttaatctctgatttttcatcttttatcttttgtctgtatttctggggtattttcttaactttgtttttctaaattttctgtttctgcttttacatttttaattttcaagggttctttttggttctttatcgatcttttgccataacactcagtacttgttttatcaatgcaatatcctttctaattatctgagactgtgaatgtcattttttcttgaaaacaaaaggcatgtatatcttgcaaacataatgttgaatcagagaatacaggcgcaaaaggatgcattactatttgattctttttatataaatttcaattccaaactcatcaagttgtatacattaactatgtatggatttttgtgtatgaatcataccttaataaatagtttaaaaataaataaattataaagccaagaaaaatttagctgttattggaagtcaggtagccagtgggggtaatgactgggagagtgcatagaagggatttctaggacactggttatcttctatttcttgacttgggtgatggtttaaacggatggattccatttgttaaagttgacagctgaacttctgaaacttgtgtacttctctatgtgtttgctctacttcagtgaaaagttttaattagaaataacagctgcctattttcttttttttttttttttttttttgaggcagagtctcgctctgtctcccaggctggagtgcagtggcgcgatcttggctcactgcagcccccacctaccgggttcaagcaattctcctgccttagtctcccgagtagtgggattatgggcatatgccaccacacctggctaatttttgtacttttagtagagatggggtttcaccatggctggtgttgaactcctgacatcaaatgatccacccaccttggcctcccaaagtgcttgattttcttatttttgtttttaccagtggataatcacattatgtgattttttttaataagtaagtaatttgcctctttatttcctatcattatatgtatattttttaccttaactgcagtctgcagagcaatgttgagtattaatggtgagaacaaatctttatctcattcctgacttaatgaaataccttgaatgtttcaccattatgactcatattggctgttttaaatagacatcagattagggacattttctgtctaatttactctgagtttttcttggcgacacatattggatgttttcattgcttttttggcatttattaaggtatttatatatttttctcttgatttattaatcttttgaattatattaatcgattgtctaaccgggcgcggtggctcacgcttgtaatcccagcactttgggaggctgaggcaggcagatcacctgaggttggaagttcgagaccagcctgaccaacatggagaaaccccatctctactaaaaatacaaaattagccagtcgtggtggcaggtacctgtaatcccagctactcgggaggctgaggcaggagaaatcacttgaacccgggacgcagaagttgtggtgagccgagatcgtgccatcgcactccagcctgggcaacaaagagcgaaactccctctcaaaaaaaaaaaaaagattgtctaaaatatgaccatatttgtatttctagagtaaacacttcttggtcctggtttattagttgttagtatttaaagattttttttttttttttgagacagtctttctctgtcgcccaggatggagtgcagtcgcgcgatctcggctcaccgcaaactctgcctctcgggctcaagaaattctcttgcctcagcctcgcgagtagtggcattacaggcatgtgccacaaggtctagctaatttttgtatttttagtagagacggggtttcgccatgttggccaggctggtctcgtcgcgacctcaagtgatccacctgtgtcggcctcccaaagtgctggaattacaggcatgagccagtgcacctggcttacttgaaaattttaaccctcagtggattagtggaactcgtgtactttttcttttgtgtgtgcatgtgctttttaaatgaaaaagacagccttggtgagatataattcacgtcatatattttaaacatttaaagtgtataattaaatggtttttagtacgttcacagagttctgcaaccatcactgcagttttagtatatgtgctgcacccttaaaagaaacgccattctcatttccctctaactctcccagccccaggcaaccacaaatctattttctgtctctttggatttgcctgttctggatgttttacagaaatggaataggtggtcttttgtgagtggcttctttctgttagcatcatgctttcaaggcgtgtgtgctggcttgagtgcttttctaagagcattatataagcttggagaaaatgataaacttttaaattttattttctgttctagactacttcagattgcatggcgtttttcttttttttattcttttttttttttattatactctaagttctagggtacatgtgcacaatgtgcaggtttgctacatatgtatacatgtgccatgttggtgtgctgcacccattaactcatcattcacattaggtatatctcctaatgctatccctccccactccctccaccccacagcaggccctggtgtgtgatgttccccttcctgtgtccaagtgttctcattgttcaattcccacctatgagtgagaacatgtggtgtttggttttttgtccttgcaatagtttgctgagaattgcatgacatttttctagtcctcaaaaaattgacagaatttacctataataccctctgggtctaatgtctttctggatagtcattctcgacagcctttccaggattttcagtgattagtctatgccagttttctactctgtcgcagaaagttttcttgaccattcttctactcatcatttaaaaatttaaaagcttctatatgtttttggtaagagttctttgctcagatctaatagcatttatcagtgtttttctctcctttaaaatgagattaattttaaaatcctttcgacgaactaactccttattctcggttcccctctttccttatatttgaattttattaattcattttgtctgttcctcttttctccttggtctgcttgctctctttctgcccttttgagttgaaatctcagttcatttattttctttttgtcttgcttaatagcaaaagcatttaatattatgtatttccctcaagtatggatcttgctacagctcataagtttttatatgtagtgtttgagttgtcactgttttctagatagtgtttaattccagactttctttcctctttggtctaagagttatttagaagtatttttaaaaaccaaatcaattttttaaatataagcttctattcttaatttatttcaccgaattgtggttttttttgtttgtttgtttttttaagaattaaaattttgatttgggcacagtggctcatgcctgtaatcccaacacttttggaggccaaggcaggaggatctcttgagcccaagagttcaagatgagcctggacaatatagcaagaccccaactctacaaaaaatgaaatgataaataagtgatacatgataaataaatgacaagaaaaatgataaatagggcgcacacctgtagtcccagcttcttgggagtctgagatgggaggatcacttgagcccaagactttgaggctgcagtgaggtatgatttcaccactgcacttcagcctgggtgacagagtgaggctctctttagaaaaaaaaaaaagattttagggccaggtgtggtggcttacgcctgtaatcccagcactttgggaggctgaggtgggaggatcacttgaggtcaggagtccgagaccagcatagccaacaaggtgaaaccctgtctctactaaaaatacaaaaattaggcaggcatggtggtgtgcacctgtaatcccagctactcaggaggctgaggcaggagaattggcttgaacttgggaggcggaggttgcagtgagtcaaggtcacaccattgcacccagcctgggtgacagagagagactccgtctcaaaaaaatttaaaaataaaaaaggattttagggaggcctaatatatgatcagtttttataatggctgttggataaaaaagtatttattgggtagaaaagttggtatgcatttaaaaaaatcatttgtatttgcttccttggtttgttcctgagaagcagtatgaactgagcagagcagggggtgactctgtctactttctagtgcagtatctgataaaaaggggcctctctggtggatacaggcccagaggctctggagcaagaattaagcatcttgtttttttgttgttgttgttttctggccagttatgtaaagtatagtcagtgttttctctgtgctgaatcatgggttgctttttctcaatttttctccatctgccttaacatgattggtgattctacctagatcctggccttagattctgtgttgctcttattattctgacttctgccatccatcattttctctgttctctctggtggtttagtaagtcccagaccggaaactccaggagggtaagagacatgccaacattgttcattattgtgtctccagggcataagtaccctgcctggaatagagtaaataaacatttttttttgcatgaatttcagttgcgagtggctgcctgggtaaaggggagtgctaaccagatttcatttggaacatcattcataattatattccaggtatcttttgtctagcattataacccagttcaccagcaaacttggttccacagttgtagtagtcttttgtcacattgctgataaagatataactgagactaggaaatttacaagagaaagaggtttaatgggctcacagttgcatgtggctggagaggcctcacaatcatggtggaaggggaaaggcacgtctaacgtggtggtaggccagaaaaaagaatgagaaccaagcataaaagatttccctttataaaaccatcagatctcatgagacttattcactaccatgagagcaggttgggggaaacttcccccatgatttaattacctcccactgggtccttcccacaacacgtgggaattatgggagctacaattcaagatgagatttgggaggggacacagccaagccatatcaacaatattcatggttgacattctttaatcactatcctgtgtatgtcagatagcagataagaggaaaatgtgaatgaggctctgaattaagccacatgttcaggatgctgtcccagacttccgctcttgactgtctcatctctttcagcaccaccttctctccttctctgcacaaatcctcagtgagtgttgaatatctcatcaggtctgtttgaggacatcagcagacactccttttggttctggcattccagctcccaaatgggctttccacgtctttcttccaagagcttttctcactgtgttctggctctactcaatgactcacttgctaatctcccatatacctattcacactatgatatcaaaagctcatatcacaacttaatatgtcccagggtattgtcaactgaagaatgatcgggttcatacatttggaaaggggagcttttttaaaatttttaagttccagggtacatgtgcaggtttgttacagaggtaaacatgtgccatggtggtttgctgcacctagcaacccatcacctaggtattaagcccaggatgcattgtcccccagactccaccaacaggccccagtgtgtgttgttcctctccctgtgtccatgtattctcattgttcagctcccacttacaagtgagaacatgtggtatttggttttctgttccagttttagtttgctgaggataacggcttctggcttcatacatgtcactccaaaggacatgatctggttcctttgtattatattccatggtgtatatgtaccacattttctttatccagtctatcattgataggcatttgggttgattggaaagaagaactttatttctcataaatggttgcagccttcccaggccattctgacagcctgggaagtgtagcctctggtcagaagccagaaatactttgagagaaggtcaaaggtaacaagaatttatgctgagtggggtggctaaatgtatgtatttaataagctataggaggagtcataaatatttaccaaaggagaaatgtgtgcatgaacaattcagctttatgcctcttcatgagttgcatgtacaaaaatggcagtgttagcatgatctgagggtggaattttcagctctctgacatcaaaaggtgaaatagaggacatgaaacccctcactgcacatcctccgttgaactattccatggtcagtggtctcttatcaagaaggaatcctgggccaggcatgatggcacacacctataatccaagcactttgggaggtcaaggcaggcagaatggcttgagctcgggagtttgagaccagcctgggcaacatggtgaaaccccatttctacaaaaaaatacaaaaattagccaggtgtggtggtatgcatctatagtggcagctactcaggaggctgagatgggcccattacatgagcctgggaggtcaaggctacagtgagccatgacacatcactgcactccagcctgggcagcagagcaaaatcttgtttcaaaaaaaaaaaaaagaaggaatgctggtcagttgttcatgttgaaaccatcaaagggaggggcagcagtcagacagttggctgaaatagtaggtggagcctattgaaagggctggtttctgtttggcacctagggtagaaagcttaatggcagttagggagggggaggtataaagaggtgtgttcaacctcccatcctgtcatggctggaaactcagtttgaaggttgctctggggtcctctttgccaggtggggtccagtcagtcagttgaggggttttggattttattatttcccagtatgaatattttccagggttttgttttgttttttgtttttgtttttttttttgcattttaataagtctgtatccatcttctcatttattcatttagcaaacatttcttgaacatcactatgaggaaagcgctgtgccagaccccagaccagaccctatgggatgagccaacagttcttgttcccagagaaggcagctctctctcatgctcatagtccacactccccagccagcacggggcatagggacttcatctgaaatctcaaatcccatgtggcaaatatcacagtggctaggagatgacttctttgtgagagattttcctgtttgagtaagagaacaagttaggcttttgaaaccaagtagagctggatcaaactttggtcccagtacttgtcagttgtttgacctaatgaaaggcagggaaccttctgttcctatgagaaggctcaggatacatcacctacccctcagagctcctgtgaagattagactgtgaggccggggacggtggctcacgtctgtaatcccagcactttgggaggctgaggcgggcagatcacttgaggtcaggagtatgagaccagtctggccaacatggtgaaactccatctttacttaaaatacaaaaattatctgggcgtggtgccacgtgcctgtagtcccagctattcaggaggctgaggcaggagaattgcttgaacctggggggcagaggttgcagtgaggcgagatcgcaccactgcacgccagccttggtaacagagtaaaactccatctcaaaaaaaaaagattaagctttgaatagtatgtgagatgccagtgacctgaccgccaagtatattgcgagagtcagtgaattgttagttcttttttataattcgaaaatcaagtattataaggcctgggaaggatgcttatgatattaaattcatattttaaaatgagccttggccgggcgtagtggctcatgcctgtaatcccagcactttgggaggccgaggcgggtgggaggcctaggtgggtggataacctgaggtcaggagtttaagaccagcctggccaacatagtgaaaccctgtctctactaaaaatacaaaacttagccgggcatggtggcatggtggcggacgcctgtaatcccagctactcaggaggctatggcaggagaatcgcttgaactcttggcggaggctgcagactccataaaaaaaaaaaacaaagcctctctgtagaaaggatctaatggcattcttgaacccaaaatatctgagacagatttcaaccattttagaaagtttattttgcgaaggttcaggacacacctgtgacacaggctcaggaggtcctgatgacatgtacccaaggtggacggggtgcagcttacttttatacattttagggagatggagacgtgagacatctatcactatgtgtaagacagacattggttctgtccagtaaggtgggacaactcgaagcggggggttccaggtcacaggtagataagagacagaaggttgaattcttttgagtccttgattaaccttccactgaatacacaatttagtctggctcagtgtgtctgcatttttacaaaaacaatagaggcagaggaaacaatcagatatgaatttgtctcaggtgagcagagggatgactttctgtcctgcacctgtgaagataagctatccgtttacattgtcagggtgaaattcaacagaaccctctgacggaaaagatcttgaggcctgcagggaatttccttgtgggcaaattgcaggggagatatgcacctcttttgtcttttaagctatcttatttaggaataaaataggaagcaggtttgcctgatgtagttcccagcgtgacttttcccttggctttgtgattctggggttattttgttaccggaaaggggtcctgatccagaccccaagagagagttcttggatcttgtgcaagaaagaattcaggacaagtccgtagagtaaagtgaaagcacgtttattaggaaagtaaaggaataaaagaatggctactccatagccagagcagccccgaaggctgctggttgcccatttttatggttatttcttgatgatatgctaaacaaggggtggattattcatgcctcccctttttacaccatatagggtaatttgctgtcattaccatggcatttgtaaactgcagtggtgctggtgggagcatagcggtgaaaatgaccagaggtcactctcgtctccatcttggttttggtgggttttaaccagtgtctttaccacaacttgtttttgatcaacaaagtttttatgacctgtatcttgtgccgacctcttatctcattctgtgacttagagcgccttaactgtctgggaatccagcccagtaggttccagccttattttacccagctccttttcaagatggagttgctctgtttcaaacagctctgacatttttacacattttatccagaacagcaggcatctccagaaggcagggacaccactgcccacccttcctttcctctaccactctttgaagccacgctgtgtttcccagtagggcgctctgttctctccaatccccacactgtcaaagacagccacaagcagagatctgtgtgaggggtcacctgctgccagggctcaggcagcaggcttggccagtccttttccagcattcagcctgtgtatggaaggattctatcctgtgcattagcagaataacatctaattggtctttgtttgctccagaacatagaaagtagagctttttcattgcattaacaactacatcgaaacaggagacttctctcaccccccttgcaggatgtgctgcaggggcatggcttgtctgttcgccacccttaataggacggggagcaagtaaacagtcaggtgcaggagcgggggcgagtgcttttgggctgcagccccacggtagcatctaagatgggtgcctgtggctgccaaagccctattgggcatgttgcatttatacgtttgtactcagatacatttagctcagttgcagtgctcctttagctctgctacctacagatggcttaaatgttaaccagctcagtgccctgttggtgcctgggttcttgcctggtgtccaggaagaatcaggtcacacatggacttgaaggatggtgaatgcaggggttttactgagtgttggaggtggttctcagcaggatggatgggaacgtggaaaggtgatggagtgggaagaggatcttcccctggagtttggctgtccagcggctcacctcctctccaaccgtccccagctgaactcctctccatgttcagacgctccttcttttctctcattctctgctgccctgttcagcgggtcttctgttcgtctgctccgggagctgggggttcggggtttatatgggtacagggtagggggcgtggcgggccaaaaggcaatgtttgggtgtgaaaacaggaatggctgttcccatttagggccacaggtttccaggcttgagggtggggcctttgctggggaaccgccctcttctacccagtattttcctgtctcctgtccatatcaacatgaagtagtacatgggcagaacggatatacaggtagggttggatattgcttaaaaaaaaaacacctttcggcaaattaaatttaacagagtctaattgtgcaaagaacaattcacaaatcagacagcctacagaagaagaataggttcagaatgactctggggctaccacatgggcagataacataacatttatggacagaaaaaggaaagcagaatacagaaaaaaaaagtgacagacagaaacagctgggctgattacagctgggcatttgccttatttgaacctgctttgaacagttggttgcctgtggttggctgagactcagttatttgttacaagagcaggttacagtctgtttacacattaagataagttacagtttactatgtatggagaaaatttcaggctgaggactaagctctaattttttcttgtcttgcccaaatatctaagagacctggggagtcatgccttataaatcatagtctcatcacatgggttttatttaaccctatagatcgtgacttactttccagtctgactctggcataacacaacatgacaaagaagaaagtcaaaatattttatcccaaaacatgtttcttggccatattttgaaatggtcctgcaaagccattcattgtgggggggaaaattgcatctgtaaagaatctctgtttacatagctagatctttttctctaggccctccctatcctgaagagattacctgacagtctagcaccttttaaaggtctgaataaaacattcgtcatctactgtctctaagggcagctgctatgagacttcaaaagaaccttggtctccacaatgttttattttaacatgaacatttcctttctattaaccccaggtctttagacacactcaaccagttgtcaactagaaagtgtttaaattcaccttatagcctggaagcccgcagcttcgaattgtcctgcctttatggaccaaaccaatgtagttctctaatgtatttgagtgatgtctcatgcctccctaaaatatataaagccaagctgtaccccgaccaccttgggcacatgttcttaggaccccctgagggctgtgtcacgggccatggtcactcatatttggctcagaataaatctcttcaagtgttttacagagttcaactctgttcatcaacaaggccaaacttaacacaacaatatgtctatgaaatagacaaggatggcagcattggaccataggagtgggagggaaaagtaagctaccaactgtgagattcttattacctaaataaaatttttggtgaaaaacgataaaaataaatactaaatcaccaccatctcaaaaaacaaaacaaaacactacaagcagggcagtcatttttgtggtcactgcccacctgcaattggtctgtgtgatggaccttttgaaggataagtagatctcacaccatataatggagtttgagaccaaaatataagaagtagtagtgttaccagaaaggggtcctgattcagaccccaagagagggttcttggatctcatgcaagaaagaatttaaggcgagtccatagagtaaagtgaaagcaagtttattaagagagtggaggaataaaataatggctactccctatgcagaacagccctgagggctgctggttgcccatttttatggttatttcttgatgatacgctaaacaagggggtggatcattcatgcctcccctttttaggccatatagagtaacttcttgatgttgccatggcatttgtaaactgtcatggcgctggtgggagtgtagcagtgaggatgaccagaggtcactcccgtcgccattttggttttggtgggttttggccggcttctttactgcaacctatttttatcagcaaggtctttatgacctgtatcttgtgccaacctcttatctcatcctgtgacttagaatgcttaaccatctgagaatgcagcccagtaggtctcagccttattttaccaagcccttattcaagatggagccgctctagttcagatgcctctgacagtaggggaaaggagagacataaaacttcacattcctgaagactttctcatgcttttgattgaaactcaagccattgaagaatatttcagccagagtatgcagcaacccatttttctaggtccagtagttgacaccgtagacttgtcaagggaaagccaaatgcacacatcactgtgaacattggaaatactatctccaggatgttagaaaacacttttaaaaatgacttgaaggaaaagtcggaaggagaacataggaaagggcctttcatttctcttaagcaggagtgttaaagcaattattgacctactgtactttgttctcattaagaaaccaagtacctttttaatgacttctatgggaagtattctaaatacagaagtgataatagaaggatttcttggaagcagaggatagcactctttcatccaaaagaacttagaggagcatttgaagagggattgctgaaggctgtggttttctttcctgtgcacattaattcaatgtcctttttactcagtagggtgtaaacatacatcatttaaattaacataaaaagtcagaaatgagacctccattaacatatccgcaggggaggaatgaggcagtcccacgtgacttcttgctgctgttgcctcccaggagtggggctgccaggcgggtcctcctgctgaccccctcctcctctgccttttcctgtccggttctgcagtgtcactcccagcaggtcggctcatcttggcgctctcggccacagatgtctcgacaggtccgagttacttatgtaattgctatcaacttgctgtgcaaccctctggggcaggacatgatgcctatctttaacctctggatcaattgaaaactggcttaattggctcagtgtccagcagtgccattatttgactcccctgtctggcctcttactcttcaaggatgcagaggtctgggaaggcagagcagacctgcccctactctgcgatggtgggagtgggagctgctctgggctagattcagaggattctccagctactcagccacccagagtcctccctggagcccttgcctggtggggcactgtggggtgcagtgcatgcttctcccctgtagtggagagcctgaaattctggccctttcatcctcttttcaagattattcattcctcaccctcagccattcgttccctccactcagagcctgacacttattaaaatactaaggaagactttattcaagactattgcaatagacgttgactctgttgcaatagaggagagagattggggtcaactctgaatacaacaagacaagtgggatttatagctaagtagcagagtgacagggttgtagctgtgaaccccccaaatttgggacaggtctcagttaatttagaaagtttattttgccagggttgaggactcacacccctaacacagcctcaggaagtgctgacggcatgtgcccaaggtggtcggggcacagcttggttttatacattctagggagacgtgagacatcaatcaatatatgttaaaagtacattggtttggtctgcaaaggtgggacaacttgaaacaaaggcgggaagacttgaagtgggagggagtgtccaggtcccagataggtgagagacaaatggttgctttcttttgagtttctgttgagcctttccaaaggaggcaatcagatatgcatctatctcagtgagcagagagataactttgaatagaatgggaggcaggtttgccgcaagcagtttccaccttgagttttccctttagcttagtgattttgggtacccaagatatattttcctttcacatggctgtaatatgtctgttgctggatccctatggcaagtggatgcactgagacagcagattgcagcagacaaaaaggtttaattgttgggccactgaacaagtagatgggaggaaacctcaaatccatcgcctcaaggaattggtggttaggggttttgagggttctggaatgggctgaagtgtggagattgttgattggtggaagagtgcagggtgaagtcacaggacagggaggggaagcatctctatattctcaggctgatcccattcctctgtgagggtcttaaaactggttgctagaatttggggtctaaaaaacatcttaagtgatccttaaacaaaagccgtaggattctaacatcagagaccttatatatagaaacaatggggttgcaaatcaattcttaaacagtctgagggccctaatatcagagatcctatctgcacatgggcagtgtctagtgctacaggactttcagcaacaaggaagtgggccagagtgcagcctgattaatgcttatgttaccagaaaggggtcccaatccagacctcaagagagggttcttggatctcacgcaagaaacagtccaaggtgagtccatagggtgaagtgaaagcaagtgtattaagaaagtaaaggaatgaaaaaaaggctactccataggcagagcagtggcatgggctgctagactgaatatagttatagttatttcttgatgatatgctaaaccaggggtgaattactcatgagttttctgggaaaggggtaggcaattcccagaactgagggttcctcccctttttagaccacatagggtaacttccgggcattgccatggcatttgtaaactgtcatggagctggtaggagtgtctcttagcatgctaatgcattatagttagcatataatgagcagtgaggacaaccagacgtcactttcattgccatcttggttttggtgggatttggcaggcttctttactgcaacccgttttatcagcaaggtctttgtgacctgtatcttgtgcccatcccttatctcatcctgtgactaggaggcctgacctcctgggaatgcagccagtaggtctcagccttatttcacccagcccctattcaagatggagttgctctgattcgaatgcctctgacacttaattataactatatttctgttccgaacccaacctccaagtcttttcaaccctattgggatggtttcagtgtcagtgggtggaagactactaataagagacattaagcgtgggggattcttgttaaatggacctaacaggattcttgctaaaggcaggccaagggctcagacagcaagggtatggggtgttgaacttgatcaggtatcaaattaggggattttctcaaacctgattttgcaggattcttactaaaactggacttggcatggacagacacagaaggccaagttcaaggcctagtagataagtgggatcagaggagcctaaccaaggattggtcaaggagagcatctttgccaagaacacgctcctggtccccttcccctttgcagctttgatgaacccaacctctcaacaagagtggggttggggaaaggctctcttttgggactcccctgaaacagaaagaagctgtcatactgtccccccatcttccctccctcagcacaacctttagaccacagatatttgctgggaaagtgatcttttcattctttcctgtttcctttgacaaacagaaagggcacgggtttgaatgccagttgataatccttccatgttgctagtctcaggctccccacttggtccgtggacaggatcaagactccaaaaaccttggtgctctggggctgaggagagacagacatgagaagagactgctttctcttttgtctgtttcccttgtctagtcttgttctccccagcatcctcaatacacattagttccagagttacaattgcagctgagttcaaacttgcactgctcagtgcaggacagccaataagtaaagagacaaggtgttggggcaaggaagacaaatttattttggagatccagcaaactgagaagatggtggactagcattctaaagaaccatcttaatacgaacttaagttaatatgagccttaagttaatagggctccttttatgctaggggaaaggggaagagaaaaggggttgagatcaagaggtgaccaatggccacagacatctaggtggcagcaagggtacaaggatgttgtgaaaattctttttccttggtcagatcacaatgctcctataaatgtttcacataacatgcttacttgtgggtataccctccttatctcctcaggggctaattttgggaagggactactgtccttactttaaagttaaatataaactaaattccttccctagttagctcagcctacgtgcagagataagcaaaagtagttaacctaaaagatatcaccctttggggggtgtcagaggcaaaatagagtcagtcatgctaagctcccctccactgttacacaacataatttaaagaagaaaagctttatgataactttattcaacctacttaagcatcactctcttgagcaagacgttgccaaatgtaattttctacatgcgtgtttctatagactttgatctctccaggataactgcatgggaagccacagaagaatgtggcggaagcttccctcccagcccgatctcctcctactgtgtccaaacctttggcccctctgaaagttgattgaaaaatcaactcacaagaggcagattcatggaaaaggcatacagatttatttaacatgtatacatgggagccttcagagtggagagccaatccaccaacgaggttccgaagcttatatactgtcttgaggttatagaaaggatgcatggccaaaaacaggttatggtggtaagtcagcttttattggaaggacagtttatggtggcgggagaaagaaagaggcttggctagcaaaggtggccttgttatgtagatgaagtctcacatggtagcagccctcagagagaatggatgttaaatatctcttttcagacttttaaaggtgtcagactctcaatctctcctggatctaggaaaggtctagaaagggaaggcctggctgcatgaatggagattctttacagatgcaaatttccgccacaaaagatagctttgcaaggccacttctgtcagctgaccctgcagtggccgtttcaaaatacatcaaagtcacgtactttggggaaatattttgattttgcaaatcaaaaataaaagtcctcctgctgactaaatggaccaccctcttggccaagggtatcccaaggaaacctgaaaaactagttcagaccatgactggaagttgaggggtcagatatgcctcattgtaccctctcccttggagtgtagatacaaatgaccagcattggtgttaaaatagagatcataagactgacaaaacagactctttgtagcaataaggtaccaacttccaacttcactctggtatagtatcacatgacagagagcagacctggaaagaaatcaaagtgttttacccaaaaatgtatttctctgacatattttgaaatgtctctgcaaagctgtttcttgtgggggaaatttgcattctgtagagaattcccttcccttcctaggtctttcctggagagtctgacactttttgtggtccaaagagagatatttaccatctattctctctgatgcctgctacctggaggcttcatctacataacaagagctttggcttccacagtcctcatcttgactcaagcatttctttatgctgacttgaaactccgcagacaaaatttagctcttttaacagattgccaatcaagaaatctacgaatccatctacaacctggaaacacccgttttgagatgtcccacctttctgggatgaatcaatgtataccttccatacagtgatttatgtttttgcctgtaacttatctctccctaaaatgcataaaaccatgtgcccaaggtggctgtaacccctccaccttgggcacatgtgctcaagacctcctgaggctgtcacgggccatggcccttaacctgggcaaaacaaacctctaaactgattaagacatgtcttgggtaatttttgatttacgattttcttcatggcctctgacattggtgggaatgaagttcctaaatagcttcttttatctcaaggttgcttagtagaagcactgacccctgctttgtcttttccctaagtctagttcctctttcaagttatgcctgggaacatttcttggagacacagcagtcgtagctctgggatatctacaaaggaggaacctagggacagctctctggttggaaggaagtgaggccaggccacatgtctctgtttcattttcatgcaatgtataccatgttatagatcaatagattcagctgtgttttccaaatatggttttatgcccatcaggctcacaggagatggagtaaatatcagttgtctgtactaccgaaacatgactatttaaaaacaattgggctacttcaggggagtggggcaaagtcatgcctgggagattgtggtcttcaagggacaattgcaaaagcaaggagtcttatttttcaaagttaggaacatctcactttctgtgacatgtgttcttaccaaaaaaaaaaaatgacatttggagtaatttctgcatgtgaatcctgcttatctgaccccttcctcatggcaggactttggctgctgagctaccagcttcgtcccagaaggaaggtttgggactctgagggcctgagacttatgcatggagttctgctctagacaacagggaacatggaaaggcaaaaaaaaacaaacaaaaaaaccctcaaaatctgcagggaaacctgaatttcaaatccaggaaaactgtccatggatgacagctgtggtggggatcaaggggtctcagagccaaggtgtattggctagtgtctccatagactgccaaaattacacgggcatcctgggtgagaacctctacaccagccaggccttgcacctggattttatgaatgcatgtgggaaagactatggtatggtctagggcattcttttctcgttattttaatttcttaaattttagagacagggtcttgctctgtcacccaggctggagtgcaaaggcgtgactgtacctcactgcagcctcaaactcctgggctcaagtcatcctcctgccgcagtctatagtgtagttgggactgcagatgctcaccaccacacctggctagtttttaaaattttcttgtagagatagagtctcactttattgcccaggctggtctccagctccttgcctgaagcaatcctcctgtatcatcctcccaaagtgctgggattacaggtaggagccatcacacccagtcttttctagggcattcttcatatgatagatgagattgcccaaaatcccactggcccaaactcctcccatctttttattttattttatttattattttttttaattggagacagagtctcattctgttgcccaggctggagtgcagtggtgccacctcggatcactgcagcctccatctcccaggttcaagtgattgtcctgcctcagcctcctgagcagctgggattatggatgcccaccaccatgcctggctaatttttttgtttttagtagagccatagtttcaccatgttagccaggatgatctcaaactcctgacctcaggtgatcctgctacctaggcctcccaaagtgctgggattacaggtgtgagccactgtgcccggccctaggctcctcccatcttgacctgggtgtttgcgatggtgtctggtgctacacggtgcattttaggttctccatctgggactgcttttgttctttcattccttcttcttgtagagtataatgcattcattcattcatctatttgctcaataaaaaatttgttaaactcttattatttgttgagttcagggtcatgatcataaatcccaacagaagctcttgcctctggaaggagctcagagattggtgggggacagaaacgtttatcacatccttaaactgatgagctcacaatgacaaagtgacatgcgtgctctgatggtagagagcacggtgttgggagaaggtggttggagtggagatatggtgtatataggagtccggtaagtgaaggcacagcagaggagggaaggtgttctggcttcaggaaagggtggggtatgtgaaggttctaaggtggaaggccaatgactgcaaggaagtcattgttgctgaagagaagggataggtaatggtgtaaaagaaagttctggagtcccaaagatctgagttcaaatgatggctctgctgtgtcaccgtgtgcaagttatttaaactttataaccctcaaattcctcatttgtgaattaacagtattcctgtggcctaggactggtcacggaaaaaccttcgacacattaaattacacagagtttaactgagcaaagaacgatttacaaaccgggcaacccctgaaccagaataggttcagagagactctgtcgcagctgcattgtggaagtagatttgtggacagaaaaaggaaaataacacacagaaaatggaagtgaggtatagaaacagcgtgattgggtacaaacgaagattgcttagcgcttgccttatttgaacatggttggaacacttgaccactgttgattggccaaaactcggtgactggcagaagagtaggtgaccatctgtttatacatccagttctgttacagctcactatggacagagaaaccttcagggtgaatttaaaatatgtaaggaggtagctttaggctaaacttaattgaataggatttagtaattccctcattctttgaagactgacatcagggaccagaggaaaatatgactttttcacacaattagagatattgttcactggattaaaatgttggtctcaagatatatagtacccttacatttaagattgtagtccaggccaggtgcagtggctcacgcctataatcccaacactttgggaggctgaggcggacggataacctgaggtcaggagttcaagaccagcctagccaacatggtgaaaccctgtctctactaaaaataaaaaacgtagccgtgcatggtggcagatgtccataatcccagctactcaggtggctgaggcatgagaatcacttgaacctgggaggcagaggctgcagtgagccaagatcacaccactgcactgcagcctagaagacagagcgagactccctctcaaaaaacaacaacaacaataaaagcaaacataaggttgtagtccagttagaaattaacagcaatgatacattataaaaggtaagagacacaatgtgtcttaaatacatatttaagttttggaggatgtttggttggtgggttggttcctggtatctcctgtggtacagaggagaaacagcagaagccaacttgaacggagcacttgaaatcgacaggtccttggcttcggtcatgcctcttcccagtgcttcctgtgtaaaggatgtttaggtctttccattactcatacacagacccagattcagaaaggaaaaactctttgtaaactgctcacttttagaaatgaaaagattgatccaagtggaaggagggagacgatgtgatataaaaactgcaacctaggcagggatttaaaatgaatcagaaaacgaacagaccagagaacgtgcttaattcaaagacacccaggggaccctcaagttctaaaaacaagtgactaggaatcaaagtcagctgtttgatttttgtattttagagagtgagggtgggtgttttgcatatgaataatattttgaatgctattggatttttttaatacagtgggatcattgcttttccctatgtccttttttaaaaactctttttcatgcaaattcattaaatttgagatgcagtaatatactggaatcttgcccatctgattccccaaaccacagttaatccttggcacattttgaaaagtatacatgtagttttaaaatggaattatgtgtgacccaaatgtgacggcagccctgtggacatcctttcttcttagcctgcattcttctaaaagtagagctcagcattttttttcctcttttttctgtttttgttttttttcttttccccagtgtctcactctattgtccaggctggagtgcagcaatgtgatcttggctgactgcaacttcaggctccaggctcaagtgattctctcatctcagcctcccaagtagctgggactacagacaggtgccaccatatccagctaatttttgtacttgtcgtagagaaagggtttccccatgttgcccaggctggtctccgaactgctggactcaggggatccgcctacttcagcctcccaaagtgctgagattacaggcaggagccactggacctggctgagctcagcattttttttttccaaaaaaaaaaaaaaacaaaaaaaaccaaaaaccatatttggctctacaaagcatattttgtgtaaaatagattctataggcaattaatgcaagagatcctagggaaggctgtgtcacaagccactgtaaaacttaacaaaattgcaatcacagacctaattctaccttccaaagtcctcatgggccactggttatcccctcctcctccttgtcctagatccttctcttctcctttttttatgctaagcaggttatctcttagctttttcagtctgaattctcaagctcagaatctcttttagcaaacaagagccttccagcaatccatcctttgcagttgaggattataaacaaccaagaccatttttttcccatcagagatatttgtttttcagtttgcatgtgtgtattggctgaatcctaatatttgcatttcatgattgtgttctgaactgggagaaaaataacccaaatttccctaagcaggtacattatcctgtctgccctcagaaagcctaatctgtgtctcatttttttttttttaatgtaggttgttatcttactcattttgggctgctgtaacaaaataacatataccgggtggcttataaacaacaaaaatttatttcccacagttctggaggctgggaagtccaacatcaaggtgctggcagattcagcatctggcaagggcccatttcccggttaatacatggccccttctccctgtatcatcacatagtggaaagagacaagagagctctctagggtcccttttctaaggcatggatcccactcatgagaactccatcctcatgacctcatcacttcccgaaggctccacctcctaaaaccattgagagaataacattggaggttagggtttcaacatgagagtttggaggggacacaaacatttagctcataatggttattgtggaagatgtttactgaacttctgaagcaaatgacaaagctagcttaatgagacattaaaagttatttagggctgggcgcggtggctcatgcctgtaatcctggcactttgggagaccaaggcaggctgatcaaatggtcaagaggtcaagaccatactggccaacatggtgaaaccccgtgtctactaaaataaaaaaattagctgggtgtgatggcgtgcgcctgtaatcccagctagtcgggaggcagaggcaggagaattgctggaacccaggaggcagaggtttcagtgagccgagatcgtgtcactgccctccagcctggggacagagtgagactttgtctcaaaaactaaactaaactaaactaaactaaaataaataaaaattaaaaagtcatttagtctggatatcatattataacagtgttgcacaatggaccctcagtccaaataatccttcttaaatgtaggaccttgtgacctttgttgaccaaaacaaaaacgaaaaccaaccccacaaagcccaaactgtgaagtcttgaaagaggtttcttctgagccaatatgagtgaccataacctggggaatgagaggtcccaagaaagtgtgcccaaggttgtcaggttacaggttggctttatacaatttatgagacaagaattgtaggtaaaatcatgaatcagtacatggaaagtatacattggctcagcgtaaagaggcaggatatcttgaagtgtgagggagttggggctggtatgaggccattggtgaattcaaagattttctgattgtcagttggttaaaagagttaagctttgtctaaagacttgaagtcagtagaaagaaatgcttgagttaagaaaaggggagctgtggagaccaaagttcttgttatgtagatgaagcctccaggtggcaggcttcagagagaatagatgttaaatatctcttttcggaccttaatttagtgtcagactcttagctaatcccttctagacctggtaaaggcctggttggtttaatagagattctctgcagatacacattttcctcagaaaagacagctttgcaaagccatttcaaaataagtcaaagcaatatattttggggtaaaacatttggatttccttcagggtctggcatgtgacactataccagagtcaggttgcaatttggtatcttactgccacagtgagtctgttttctcagtcttatgatctctattttaatgttaatgctggtcagttgtgcctaaactccaaaaggggtggggcataatgaggcttgtccatcctttcttctcttcatggccaggaatccaatgtttcaggtttctctggggtccttttggcccagaggggcttcattcagtcagtggggtggcctaggcttttatttttgccttacactttggacaagtctcctaacctgtcagggactcaattttataatctgtaaaatggggacaaatatcagtgcttattgttaccagaaaaagttcacgatccagatcccaagagagggttcttggatctcacaaaagaaagaattcggtgcaagtccaaggagtaaagtaaaagcaagtttattcagaaagtaaaggaataaagaatggctactccataggcagagtagcagtttgggctgctggactaaggatacttatagttatttcttgattatatgctaaacaaggtgtggattacttatgagttttccaggaaaggggtgggcaattcctggaactgagggtttctcctctctttagccatatagggtaacttctggatattgccatggcattcgtaaactgtcatggtgctggtgggcatgtctttagcatgctaatgcattatatttagcatataatgagctgtgaggatgaccagacgtcacttttgccaccatcttggttttcatggatttgggcaaggcttctttaccgcagcctgttttatcagcaaaattttttttgacctgtatcttgtgctcacctcccatctcatcctgtgactaagaatgcctcacttcctggcaatgcagcccaataggtctcagccttattttacccagcccctattcaagatggagttgctctggtttggacgcccctgacattgtgtcacaggcttgttgtgagcatgaatgagttactatcagtaaagtctaacatccagaaaggtaaaattatgcctcaatataaaatgaaaatgaggaacatattttattcaacttattaattcatgggagaatcaataaggtgttaagtccagttcaaatgagaatttaacttacagaggtgtatattctccaccagaaaaaaaatcattacaagagtcatttgcggtgctgttagtttcctacaactttgcagctatccctacagcaatgggctgaaaaatgccttccacccaagatacccacattccaatcctagaacctgtgaatgttacttcatgtggcaaaaatacgactttacagttgtgattcattcactccacaacagtctccagatggggagattatactggattttccaggtggccctagaaggagagaggcagaggaagatttgacccagacaggagattagaaggtggtgtgaccacagagacagagactgaagggatgcagccgcaagccaaggaatgccggcagccaccagatgctggaagaggcaatgaatggcctctcccctggagcattcagagggaacatgatcctgctgacaccttgattttgttccccagtgaaactgatttcagacttcttgcctccagaatgtgagagaatcaatttctgttgctttaagccagtggtccccaaccatgttggcaccagggactggcttcatggaagatagtttttccacagaccaagggtgaggatgatttcgggatgattcaagcacattccattgattgtacactttgtttttattattattacattgtaatatataatgaaagaattatacaactcaccataatgtagaatcagggggagccctgagcttgttttcctgcaactaaacggtcccttctgggggtgatgggagacagtaacagatcatcaggcattagattctcataaggagcgtgcaacctagatccctcgcatgcacagttcacaatagggtttctgcgtccataagaatctaatgccgctgctgatctgacagcaggtggagctcaatcagtaatgggagtggtggggagcagctgtaaatgcagatgaagcttcgctggctcgcccaccactcacctcctgctatgtggccaggttcctaacaggctgcagaccagtacctgtctgcggccctggggttggggtcccctgctttaagccacctagtttgtagtcatttcttacagttgccacaggaaattgcctacaaagtcgcaaagagctttctcaacagaaagttaatcaaagatgcatactctatagaaacaggtatccccagtgagtctgctagatgatactcagcacctcacttaaaagacacccaggaatctcctacccattcctaagtttggacagtttttcctgacaattttagtctacaaaatgcttggaatatatataaagtaattcatagaaagtaagcattactatataaattttagtgatactactactcctcctactaattataataattatcatcatcatcatcatcaaccaccatcattattctcttttatcttcttggcttgttcttttcacttgatgggttgttttgagtgggaaccatgattctcttgactgacaggcttccagacccagtggaagagaataacgggattatgagtgggaactccttgggaacacccaggagttcaaggctgcagtgaaccatgattgtgccacagaggttggtgttttcactgttagctgtgagagtgcgaaggcacaagatgttagcagtggaagaccaaggtgtcagtgataggcttggggttaccctgcccttccagctggatatcttgagctgctgtggagatgcaaacagcataaaggacaattgaatggaaagatgtgtggttttcagtgaacgaatatcccggagagcgtgatgagggtgaaaaaatacttactcacaaatcccctgaacaggggaagcaaaggtggtattgccaagtgaaaatattttgtttaaaaaaaaaaaaaaagagtgaagtgaagaaaacctataggttgactaattgttgaaggtatggagtgtggcattcagcagcattttaagttaatctaggccagtggttttcaagggggtaggtggattttgtcatccaggggatatgtggcaagtctggagacatttttggtcatcgcagcggggagtgctattgatgtctagttggtagagagcaggactgccactaaagatcttaacaatgcacagggcagtttcttacaacaaagaattatctggccccaggtgtcactaatgctgaggccaggaaactcagctttagggtgagaattccagactcacagaatcagagtcctgtaagggaccttagcaagtgtgaggttctgtgattttcaaaggacatctttcagatcccacagggtagggggaggcgccaggagcccagggaccagagaggcagtggagggtgtggagggtggatctcgtggtgttaccacatcaccggcatctctctcctctgcaatgggtgttggtgcaaggatgagtatttctgctgacagaaatatataaagtaactattcatagtaagcattactatgtaagttttagtgatactactactactaataattaattatcatcatcatcattatcatcaatcaccatcatcattcccttttatgtacttggctggttctcttaacttggtgggttgtgttgagtgggaaccaatgattatcttgactgacaggcttccctgcccagtggaagagaataatgggattatgagtgggaactcctcagaacatccaggagttcaaggcagtgagccatgattgtgccacggaggttggtgttttcaccgttagctgtgagagtgcaaaggcataagatgttagcagtggaagaccaaggtgtcactgatcgtttcgaggttaccctacccctccagctggctgtcttcagcagttgaggagacgcaaactgcacagaggacaatgaaatggaaaaatgtgtggttttcaatgagcaaatatcatggagggcagtacctagagccgggcatagtgactggcacctacagtctcagctactcaagaggattgctggagcccagacgttcgaggctgcagtgagctatgatcgcatcactgcactccggcctgggcaacaggccaagatcctgtatctaaaaaaacaaaaaaaaaggttgaaaataactagtgtgtttttattttgtgttgaggaataaaaaattaacagatgtggtcactaatagtaccgggaatcctggctgcctctggtgcctaagcccacccttcccaatgtctattcagaccttgttagaaaaacctatggggtttccaaccccatttctgcaaatcttgccgacatgcgacatgagctggtttaatttctgaccataaaaacacattaaacaggatacaataaaaagagtcctttctttgttaagaatcttattgatacaatttactaaggcatttaccgtgtctaccctgtacatggctgtgaacatttagagggtgtaggatttagggctaaaattatcccatctccgatatatattctggacactggagttttagataaatccgtaacttatgtttacgtctcttctaaacatagatggtgggaactggaaccagcgtgcttgtagctgggggagaaaaataaaggcacactggctgtgggaacatttatccttcctggtggctatggcaaacctgtgatcctatgatcactctccttatgtttggaggagtttccaccctctgagccccacctttgtttgttttgggttttttgttctgagacagtgtctcactctgttacccgagctagagtgcagtgtggcatgatcatggctcactgcagcctggaactcacaggctcaagcaatcctcccccctcagcctcccaagtagctggaaccataggcgtgccccaccatgcccggctaatttttgaatttttctatagcaatggggtctccctatggttgcccaagctggtctcaaactcctgggctcaacctatcctcccacctcaacctcccaaagtgctgggttatcaggggtgagccaccgcacccagcctgagtcctgcctttccaagatcaaagtaaaaaccagcttcactgcctcccttgtagctagaccatgtcctgggagccaggcttctccagtcagacccacaggaagggtggcttcacagacaaaggtctgtgaagataggggtaggaggaggatgaaaatgtatcatgcaaaacccatcctgatgacaagaaggagagacatttaactttgaaaggcaaaaattgtaccagtgttaatggcggcatctcatttcctgtgtggacaaagtggcagctggatttaggaaccctcttttgataaatcccttttctctgaaactagctcaatttggttctggagaccataagtaaaatcactgcctgatacagcaggagaaatgttactgtggaaatatctcagagaccaaatcacttggcacttcgcagttttgtgaaatactaactgtcaccatcagacaaaccttcactgctcccacctcctcagcattgcctgccctaattaggtgggttttggaagaactcactagcaaccataacctttaaatagaccagaaattgtcttttacagtggattcagaatcagtagctttataagaagggctttgctcagttcatgatgactctatgcatgattgactccatctctgtacctgaattacaaaaaaaaaaaatgtggcaagtaaagaaaaggcaaaatgttatttttttccccactcagttttgcactggggctcagcacgtatggtttcaggtaggctctgccttaacatattcctggaataagcttcagaaaagaggctgtgacaggtggagacagcttccttgattatagctcagcatggttcaaaggacactctggtagttaattgattcaggcaagataatttgtgggcaataaacagcacagaccttttattttcaactggtcagttagaacgaagtttctctaattcagtcttagagaatgactttttttttttcctgtgctggaactcattcatttgcatatagaaagatgtttaaacctctgtagaaatgcccagagattgtaaaatctaacattatgtttgcaaagatggcatcaagctccttcctcctcagacataagaaaattgcatttgaacaggccgggtcttgaaaaccagctgatggtgtctgagtcaaagatggagctgatattctcaggcaatgggtccactttggggccactccagctgtttttctaggaaatcttccaaagcaaacaccacagtggtgctattcctgtgaaatggtggcacgtcttcttctgtgatcatggccagagacaacttctttctttgaaatacatgcaaaaggttttgctcagcctctggagtaaaccccatctcaacagagcagctctatcctttgagaatatgattttgacatctgatggactcccaatatttgatgcttgttttcaaggccacactaaccccagttgggctgagattaaaatgaggtccatagtaacagtcacgggtccacagctcttggagaccccctctttttttggagtcttttttttttttttttttttttttttttgagacagaggctctctctgtcactcaggctggagtgcaatggtgcaatctcagctcacttcaacttctgcctcctgggttcaagcgattctcctgtctcagcctcccgagtaactgtgattataggtgtgccccaccacacctggctaatgccctctgcggactcttgcacagtcctggccatgcctctcctgggcagggtctctgcagtcagtcctcttgtccaccagcttcatgctttccattttcctctcctactcatacgtggcatcctctgcaatgcctcgaacagccagtgcagtgcatggtgacttggtgacacattactgaccagagacactactgagctctgtcgctcatgtcacccaggctggagtgcaatggcacgatcttggctcactgcaacctctgccttccaggttcaagcgattcacctgcctcagcctcccgagtagctgggattacaggcatgtaccaccacacccagcaaatttttatatttttaatagagaaagggtttcaacatgttggccgggctggtctcgaactcctggcctcaagtgatccacccacctgggcctcccaaagcactgggattacaggcatgagccaccatgcccagctaaagccactgatttctgaagtcaaggatgttgtctttcatcattgccaaagtggctggtgccaaccccatggaggccttgtgctttcaaacctactagagattttcttgaatgagccctttcatgacagcccaggcaacacagagctacagagggagggaacctctgccaccagcctgtgaccataataagacaaacagaccacatcctgcactggctggcacctctcttctctaagtctggtccctggctttgccccaaactggtgcatttttcccaggaggcagcttggaatcccttacaaaaggccatttgacaagtcctctggaaagactgaccttagatgaaagctgggtgtgggccgggcacagtggctcacgcctgtaatcccagtactttgggaggctgaggcaggcagatcacttgaggtcaggaattcgagaccagcctggccaacatggtgaaacctcatctctagtcaaaaaaatacaaaaattagtcaggggtggtgggtgcacatgtgtaatcccaactactggggaggctgaggcaggagaatcgcttgaacccgggaggcagagctgcagtgagcggagatcgcaccactgcactccagcctgggcgacagagcgagacactgtctcaaaaaaaagaaaaaggctgcatgtggtgggtggcctggccatatgtgtgctgggcctggctgaactacacttcccagaattctcttccttgtgtgttttccagtagagtggactgcaagagggatacctatgggagatgtggaaggtgcagggggaaacagcagccgctttgtagctcacccacattactgctcatctgctgcctccacttgttggctgggcctgctgcaactccacctgcccctggagcccctccaggttctcccacagctggactttgtgtggctgttggctccaccgtgaagggccctggcttctgcctgacacgaaacccaaggtcagaggcaataaggcacttcgacaagtttcattcgtactcctgggctccagcttaagtttgtgggtttcagcttgttcttgcttgcttaggttatagccgtcatttccccttcctggctgtcttccctgtggactgcagctgccagcatcagaaggaaaggaaagaaggaaagacaaagtcagttctagagactgcttaaccagctcccacagttgcatgaggtcaaatccttgcaaaaagtcataaaagtgatatatatgtgcattgatgtataggtatacatatatgtatatgtgtgtgtgtgtgtgtgtgtgtgtgtgtgtgtatgtatggtcatgcattgcataatgacaaggatacatttttttttttttttttgagacggagtctcgctctgtcacccggtctggagtgcagtggtgcgatctcggctcactgcaacctctgcctcccgggttcaagtgattctcctgcctcagcctccagagtagctgggattacaggcacctgccaccacgccaggtgattttttgtatttttagtagacacagggttttgccatgttggccaggctggcctccaacgcctgacctcatgtgatctgcctgcctcggcctcacaaagtactgggattacaggtgtgagccactgcacctgccgacagggatacattcaaagaaatgcatcattaggcaatttcatcattgagcaaacattatagagtgcacttatacaaccctaagtggcctagcctattacactcctagcctgtatggtaaagcgtgttgctcctagaacaagaacctgtagagcacgttgctgtactgaatactgtaggcaattgtaacacaatgctaagtatttgtgtacctaagcatacctaaacatagacagggtacagtgaaaacatggtataaagcagcagcccccaatctttttagcactaggggccggttttgtgaaagtcagtttttccagggctgcagggaagggtggggaggtgtcaggatgaaactgttccaccttagatcatgaggcattacttagattatcagaaggagcatgcaccctagatcctgcacatgcgtagttcacaagagtgttcatgctcctatgagaatctaatgtcactgctgatctgacaggaggcagagctcggtgggtaaggcgagtgatggggagtggctgtaaatacagatgaagctttgctcgcctgcgggccgctcacctcctgctgtgcagcctggttcctgaaaggtcacagatcagtactggtccaaggcctgggggattggggacctctggtataaaagactaatcatgcacctgtctaaggcacttaccatgaatggagctcacagcactgaaagttgctctgggtgagtcagtgagtgagtggtgagaaaatgagtggttcatgcctgtaatcccagcactttgggaggccaaggcaggcggatcacctgaggtcaggagttcaagaccagcctgggcagcgtggccaaactctgtctctattaaaaataaaaaatcagcctggcgtggtggcaggtgcctgtaatcccagctactctggaggctgaggcaggagaattgcttgaacccgggaggtggaggttgcagtgagctgagattgtaccactgcactccagcctgggcaacagagtgagactccttccaaaaataaaaaaggaaagaaagaaaatgtgaaggcctagaacattactgcacactactggaggtagactttgtaaacactgtatggttaggctacgctattttttttgagacattgtctcactctgtcacccaggctagagtgcagtggcattatctgctcactgcaacctccacctcctgggttcaagcaattcttatactaatttattctttttaaaatcccttcttcagtgacaaattaacctttgcttactgtaactttgtaactttataaaggttctaattttttgtaaatttttggacactctgacaataatcacttagcttaaaacacattgtacagctgtacaaaaatattttctttctttatagctttaatctataaactttttccaactaatttttttttctctttactccctaaaaacgaagacacgaacacacacattagcctaggcctacacagggtcaggatcgtcaatatcaccatcttccaccttcttgtcttgtcccactggtaggtcttcaggggcaataacacacgcatggagctgtcatctcctatgataacaatgtatttttcttgaatccctcctgaaggacttgcctgaggctgttttacagttactttttgtataaatagaaggaacacactctaaaataatgatgaaagtatagtgtagtaaatacagaaaccattaggtcttttactatgattgtcaagtattatataccgggccagatgcggtggctcatgcctataatcccaacactttgggagactgaggcgggcggatcacttgaggtcaggagttcaagaccagcctgggcaacatggcgaaacctcgtctctactaaaaatgcaaaaattagctgggtgtggtggcatgcacctgtaatcccagctactcgggtggctgaggcaggagaatggcttgaactcaggaggcagaggctgcagtgagatgagatcgtactactgcactccagtctgggtgacagagtgagactctgcctcaaaaaaaactagtatgtattggacataattgtatgtgtgatacttttatgactggctgatgagtagcatcaccagcattgccacaaacatgtgagtaatgcattgtgctatgatgttatggcagctacgacatcattaggtgataggcattcttcagctacattataatcctgtgggcccactgtcctacatgcaatctgtcattaacccaaacttcattatgtggtgcatgactgcatatataggtttcctattggttttatttctcaggttgaacccagactgatacactgggaacccagcatcaggattttttttttttttttttttgacagagtcttactcttgttgctcaggctggagtgcaatggtgcaatctcggctcactgcaacctccacctcctgggttcaagcagttctcctacctcaacctcccaagtagctgggattacaggcatgggccaccacacctggcttttttttttttttttttttttttttagtagaggcaaggtttcaccatgttggtcaagctggtcttgaactcttgacctcaggtgatccacccacttcagcttcccaaagtgctgggattacaggtgtgagccaccatgcccagccaggatttttttttttaagacaggatcttgctctgttgctcaggctggagtgcagtggcaccatcatagctcactgcagcttcaacctcctgggctcaagcgatcctcctgcctcagcctcccaaatagctggaactacaggcatgcaacaccatgcccagctaatttttgcagagatggggttttgctgtgttgcccaggctggtcttgaactcttgggctcaagcaatcatcccgccttggcgtcccaaagtgctgggattacaggtgtgagccaccacacttggcattgtcaggcatttttgttcttctagtcttaggtcttacttggcctgtgctttcgattctatcccaggagtgccagtcctagcttctgactgcccatcctggctcagagttcattctttagaaagtgtctcatggcaggtccttgacctgtggtgccatcactgagagatcacctggccacctttcacccagacactcccacagcttagtgcagatggttttgaggatatccactgtatctattccaattttctgctcaagaaatacctcttattctacacagttaaggagcaagacagctaagacatggtttatggccttgtcattcgccatcattgtagcgccctcagacctcctgtgggttctgacatttaaaaaattcagttgtaatccatcctctgaaatccatcagtctgaaaaggctggatgaatattttctttgtcaaccagaaattgtgtaagctatatagtcagatacaaggaggcagtgcccttttcttaaggaattcataatctaattgttacgtttctctgattggagcaaaatggtgttttactgacccagattttatgttattcaaacaaataaagctccagctaccaatttcaaaagagccactggacttaatgggcatttaatatatttcctcggccaggcacagtggctcatgcctataatcccagcactttgggagactggggcagggcggattacttgaggtcaggagttcaagaccaacctgggcaacatggcaaaatcccatttctactaaaaatgcaaaaatttgccgggcgtggtggcacatgcctgtaatcccagctacttgggaggctgatgaggcaggagaatcacttgaacctgggaggtggagtttgcagtgagctgtgatcacaccactgcactcccagcctgagtgacagggcaagagcctgtctgaaaataataataataataataataataataataataataataataataataataatagtaaataatatatttcctccctggtcttgacttcatttgcagtgacagattctcatgacttcctggattgttgagactttcccatgtgaaccatagttcattgcttctcacaacagcagacagctcttggtgctccacagtgctgtaggggcgctgtgacacatgccgaagagcctctctcttctggaccaaggtactcaggccaggcatgatggttcacacctacaatcaaaaggcaggcggattgcttgagcccagcagttcaagaccagcctgggcaacatagtgagatcccatctctacaataagtcaattaaaaaaaaaaaagccaagcatggtgatatgtgcctgtaagtccacctactcaggaggctgaggtgggaggattcccgaagcccaggaggtcgaggctgcagtgagctgtaatggtgccattgcacttcaacctgggcaacagggtaagaccctgtccaaaaaaaaaaaacaaaaaaaaacgcacttcttgctcctgctggtggattgttgcctgttgacagctcacagccaagttcctccctaagtattgagatgactgcagggtgctgccctgcctgggatgatgcacttcccaattatgtccctcctcccttgacttttcagtgtgggacacgaagcttcagcaaccctgcctgattcaggacatctctgcagggcagctgtgcgtcagagctccccgaggaactggctgaggcatctgttggaattgcatcatttttcagtgtctcctctgatcagtctgcttccctcactccctgtacccaaatctccatttcagagcttgctgccagggatggggcctatgacaagtgtctccatgagggtagtgatgtttctcctcctttgttatttcccagggttttgctaagttgtctggaggaggaaaaacatgggtttgttcttaatccttcctcggcttacttgatatagaatggagaagaccaggagcaactggaagctggaaacaagagcagatgagtcagaagtttggagacaggcaccaaaaagtccatccagcgtccagggaatagttgagagttaaacaccaagaagagtcaagccaagcctggatgagtcaggtcatgcctataatccctgcactttgggaggccatggtgggaagattgcatgaacccaggagtttgagaccagtgtgggcaacatagtgagaccccatctctataaaagaattaaaaataaaaattagctgggtgtggtagtgcatacctgcagtctcagctactcaggaggctgagacgggaagcagaatattacagaattatagtagtattaaaaataatggcaaaacccacagttacttttgcaccaacctaatagtagtgataacagggtcaggaagtgagagaagccagaaccatatgacatcctggtccaggtactggcctagttgtgaaattgccccacatataggtggccagccatcaagatcccagttttggagccgggcatggtagctcacacctataattccagtgattcaggaggctggggcaggaggatcacttgaggccaggagtttgagaccagcctagacaacatagcaagagaccctgtctgtataacaagtttaaaaattaactgggcgtggtggtgcatgatggtagtcccagctactcgggagaccaaggcggaaggatcgcttgagtccagattccaagctgcagtgagctatgattttgtcactacactccagcctgggcaacagagcaagaccctatctcttaaaaaaaaaaaaaaaaaaaacagccaaggtaagaggcaagccttagacagtgcgcccaagaaccaatgagataaggagcccagggatagacttggtggagattatgggatgtctgggcaggcaagctaatgagggctcatagcagagagcaaggcccagcatcccatctgcctggagtacagcgtagtccttccagtctttgctgtggggaattgtcaaggaacttcctggacaaaaatcaccttctgcacagtgagcagaatgggaccccgttgctcattagaaacacaacctggagtggagtttcttaaatgggaatggcatcaggattgtctggagggcttctaacacaatcccagctccacccccagatattcccactgggcaagccaggacttgcccttcttttttttttttttttttttttggagacagagttttactgtattgcccaagctggagtgcagtggcaggatcttggctcactgcaacctctgcctcctaggttcaagcaattctcttgcctcagcctgtgagtagcttgggactacaggcgagcaccaccacaccccgctaatttttttgtatttttagtagagacggggtttcactatgttggccaggctggtctcgaattcctggcctcaagtgatccacctgcctcaacctcccaaagtgctgggattacaggcatgagccaccgcgcccagccaggtttccttttttttttttttttttttttttgagacagtcttgctttgttgcccaggccagagtgtagtggtaagaccttagctcactgcagtctctgcctcccagattcaagcgattctcctgcctcagcctcccaagtacctgggactacaggcgagcaccaccacacctcgcaaatttttgtatttttaggagagacagggtttcactatgttggtcaggctggtcttgaactcctggcctcaagtgatctgcctgcctcgacctcccaaagtgttgggattacaggcatgagccactgcacccaaccaggtttgtctcataatcaaattctcaagtagtgcagatactgtggctctaggggccacactctaagaaccttcagatgggtcagccggacacctacacctgactatcgtcttaaaatgcttcattcacacccagctcttataggggaggacagatttaggcctggaaacctgagagaagatcaggagattcagacacaacacaaattgataatgatcaacaggctttggcctcagctatttgccatggtaagtgacttaactgttctgagcctgtgtcttcatctgtaaaaagaggataagaaagctatcacataggattgttgtaaggattggataagagatcaagtgtggaaggtgttagctgatgtgagactgttgtgctgaacccctattaacctcagaagggagagccccaggctcaagagcctgaaggagagacccagcaccagccaacgagacatgggattttactagaggcttacatacaggggagagagtccattggcggcgggctgggcaggaaaactgcaaccgcctgcaaacatcatgtagcttatacagcattttcacttaacacccttccctcaatgacctccacctgacaacgttcatttaaccccaaattcagggcctcaatctcctgtatggctgggggctcagatgttcatcatagataaggaatgaatctctgcattggccacgctgtgtaatcccagcactttgggaggccaaggcgggaggatcttttgagactaggagtccaagaccagcctgtgcaacatggtgagactccatctctactactgcaatcccagcactttgggaggccgaggcgggcagatcacgaggtcaggagtttgagaccagcctggccaacatggtgaaatgccatctctactaaaaatacaaaaaaatttagctgggcgtggtggcggcacctgtaatcccagctactcggaggctgaggcaggagaatcatttgaacctgggaggcagaggttgcagtgagctgagattgagccattgcactctagcctgggtgatagggcgagactctgtctcaaaaaaaaaaaaaagaagcatgatctggaacagtactcatggcctggtgatctctgtgcctgttttcgtctctttcttcaccccggctctgaacatagattcaggtgcatctgccatacagggtcattcttagggtatgctcaagttattcctatcaggggcatttagcctacagagacccccttaagtgtttgttgtgcatggtggggacacacacaggcagtggggaacagctctagcaagtgaggccagactagttggtgttctctgggcaagggcactttgggaggctgaggcagaagggtcccttgaggcctgggcaacatagccagatgccatctctacaaaatataaacaaattagccaggcaaggtggcatgtgcctatactcacagtacttcgggaggctgaggcaggagaatcccttgaggccaggagtttgagaccagcctgggcaatacagcaagcccccatctctacaaaatataaacaaattagccaggcaaggtggcatgtgcctgtactcccagtactttggaaggctgaggcaggaggatctcttgagcccaggagttcgaggcagcagtgagctatgatcgcaccactgcactccagcctaggtagcagaccctgtctctttaaaaaaaggaaaaatgactgggcgtggtggctcatgcctgtaatcccagcactttgggaggccgaggcaggcggatcacctgaggttgggaattcgagaccagcctgaccaatatggagaaacccccgtctctactaaaaatacaaaattagccgggtagggtggcacatgcccgtaatcccagctactagggaggctgaggcaggagaatcacttgaacccaggaggcagaggttgcagtgagccgagattgtaccattgcactccagcctgggcaacaagagcgaaaatccgtctcagaaaaaaacaaaaaaaagaaaagaaaaacacaacattttgcccttctggtgctctgggttctgtctcctgctcatgctccctgggtcttcatggcactattgagtagctggcagtgacggggtaggagtggtggtaccagcagccttcattttttcctagacaggaatgtaagaagcaggcacgacgccttctctccaacagttgcattttacagcttatgatttatagcgaggtccatcatggcagggaagcacacaccattatttatgtgtttgtaccctgccttgttccaaggaagatttaaggcagctgcagaccccggtaaattaatccactatctgtgcagtggagagaggcagggttcccatatcagcccggataggttagcttgctgaagtggccttagcggcagactccagtccatcctgatgcaatcagaagagaatttggatctaaaccagctgttctcaaacttaagtgagcattggagtgacctggggaacttgttcagcacagattggtcagtttctgattccctaggtcaggagcaggcctgagaatctgcatttctagcaagtaccaggtggtgctgatgctgctggcctgggagtctcactttgagatgcactgtcctacggaaattcatgctgtgattgtccttctggaagcgtgaacttgggccaggctcagtggctcacacctgtaatcccagcactttggaggccaaggtgggaggatcgcttgagcccaggaattcaagaccagcctgggtaacatggcgagagtccatctcaaataaaataggctgggcacagtggttcacacctgtaatcccagcactttgggaggccaaggtgggcagatcatgaggtcaggagatcgagaccatcctggccaacatggtgaaaccccgtctctactaaaaatacaaaattagtcgggcgtggtggcacatgcctgtaatcccagctactcgggaggctgagataggagaatcacttgaaccagggagtcggaggttgcagtgagccgagatcacgccactgccctccagcctggagacagagcaagactccgtctcaaaataaataaataaattaattaaattaaatatgaataaaatggaggcatgatttggaatagtgttcatgtgttcatgcccagtgatctctgtgcctgttttaggttctctcttcacccctagagctgctaggagcctctcacttacacccaccttcctgagatgcatcctgtgctagaatgtgccagacttggcacccatggaaatgctcttttctttggctgtcactctcatggtcttgcaaggagccactatcctcattcaaccataatctaactaaggcatctaatgggtggctttccctggtggaggagaagagagaagcttaggtggcaggtggacttgagttcaaaagtaaattggccaaagtactcatgtgaaagtgagcacgtcactccagttctctcagtttattaatctgtcaaatggagacagtacactttcgtagaaccgttgtgagaatgcagttggacaatagagtgtttgacgtatcgctgttctccatcattattcccttttcctttcgaaatacattctcatggatccttgtcttgaaggagtgacctggatggagagtttgggggtggattatgatggaccagagaagtagctgtggaagatttgggggccaggggatccgctatttagcattctttaattcacatgctatgaatggtccctctcagcccttagatttctacttgtattcaaataaattgcacagctaaaataaagaactattttagtcaaaatggtcagttttcagaataaatagttttgatgtatgctacagctcatgcataaattcagacaggtagtagactgtcaggctggggacacagagatgaatggagcatcaccttgtctttgaagagctcacagtctaatgctcaaatccagccagtgcctttcaaggctctcctgggtttttcctccaggacagtgagtgtaggcatgggctcctctacccagcgtggttctgccaggcatctgtgatgttgccccagttatctggatgttcttgactgggccccagttcaccttcatattgaagaatcacgctccctggtaaagagaaggaaatgagttttgattggtgcctgtgttagtccattttcacactgctgacaaagacatacttaagactgggtaatttataaagaaaaagaagtttaatggactcacagttctacgtggctggagaggcctcacaatcacggtggaaggtgaaaggcacgtcttacagggcagcagacaagagagaatgggagccacatgaaagggaaaccccttatacaaccatcagatcttgtgagacttgttcactatcatgagaacagtatggggaaaccacccctatgatccaatgatctcccccagggatggtccctcccacaacatgtgagaatgatgggagcttcaattcaagatgagatttgggtagaaatgcagccagaccctatcagtgccttttcttcccttctgtcccctccacttctccatccttctcctcatcatcccatctccttgcctgtctttacctgtcctctctgaacaatgcaaatatttccatttaaatctattatatgttctctttctctctctaataaacatactttactgttgatgggattgatagatgtttcaggttacttacttgcagagaagaaggaagtctatcagcttttataaagtttttttttaagaggcagggtgtattagtccattttcacactactctaaagaaatacccgagactgggtaacttgcaaaggaaagaggtttaattgactcacagttccacttggctggggaggcctcaggaaacttatgatcatggcagaaggtgaaggggaagcaaacttgggacttctcagatggtgggaggagagacagtatgtgtgtgaaggagaaactgtcaaactcttagaaaaccatcatatcacatgaaactgtcacaagaactgcataggggaaatcaccccatgatccaatcacctcccaccaggcccctccatcaacacgtggggattatggggattataattcgataagagatttgggtggagacacagagccaagtcatatcacagggtcttgctctgtcacccaggctggagtgcagtggtgtgatcatagctcactgcagcctcaacctctgtggttcatacgatcctcctgcctcagcctcccaagtagctgggactacaggtgtgcactagcacacctggctaatttttgtattttttgtttgtttgttttgtagaaatggggcctcactgtattacccagtctggtcttgaattcctgggctcaagtaactctcctgccttggcctcccaaactattgggagtacaggtctgagctactgtgcctcacttgtcagctttgtgataaagcagagagaagctgtattagtctgttctcatactgctaataaagacatacctgagactgggcaatttataaaggaaagaggtttaattgactcagttccacgtggctggggaggcctcacaatcacggctgaaggcaaatgagcaaagtcacgtcttacatggcagcaggcaggaaagcttgtgcgggggaactcccgtttatacaaccatcagatcgcgtgagacttactcactaccacaagaacagtatggaggcaactgcccccatgattcaattgtctccacctggtacaaatcaaggtgagatttggggccaggtgcagtggctcatgcctgtaatcccatcactttgggagactgaggcaggtagatcacctgaggtcaggaatttgagaccagcctggctaacacatagtgaaaccctgtctctactaaaaaaaatacagaaactagctgggcatggtggtgcacacctgtagtcccagctacttgggaagctgaggcaggagaaatgcttgaacccaggaggcagaggctgcagtgagctgagactgtgccactgcactccagcctgggtgacagagcaagacaccatctcaaaaaaaaaagaaaagaaaaggtgaggtttgggtggggacacagccaagccatatcagaagacaagcaaagacactgtactccatattctgtgataatagcaatgacaaccatagcagttttcttttttgagcacttaatgtgtgccaggcattgtgctgctaacatctgtctatggattagtaacataattaatcaaaataacctcggtggggaggcattattattatcattatttttattttacaagtcaggcagaaagaggttaagatagcatgcccaggactagtaggcaacagagctgaatttaagtgcagggccgaggtctgatccccagtggccaggcccctaatgactgatctcctgacccggcctggaatgggagcactataccttggctcattcccagtaactggaggatgcttgatggtcacatgtagaggctgatcattcctctgcttgaattgggcatcgtaataatgcctttcctacatatcatggccactttcccttcctgtctccaattgtatagggaattgcagggtagggaagagaggactccaggagtatctgattttggtctagagactgataaaaatgggaagtccagggatcagcaggtgccaccagggcagatgtaaatgatgtccttgagaagcaaagaatattgagagtccagcctgccaaggttcgtgatgtccgctgctgcccacccctgctgttgctgatattgaatggcaaggccagaaggcatgggaacaccatctgtgggggctccagcaggaagagaaagcactgggaacccatgtgctcttttcgtcctacagatggtcgagacttagagagacaagaacagccccaatgtactattattttagttgccctgtcttagttgcacagggaagaggacttcagcagctcccaggacttgaatgtgaaggaccctgcagtggggaggccgggggatcaagggaatccccaggtggcagaaggggccagcagctgggagccaggccccagagtttgtgctggctcaaagcatcagtgggccagttggagaccgggctgtcttactctggtgggggtggggagacatctttagcatttgaggggagcatctttctagagaaacagcagggcataggacctgtttggtggacctcacgtattggtgaggtcactagccacaggttgaaccaaaggaagtcaaaatgaggacagagacccctctccgcacagacatcgtccagtgacatagaaatgatctccgccttcctttccacctgccctccttccccgaagcccaacctgaaaggagtggaggagagagaccatgagggagggtgaggaggaaggcactacagaaacagacagcaccctctttcctgtcctaagcccccagctgccctgaggaagcataagagccatgaaaacagagtgagttcagtgttctcaattgaaccggcctaaatatcaatcactgaaaatgacctgggccggatggggtggggtggggagcggggggcggagcacttacacctgtaatcctagcactttgggcggccaaggcaggaggattgctcgaggccaggagtctgagaccagcctgggcaaagtagcgagaccatgtctatacaaaaattaaaaaaaaaaaataaccaagtatgatggcatgcacctgtagtcccagctactcaggaggctgaggcaggaggatcacttgagcccaggactttgaggctgcagtgagctatgatcaagccactggtgacacagtgagaccctgaatctctctctctaaaagaagaaaatgatctgaaagttaggaaaatgatctgaaagttaggaaatttgtctagggagggagatgtgggtcctcatcctctaactgggagccaggactggatacatttgacatttgtatctgcaatgagctgaccttcttctgtgcactaatccactaatgctgccataacacacattgtgcaaactgtgtgccatagcatagattaagtggtttaaacaagaaacatttattttttcacaactctggaggccagaaatccgagatgagcatgcaagcagcgttggttctttctgaggcctctctccttggcttgtcgaaggctgtcttctctctggggcctcacagtctttcctcagtcacattctgggtgtgtctctgtccatttcctcttcttttaaggacagtgagcacaccgaattacggcccactctaataccctcattttaacttaattatctttttaaagaccctttctccaaatacaatcacattccagggtactgggggttaggatgtcaacatatgaatgtggttacaggggacaggatttagcccatgacagtccattaaatgtaagtccactgtgtgcttacatggggaagtgtgctattttcctggagcacatgctgcgtgcagcctgccaaggttcatgacgtccactgctgcccactcctgctgttgttgctgatattgaatggcaaggccagaaggcatgggaacaccatctgtgggggctccagcaggaacaggaagcactgggaacccaggtgctctttttgtcttacagatggctgaaacttagagaaacaagaacatccacaatgtactattattccatgaaaagggcagtttgcaaaaccgaaagtacagcatgattggattttaaaagaatgtttttcaaaaaagaaaaagaatatgtgtatgcacatgcgtgtgggatcatgccttttctctgtgcaagcagagaattcagacgtgaatgtccgcagtggggtagcagaggttattcctgaaggcgggaagatgggtgactaccattttaacaatttattgtatttgctacatttgctacaatgaatttgttacttttgtgatataaaagagagaaagagggctgggcacagtgtctcatacctgtaatcccagcactttggtaggctgaggtgggcggatcacttgagatcaggagttagagaccagcctgggcaacatggtgagacccccgtctctactaaaaatacaaaaattagccgggtctggcggttcacgtctgtaatcccagctgcttgggaggctgaggtaggagaatcacttgagcctggtggaggttgcagtgagctgagatcataccactccacaacagagtgagactctgtctcaaaaaaataaataaaagcaacaacgaaagagagaaagggctatgtaatattggaaagaaacaggaggtgaatgtttagcgtcatagttggagtcagtgaatggaatttggatttctgagccaggatttaaaatgtcagattcatgggtttgggagtactgaagagaatcaagtgtacaaggaggagatgaacatttgcccagagtcaagatggctggaatcagaagatctgaatatgactggggactggggagtagaggacgctttgttgtgtctgtgaagcatcacattaagagcaactgggctgcctctgaaaaccctggagaagaatgttcttgcagaagccagataactccatcaaagagatgaatagggttgaaatagatgacatttaaggtccttcctaactctgagattctgtggttttgtgaaaatgtagaagctctgagttaagctacctttgaggacatggtgacatttaatgctaaaagcatctgttgatgttttctttgaaatctgcattgtgccaactccacctgtaaggatgacctgcaggacattggaatattttgtgaatctccatagcaactctttcagcagaagtattttctttggatgatctgaagacacaggacagcgaagcatttttttttttaaatctccatacctcatgtccaagttaactgctatttaattgaatggcatttcattctcagaccgtcatccccttacctgaatgttaatattcttacctgcaacaaggcccctattggggcagggttggggagtggagtggagtcatgatttactggtattttgcatgaaccaataacatttccaaatcccatcactttgagaggctgagatgggaggatcatatcacttgaggccaggagttccagaccagcctgggcaacatagcgagacctccatgtctacaaaaagtaaaaataaaatcacatttctaatctcagatgatgttgatttgtagacattattgtaagtgggagagactcagtgtaacctgaacctagtacagtaaagtgtaggctcagatcacagtgagaggaaataccacatatagcagcattttcattaatgatacgattgttttataatgagtgctccaaagattccagggaaatgcttccttacactcagaatgtgttgcaaagaagactgttttctctggcctccatctgcctgaaatgcactcccgatttctcttcatctatacagattttacctgctcctccggagccatttctaatccacattcttcctccatcaagccaacactgactcactgatatggtttggctgtgtccccccacaaatctcatcttaaattgtagttcccatgatccctacatatcctgggagggacccagtgggagataattggatcatgggggtggttacccccatgctgctgttctcatgatagtgagttatcacgaaatctgatggttttataaggagcttttcctccttttgcttagcacttctcctgctatcctgtgaagaagaatgtgtttgcttctccttctaccatcattgtaagtttcctgaagcctctccagccatgcggagctgtgagtcaattaaacctctttcctttgtaaattacccagtctcaggcagtcctttatagcagtgtaagaatggactaatacactcgtccatcccaattgattgcttttgcctataaatttcctagagcaattattgacaattaattgcaccgccttgccctgtctcccttattacagtcttgaatgactattaatgtctattctgtatgtttgtgtcctcccatagtgtttagcgaagggctccaaaaacagcaggcactcaataaaggttctctgatttattcagaagaccactgtttgttgactgcacgatgattttgaactcagctgaggcagaccctattcgtggtcctccttgatcctccacctaccaccatcatgagtgactttggtgtctacaaagatgttccttctaacacactggtctccccaggtctcaacttcctcctctctgttggcctcctgcatttgttctcagccatccaatcttatggctacacctccagagcttgtcattacctgcaaagcagtaactcagacactcaccccctgccacttccttgcttgtcccactggctgtcctccaagcatcctttgctggcatcagaacctgcagcacattactactctttcttccagggctctttcctttcatcactttccccttatcttttagattccggggaccctcactgcagggaagatgggctctgatcaccaaccccaagtggccgttcaccatgtggccatggttaagacaattcctaccaccatagtaagagccgtagtttagccactcctccaaacccctgtcctctcttctccccctttaccatatcgatctagtttagattccagggctcatcatttcaatcattcctgtgctcaatgctcttgttccactgtctttttagtttatttatttatttttttgagacagattcttactccattacccaggctggagtgcagtggtgtgatcttagctcactgcaacttctgcctcctggattcaagcgattcccctgcctcagcctcctgagtagctgggattacacgcgctaccaccatgctcagctaatttttgtatttttagtagaggcagggttttctcatgttggccaggctggtcttgaactcctggcctcaaatgatccatcctcctcagcctcccaaagtactgggattacaggtgtgagccaccgcgcccagcctagtttaattttttgagacagggtctctttctgtcatccatgctggagtgcagtgctgtgaccatggctcactgcagcctcaaactcctggcctcaagtgatcctccagcctcagcctcccgagtagctgggactacaggcatctgccaccatgcctggctaactttaaaaaaaagatgtgtgcagatggggttttgctatgttgcccaggctggtctcaaatttctggcctcaagtgatcctccggccataaccttccaaagtggtgggatgagaggtgtgcaccatcatggcttccctcctctgtctttttgttgtatacaaatggcaggatctcaaccctagatgggtcttctctggccaaaacccatgtcctgagtgttgatagggactcttagtgcagggcagacaggctctgatcaacaccccaagcagccctgccctccactctggccatggttaaggaaatgtttacagtcatatagagtgtcacacagttttgctactcccccaaacatctgtccttccttctccctctttctcacaacaaatggctgcatcttccattgcacagaggaagcaggagccatctctcaggaatctgcttgtcctcagggtggcaaagacaaacttaaagattaccatcctccccttcttccctcccatttcactagagaagccctgtctcctcctaagcccgacccttcagctgcactcagattccattccatgtctttgtagttttgcactgtttatggataatcccttaactctcctgtttattcaacctttccctctcaaatgaatctctcccactggcctttcaacatacgcaggctcttgcattaaaatcaaagcaaaaagaagcaaattaatttcatatttgccagcatctactctcttgccccttatgaccaatcttcacaacctgtgctgtgtctattcctcaccacccattgatttttgcagcaaattcttttccaaagttaatcacattagtatatcccatctttcacagtcttgttacgtgtgatgttgacactttctccactgagagatggggtcacattcatcggaattgggagaatctttgttatctcagccaatggaatatggtggaatgaggtggttgctgcctgaccttctgggtttaggtcatcctttaacatctgtcagatatgtccttcttcacatgatggcaggaaggagaagcactgagcaatacggtgtgtgtatgtctctctctccctccatgcatcttgggagccttgagccaacatgtatgaaggatggcttcctcaaagccaccatgctgggaagaccatgtgaacaggaactatagacacagaaaatgatgcccaaggagctcctggtgtttcaccctcactgtttcaatcttcccagtgtcaaccacggatgtgaagaataccttagatgatgccagcacccagccttggagtcacccatctcagactgagtagaacagagacaaccatccttactgagcttgacccccaattgtagatttgtgaacaaatatattgttttcataaactaagtttacaataatgtgttccacagcatgaagttgccgaaacagcctctgacttcaccccaggatatcagtttgccccatcaagtgcttgagatggctcttaataggcacaccgtgttactaagtcagacattgttgaaatgtctgctttcttggtcattagccccctgcactgttgatcacccaccctgaaatactgattccttggtatccactgtattaccctcatctggactttttcagcattcttcttacttgttgggctacttttttccccatgattctgtccacagctattaaatgctgaaatccttcaagactcacacctagacttccttgtcttctcactccaagctttctccctaggcaattccctacacgatcacatgtcaatgatcacttctatgcatgagtcataatttacatcacttttctgagccagggtctcgctctgtcacccaggctggagtgcagtggcgtgatctcagctcactgcaacctctgcctcccaggttcaagctattctcctgcctcagcctcccgagtagctgggactacaggcacacaccaccatgcctaatttttgtatttttagtagagacagggctttgacatgttgaccaggctggtcttgaactactgacctcaagcgatctgcccaccccggcctcccaaagtgctagaattacaggcatgaaccagtgtgcctggcctatatcacttttctgagctcctgacccatagatccagtttcctactgggaattatctcttgggaatgtcaaaggtacctgaaattcaatgtagccaagatttcagtactgtattcctctttctacctggtctgccttgcaggttcatgagagtgtgttattgtccaggggtaattctacccagtgttttagtgagacagatgatgttcctgccttcctggagcttttattctaggtacttagaacagatagtcaaaatacataaatacgttaataagggctgggcaccgtggctcacgcttgtaatcccagcactttgagaggctgaggcgggcagatcacgaggtcaggagtttgagaccagcctggccaatacagtgaaaccccgtctctactaaaaatacaaaaaatggccaggcgcggtggctcacgcctataatcccagcactttgggaggccgaggcgggcggatcatgaggttaggagattgagcccatcctggctaacacagtaaaaccccatctctaccaaaaatacaaaaaattatccgggcatggtggcgggaacctgtagtcccagctactcgggaggctgaggcaggagaatggtgtgaacccaggaggcggagctgcagtgagccgagattgtgccactgcactccagcctgggtgacagagcgagactccatctcaaaaaaaaaaaaaaaaattagctgggcttggtggcagacgtctgtaatcccagctactctcgggaggctgaggcaggagaattgcttgaacctgggttgcggaggttgcagtgagccgagatcgtaccgctgcaccctgggcgacagagctagactccgtctcaataaataaataaataaataaataaataagtgaactaaaagagggtgacaaacagcagacagtgaattagacaaaggtaatttgtcaaatttgctgtctgctatttatcactctcttttggtttacttatttacatattttacatagtttacttgcatattttaattagtttacttatttacatattttgcagtttatttacatttttttacctagtttacttatttacatattttgcatagtttacttatttacatagtttacttatttacctagtttacttatttacatattttacttatttacaaattacctttgtcaaatttgctgtctggtatttttcagtctttcagtttacttattgggcctggcatggattcagggcagtgtcagaaaataccctgaattctgccctctctctgtggcccgtcacctctcaatgctacgtcctgaatagctctcagatctctctatgcacctctgctgcagctacccgaggtcataccattgtcatctctcccctgggtctctctgctgtagcctttgaactggtttgctttcatcccctcctgacattctccagcatatatcccacactgcaatcttagggcaagttggatcacaccccacacgctgttgtgtgcatacactgcatcatgtagtggcccctccttgctttataggattaaaagtctgatctcttacttgacccacagaacccagtgtgctctggtcttttctttctctttatccccaatttgaacagtttcgcttctcttccacctcgtggccttcctcctcttcttcctgccacatcttccccaggccacaggacctttgcacgtgctagtcccactgttggcatctcatatcttccctctcctgccagtgaattacttctcatccctcagaagtcagctctcctggggccaggcacagtggctcacacctgtaattctaataccttgggtggctaaggtgggaggatcacttgaggccaagagttcaagaccagcctgagcaacatagtgagaccccatctctacaaaaaaatataaacattagccatatggggtggcacatacttgttgtcccagctacttacgaggctgaagtgggaggattgcttgagcctgggagttcagggctgcagtgagccatgatcttgccactgctctccagcctgggtgacagcgtgagattctgtctcagaaaaagaagtcagctctcctggagaacctcctcggcattcctgaagaggtcccattaccccattatgtgctcttggaaggccatgtgcttctcctgccatgtccagcttcagtgattctgctgttaactatgtgaatatttgagtatattttccccttcaacacaagcccttggcaggctctttataagtgcctcccctcagagaacttatttaaaaaggtgagaacagaaagagaagtaattacttctgcttttggggcaccaagcatttagctctctgattgtccagcccaacatttctcttagctccataataagcttcatatacacttgagattcagaagccacaggccccattgtgttgatctctctttctctgcctcttggctacagcaaaaccaagactcaaaaccaagggagaagtatttctttgatacacaagtttctttcctttggataaatacctagtagtagtggcattggtgggtggtatggtagttctgaccattacaccttctatgcatgtaacaaaatatcactaggactccatatgtatttgcaaatattatgtatccataaaaaataaaattggaattcacagttctaaaatcaaacaggaggacactagctggggcatagaaggaatttttattttattttattttattttatttatttattttgagatggagtcttgctctgtcgcccaggctggagtgcagtggtgcaatcttggctcactgcagcctccgccttctgggttcaagagattctcctgcctcagcctcccgagtagctgggattacaggcacctgcccccacgccagtctaatttttgtatttttagtagagactgggtttcaccatattggccaggctggtctcaaacacctaacctcaggtgatctgcccacctcggcctcccaaagtgctgggattacaggcgtgagctaccctacctggacttaggaatattaattttttacatataattttatgttttaattaacaaataataattgtatatatgtatggggtacatagagatgtttcaatacatgcaatatgtagtaatcaaatcagggtagttagcgtgtctatcatctcaaacatttgtcatttctttgtgttgtactggtacatgcaatattttccttccagctatttgagactatatattattgttccctgtagtcatcttccagtgctatagaacactagaacttattcttcccatctgttaggttggtggcaaagtaattgccattgaaagtaatggcaaaaccgcagttacttttgcagcaacctaatagttgtaatttcaaaggaaggatttttaaaagcacattcaggccaggtgcagaggctcacgcctataatcccagcgttttgggaggctgaggtgggacgatcgcttgaggccaggagttccaggccagcctggacaacatagtgagaccccatatttacaaaacaactaaaaattagctgggcatagtggtgcacacctgtactcccagttacttggaagctgaggcaagaggatcactggagcccaggaggtcgaggctgcagtgagccatgattacaccacagcactccagccaggatgacaagagtaaaaccctgtctctaaataaataaataagtaaataaaataaaaggcacattcaacgcaccaaaaagtctactgttaagccttcagcctgcttcatccctcccttgtcttgacatacagttttgagcctgaagttatttggcaatttatttttttatatacaatgaaaattaaattcagctaaaatgaggaaaacacttggtatgtatctatacaatctaggtgatttctgatttctggagaaaaccttgtcacaggtccagaataattaggagatagttctgctggaacagctgcctggcagtcagcactcaccctgggtccgcctttgaccccttgagtttgaatttttttggccagccttggcacactaagaaaattaaacctgcctgtgtctatagacgccactgggccctgagccaatgcgttggttaatcttcgagccgtgtccctttaatgcagcatgaatttgcatcttctgattacctgtttattacctgtcaggtaaaagagtgatctagaacactgcacacttgcccagagttgggaaggaactgggaggtgtttgcatgcaggatgaagaaggaagctcctctctcaaatgataagcctaattgttttaagcaggaggatttcaagttccccacgcctcagatcagcatgcagctcacaggctttgttaagcttgtgtgacagaataatctcctttgttcaatgcccgaggaggatattttctgcattattagacaagtcaatgaagataaaacaaaatattaagtattttaagctgcgccagtccaccccgaagaaattaagccccctcattctaattgtgcctagtttccttgccgtaatgagatggaggctgagctgctggaatgaggggcttcctgcaggcctgcatgccccccagtcattggagtgaacctctcctttcctctgcttagtttctttccctgggggaatttttagagccagagacctggtctccaggcgaggcaagaaataaacgcaacctccaccgtaagcgtgtgacattgatcagcatatttttaaaaaggtttccatgtctgttgcaattacgtgaaaccagctaatcctggatctaagctttggcagcttggaaatattagagcaatttggcatccagattccatcatgcaaagatttgtggtcttgtgtttgtatctgtgacactgtataatttccaattggcttttaagagacagaaacctggatgccgttggctaaacagtgagagcatttgcctgcctttctgcctccttggaagctagagcagtcattaaaaactagagaagtgagcacacgcagcaccccccggcccatgggtggttagcagactctcggggtgttactggagctgctatcattgtgggtgtaggagatgattgcaggtcctcgccggcaccagctctgaggaacccaggtgctccaagtccccagccttcatgcccgggctgtgggggccaaagggaccctggagggcgttttactatctccctgcttcacttccctccagaaaactgtgttccttccccagtgacagacttcacacccaggagctccctggttgtggggccgctggttttgcagtttgcttagagtcttttgccaggttctggagcttcagaagttcccaggaaggtaccctggacacgttcttgtgcgtgcgctcgtgtgcatgtgtctgtgtgtgtatgcgtgtgcatgcccgttcccgtgtgtctgcgtacatacagcctctcacctgctttctcttccagccactccaccataaaaacagtttccgacttaaaaattgtttgccttacgatggttcgacttaacgattttcccactttgcaagggtgtgaaagcaatacacattcagtagaatccgtacttcgagtacccatccaaccatttctgtttttcgctttcaatacagtattcaataaattacatgagatatgcaacactttattataaaatagtctgtgttagatgattttccccgacagccggctaatgtaagtgttctgagcacatgtaatatagcctaggctaagctgtgatattctggagattaagtacaggaagtgcattttccacttaggtgttccaagtccccacccttcagcttaggatgggtgtatggggatgtaaccccaagcataagtggaggagtgtctgtatactcaagctaacccctatctctgttaatacttgtgctcagccccattctgggtatttataatttgctatctcatttaatcctcacaagtatgttgaccaagtgggtataattatctctgttgtgtagctagggaaacacttggctttcctgagccttaaacttgcccgtagtcacatagctcataagtttgtcacaggagctaggattcaaactagagcctgtatcttttttgggatgctcccaaagagcctgaggctaggatctgggcatgcaattcctttgggagctgatcccagaaagcactgtcaggggaagggaggcaggacatgggaacagagagatggaggcttaattgggtcactgctatgggcagctggggttcaacctgccggagatccccagagaaacgggatgcagcatccttcaacactgccccaagagagaagaggacactgggggtcttttgtttttcttaattagctttattgagatataatgtacatgacatgcaattctccatttaaagtgtacaattttttttttctttagacaggttctctgtctctcattcaacctggagtacagtggtgcaatcatagctcactgcagccttgaactcctgggctcaagcaatcctcctgccttggtctcccgagtagctggggctacaggtgtgcaccactgcgcctggctaatgttttttaatattttgtagagatggggccttgctctattgcccaggctggtctcaaactcctggcctcaagtgatcctcccactttggcctcccaaagtgttgggattacaggcatgagccactgcacctggcccctgaaatgtaaaatgtaatggcttttagaatattcacagaattgtgtgtccatcaacacaatccattttagaccattttcattacctcagaaagagaccccatacttcttagctatcatctctcagcccctccatccctcccagccctagacaatcactaatgtactgcctgtctgtagatttgctgaggtttttgtccacccaaattttgtcctccatcagttgggtcatgcctgggtgctaatttcctgccacttccaacttgcctcagagtgcagactcataggccaaggtcataatcgctgggagaacacggaatccacccagatcaaaaggccctggaagccaagggcttcagcaggtgtagggagacctcagggatgcaggccaggtcctgacagtgtctccttaccaggcttcctctccattcttctcattcaggggtctcttttgcatccttctctttaaattgtgccttttattcttaagctccagggaggctgttatgaaaagcctgtcctcatgatgttcattctattgattgcatcctcttcccaggtaggaagggaatgttggtttggagaagaaggtcagggtatgcctgtctgaactgagacctgcaagatgaggttggaccagccgaggctggatgcagtgcctcacacctgtaatcctagtactttgggaggccgaggcagaaggatcccttgaagccaggagttccagatcagcctgggcaacatagtaagaccccatcttcacaaataataataataatgatagaattagccaggcatggtggtgcacacctgtagtcccagctactcaggaggctgaggcaggaggatcacttgatcccgggaggtcaaggctgccgtgagccatgatcatgcaccatactccagcctgggtgacagaggaagaccctgtctctaaaaaagagagagagatggacccagcttagcaggacagggccgagcatctcaagcagtgggttcgaatgcacagacaaggaagtgggaatgggcttggatttggcaaggatcagataggaaaccagggtgcctggagtgtgggtaataggggttgaggggcagaatgaggttaggggagagcgtgagagcagcagatcctgcaagcaaccctcgtggccctaggcaattttattgcaacagcaatgggaagccttttgaagactttcacgcagtggcacagcctgatctgatttcctgttgagacctagttcatttgcctaggacttcatccctttagcaatggattcctgcaaggcttctccagccccatgtggcccttgtccagccattaaactccagtcctaggacatgggccctgtcactagcacccctgctagcctaagtatcactttatgcaaattaggcaaaagtaccctttttgaagaccctttcctgccatctactggaaaaccatcatcattaataaataagtctaccatagtgccccctatagttgggcagtgcacaacctccacaaccttaggtggcagtcctgcatatcacccacaacagacatctctgatgctgttgcttggattgcccaggggtcccttctcttgtcatatttcccagagttgtgcttctgctagacatttctggtagtcactgccatgtaccacagtactcttaggacacatgtcccatctgccaggatcaaaaggaatttttccttctatctgcagttaagtctcaacactaaccctatgtcaatgtactaatttgggttccagcctttttttttttttttttgagacagagtttcactcttgttaacccaggctgatgtactgactcactgcaacatcctcctcccaggtgtaagcgattctcccgcctcagcctcccaagtagcagggactacaggtgtgtgccaccatgcctcctagctaattttgtatttttagtagagacagggtttcaccttgttacgcaggctggtctcaaactcctgacctcaagtgatccgcccgcctcactcctcccaaagtgctgggattataagtatgagccactgtgcccggccctgggttgcagccttctgacatcatggaagttccccttctttgctctctgtgtcgtgacacgtgacagtgagaggtagcccagggtagctgttcttctgtctgggtggacatgccctgacttccagctccttaggaaagcctagctgtctctgactcataaaagacctccaagtcgtccaccagccttctgggaagatgttctttgaaaaaccgcttcagtcagcttgggccatgagcagaaatgttcaagacggcaacgttgcttctcagctctttctgtttctctgctctgatgccccttcagagatgaacgtgagagaccattgaggctggagctatttttcagggctctctggtccaccccctgggaagtggcccactttggctgtgccccagttattctggtaatgaactgtgcccaggtactgccctaggcattgttccctctctctgttctgacaaccaggcacaaacttgtctccttgtatgcaaggggaaggcagtggtggagtggggagaatgaggagaatcaggcctgaggcccaggtcggctgtcaagggaaacatttcatgattgtcaaatgggccaagattcctttagctccaacctggcctcctcttttttgagcactgaaatttctcaaaatggcaaatggaaactgaaacactacattaaatagcatttctgtgcaattaaaacacattaaaatggcaattaagtttcacaaacagccttttctgtgttctcgggttgattaagctgtttgtgttgtttttcagggatggttgttgtaactaaaggctgagctgtcttttatggattgggccgttccctaggagtcaaggaaccctgaattccaacttttattcctctcttggcaatttcactttattttcatttgcagctctttattagtctgtgagaacagactaatacaccactccacgattggaaaatttacacatatacaaaagtagagagaaaaatataacaaacttccctgcacccatcacccagcttgaacgattatcaactcatggccaatcttcccttggtgtttttttttgtttttttgtttttttgttttttggtttttgagactgagtcctgctgtgtcgcccaggctggagtgcagtggcaccatcttggctcactgcaacctccgcctccccagttcaagcgattctcctgcctcagcctcccgagtagctgtgactacaggcatgctccaccatgcctggctaagttttgtattttgagtagagacagagtttcaccatgttggccaggctcgtctctaactcctggcctcaagtgattcgcccacttcggcctcccaaagtgctgagtctacaggtgtgagccactgctcccggccccttggctatttttttttttaatcctttaaggtactagttaacttttcctaggagaaaaagtatgtaggaaaatttagtaagagaaattgacatggaagaaaggctttctgtatcctgggactgtgggttcaatgataattgagacaaatggcactgctgctctgtagagtgtaaggtctggttgggaaaacagatgagtcaattacaggaattcacagtggagagctgggcatggtggcttatgccggtcatcccagcactttgcagggccgaggcaggaggatcatttgagaccaggagtttgagaccagcctgggcaatacagcaagactgtctctacaaaagcaaaatttaaaaatttagccgggcatggtggcatgtatctgtagtcctagcaattcaggaggctgaagcaggaggattgcttgagcccaggaggtcaaggatgcagtgagctatgatcatgctaccacactccagcctaggtgatagagcaagaccctatctcaaaaagcaacaccaccaacaaaaaactgcatgatggggtaggtgatatgactctaagaggcattatgggagcacactggcgcagctgggaacgatcaaggatggcactgtggtctaacctgacccaaagaggtagacgctagccaggtgaaaggtaaggtacccttaccaggtgaaaggtaaatgaaccctattgagctcataaacagtggggggtggagggccctttttgggacctggggtactgctgtccccagtgccttccttgagatgtaggcactgagtcctgatggatctactattgtaaatctctaccatctgtctttcttttctccagcccatcctcatccaatacccatctcatcatccatctcttttggtaaaaatctcctaacgggccccaggacctccatgcctgtctagcctgtcactggaaatctagtttgtctttctgaaatgtgttctaatcttaattccttgctcagcctgactctgtctctaatggcttcatttctctaaggtatacattcaaacttcttggtttgcagttgccaaaattactgtcttgctttgatcagtttcagttgggcagtgaatcatccctcaccagagcctgaccacctgatatggtttggctgtgtccccacccaaatctcatcttgaattgtagctcccgtaattcccacgtgttgtgggagggacctggtgggagataattcaatcatggaggcagtttctcccatactgttcttgtgatagtgcataaatctcacgagatctgatggttttataaggggtttcccttttcgcttggctttcattctctcttgcctcctgccatgtaagatgtgcctttgctcctccttcaccttttgctgtgattgtgaggctaccccagccatgtggaactgtgagtccgttaaacctctttttctttataaattacccagttttaggtatgtccttatagcagtgttagaacagactaatacaccactccatgattggttcacaaaggatacaaagagagagaaatgccttaggagctggggagaggctcgggttggcattgcatttctgggactacacatctccctcaaccctgagtccactggactgtgcgtctgccaggagattcctgctagtggaatgcagctggaaggggatggaggggacagtcctgtgtctacattactagtcttgtactgaagcttcttaattatgtaacaagctacatcacctaagtttctctctgtcttttactttctcctgagtgggctttgtggtcaagaaaggacttcatcagacgcagtgatagtgtctttcgaggttgggcttctaaggagcactccctgaggttctgattagaccctggatagcacccgcactccctactcatggatacaggccctctttaaattggctcatctttctttaaatctctgttcctttccccatggggagaggagaattatcaccttcctcattcagataattgaggaatttagtacttgcttatgtaaaccaaaaagtatctgagacaggtctcaatcaatttagaggtttattttgccaagggtgaggatgcgcccagataaaaagagacaaaaattacagtaggatctgggacctgtgttttttccaaagagggttttgaggacttcaatatttgaaggggaaagagcggcagggtgggaaggaggaaagagaaagaaagggaaggtaggtagtgagataagtagtcactttctcgtgaggctttcattagcactcactggatccacgtgttgcatatcaaaggagggaggggatagaggagcagccgattatgcatttatcttgcaatcggtcaactgcattttgcataagatgaacatatggtagaggaagaagtgagatacgcattggactcttggtggacagagggatgatttctagttttgtctttctccagaatctgtaaaggtaggattttaatttatgttgtcagggtgaaggaggccatttggggagataagtaacctatcttgcagctttccatttaggaaaaaaaaagggaggcagtttttgcatgattcactttccaagcttaactttcccctttggcatagtgagaatgtattttcctttcccgctcagaatctaccatgattagtagcagacaaagattaggacttgagtcacactttttcggaggagtgatggagcagcccttggtacgtgatgatgggatcagcagtagaaccccttaattccagaactggagtggaggagttgattgcagtacacctggacatctaagggatagagaaatagcccttcttctatgctttctctcctgtctcctgggtagcttgctgtagatcttagggtctacttcagaatgcaggaggggtgcaggtatacatcttgtgctctgcaggtgtatagggttccttgaagaaaataggaacttgcaggggtgatttgagtgacttgagatcagcccaagggctgggcaggtgcttttcttccagagcagctctgcctaccaagcctgtgccatggatgctctccatttctccccattctgcccatgctccctgtcacctggagcagcatctctgctctaactcaagatttctacctccaagataactacttttatccttcgtggctaaacttcctatgtttgacctaccaagaaaacaattacagcctcccagggtcatgcttggtttctctgcactcagagcacacaacaccctcagtggaatctcctgagccacctgggataaatgtcttcctggccaacatttatattctatttcttgtcgccattgctcagagcttgaagtcaccccaggggctcctttacagtaatgtggggatgtcaaagttctcatgtcttagcttaggcgaccgtaacaaaaataccatggactaggcagcttaaacaacagacatttatttctcacagttctgaggctgggacattcaaggtcagggcaccagcatggtcattttctgatggcgctctcttcttggtttgcagcagcataccttctggctgtgtcctcacatggtgggaagagggagggctccagtcctttcttcttcttacaggatactaatttcatcattggggccccactcacatcaccactttgaaacctaatcacctcccaaagtcctgacctgccactaccattatactgggtgttagcacttcaatataggaattttggagcacacaaacactcactccataacatctttgggagagggccagtgtttcccctgctgttttagcccaccttaccttgattttactgtgtagctttttaaaatataggaatgacagaactttggagtgtccttctagccagcattttttaaatttaatttgcaatcatatggtggttgcttttcctattagattagacatcactactatataagactccaagaaggatataggataatggagttcaagcatttaataaaaaatattcactgactgtcagctctttgccaggggctgttctaggtttagagaaattggtggtgatcaatacagggaataaccttttttccatggcacttacacactacagtagggagatagacatggaagcatctaactcccaagtaaacaaaaacagaaaacctgagcctgtgatgaaagttatgcagaaagttggatatggtgtcataagtgtgacacatggggaccactgcaggtgcaaatgacaggaacaatgagctgtggggaacaggtttgggtgacgaattcttatctcagagggagcagctcatgaaaggcccctgggggagacagcatatgtccctggtctgggaactagatgccatccagggtggctggagcaagtgagaggagaagaaaaagaggacagggccaggtcatgcattccttccttgccaggacatggaagcagcattttattcttagctcaagggagacatcttcagagggttttaagcaggagcatggcatgatctgatctaatttataaaaatagaaataccgtgtgagaatgctcatcagtaatttctacctcaggcatcttctttcttattttctactgagtctgtacatttcctgtttcccttggtttctaaagaaaacaattatcttcatatcatcatttctacttgttctttcctttgggatccaggatctaatctgaaaattgctttccccaaggaactctggatggctgatgtaccatcacttcaagccatcagtatgtgctatgctttgactgtggtgtttcttagagtcctggataaactgtgcgatttaagcaggatgccattaatcacgcaagagacacgagtccagcagcagttactaaaatcaatatggcttgagattgtgatttccagaatatctcctcacttagtgagtcactaggaaacttcagaatagccgtatagattttaaagcagctttctctaaacaggatttggatatactcccacatttctccttgggcggagggagaaaggatggatgttctgaacaacacatgttttaaaaaacccactgccaggcaagattaaaacctttgcctggaagggagtcggaagattctctgggttccagtaaatggtctcatgcctatttttcccagtctcttgcttggattaggtaaagggtttaatcagtaagaattggccaattaatttctcccttctcacattcattcattttgtaaccagacattctgccagctgtcctggaaggtagtgagaggagaaagacgtcatttcttccttccagaaagccacaggatacatcagtgtcatggttgaggattatttaggcatatttccattttccaagttaatgtgttaccctcaggcttgggtggcttcagagcagaaaagaacaggtgagaccaggtacaagtccagctggctcagggactgtgacaaggagagaagtgtgatctggaactgggctcagcagtgttccaagtaggcatgtgtaactaccagataaacacagggatgcaggattcgagaggggtagggaggagagagagcagaaaggaacagggtccattatcttatggaagtcagcagcagtattcattaattcatccaatcattcatttattgaacacttatttctatctaactgtaatctctcttcagtcctttcacctacaccacaagtatcatttcctttgccttactagttactaaattctgtacgtctgtcccttcctccaatctctgagctctactgcatttttcctttagaatttttttggttttttgagatggagtctcattctgtcacccaggctggagtgcagtggcatgatctcagctcactgcaacctccacctcccaggttcaagtgattcttgtgcctcaccctcccgagtagctgagactacaggtgtgcaccaccacgcccaggtaatttttgcatttttagtagagatgagattttaccgtattggccaggctggtctcaaactcctgacctcagatgacgcacctgcctcggcctcccaaagtgctgggattacaggtgtgagccaccgtgcccagcctagtattttaagttagacttttgtcctccctttttgtgtccagtcagtattgcacctagaaggcattcagtccattgttgttttaataattacgatcgttaatgtagctattcaataaaatgaatgaatgaagttaattcaggatatatgaaaacgtctccaataaaataataagagagaaagaaggtctaaagaaatcagcatgatatataaaaatcatgcagaaaaaccattatactgattacttactatgtgctgagcttcacagaggctctgagaaaccagcaagaggcagtcccagccctcaaagagctcacagtctatgaaggagacctccatacagatatgtaattgtaacacagtgggttagaatagcccattgtatgtatggcgtctcatgggggcctagagttggagacttctgatctttcgtgggctctccaaggatgcttcctaaataaaatgtgctagaattctatgttaaaaaggtgggctcatgcctgtaattccagcactttgggaggccgaggtgagcggatcacctgaggtcaggagtttgagactagcctggccaagatagtgaaaccttgtctctactaaaaacacaaaattagctgggtgtggtggtgcagacctgtaatcccagctactcaggaggcagaggcaggagaattgcttgaacccaggaggcggaggttgtagtgagctgagatcgcgccactgcactccagcctgggcaacagagtgagactccgtctcaaaaaaaaaagaaaaaacagaaggtggaatgagacctctgggcagagagaccagcatgggcaggcaaaggaggtaggaagctgcatggtgtgtgtggaggttggaaaacatacttccatggatgatggcaaaggcagtagatggaggggccatcctgcctggccctggaatcccggcaaactctttattctccatcagtgtggtcgttggaaagattactaggcttgaggtgggagggcagatgggtttaggaggcgggagcaagcatatggcaggaggggatggggccacgagatgcatagacccagcaaaagcactatcaggaggagagactaggagaggagggacaggagtaaccaggggctaaacttggcttgagttttattgagtggcaaatgatgtcactcccttctgattcacctgtagtagaatttgataagggatcagttcagtcttcagacactgtcagaagtgcaaagctgatctccaggtaggcgagggaggagaatgaaagctgcccatggaagatgccatgtgggtcctgggagccacagaaaattctggatgtgtgtgccatgtattttcattgaacacgtgtgtgcacatgcacatatgtttggtattggatgctgcaattccagcttggcatgtacacttctttgtagctcagaagggctaaggcatggatgctcagatagatcccaaatctttttttttttttccccaaatcaggttctagggctgtgtgctggtgagttaggccaagaccaggcttagcacatctgtccccaggtggacacagcagccaggtctgcccaatctaaaggccaccttacctttgaccacctcctttcccagcaggaagacgccctttccttcatctaccattcgtgtccatctgtcctggactacaaaagatttgcagaacctgcctggagacacgtctttgtattaactattgcaattcacaccttctctgttgaagggcttggagcctccttgtgctaatgtggcagcctttctgcctcctgtgggtaaggactgcagtgaaatcagatcaccgtgactgaacgcagttctgagccagctgtcgacttacactgctcagttctgttttttcttcctggccttctcacgcccaggccctgagcccagtggatttcaccatgctgggttgctcataaaaaatggtttcttcctgatgcttttggtggcagactgaatatcatcaatcatgctgcaagaaggaaacacagattcccagctgatggcattgtcatgtttatgacacatccgaaacagtaacagatggtctgtattaaaagtgtaactggtgagtgagtgctttcataatcatagagatattttttattcccctaaagttttggttctagaaggagtcacagaacgttagatcataagggcccctggaaagcttcttgtccacatgtctcatttttacaaacaaaaatatcaaagtacagtgagattaagggatttgccaaggtcattgagctaattagcgatgagaccgagaacaaaacccaggcccctaatgttccatctaatgctctttgtgcaatactgtggagcctgcggatccacactttgtcttctcttggagaagaaaacagaccgtgctggaaacgcacagggcttctgtgagttccttggcatggtgtcaatgttggatgcagagagtcctcaaaccctcttgagcatggttggcccttcctgagaaggtgcagaaaatgcaggtttttattctcagggcttctgttggtgtggacagactgtattagttcattttaatgctactgataaagacataccgaagactggacaatttacaaaagaaataggtttaattggacttaaagttccatgtggctggggaagcctcacaatcatggtggaagtcaaggaggagcaagtcacgttttacatggatggcagcaggcaaagagagaatgaatgccatgcaaaacaggtttccccttatcaaaccatcagatcttgtgagacttattcactaccatgagaacagtatgggaaagaccctcccccataattcagtcatctcccactgggtccctcccataacatgtgggaattatgggagctacaagatgagatttgggtggggacatagagccaaaccgcatcacagaccacatccaccagcgctgcaatgcaaggcttggttttcaagccagtgaggtggcaacagaaactggatctcttatctgatggaatccagtttcacctgggttcatttcttgattgatctgaggatgttcggatcagtaggaataaaccaactagccaatggttctcaaaatatgcttcctgaaccacagcagaagcatcccctgggaacttcttagaaatgcagattcttagttgggtgcaggagctcatggctgccatcccaggatgtcgggaggtggagacaggaggatcactagagcccaggagttcaagaccatcctgggcaatgtagcgagacctcgtctctatggtacataaaaagctaaaacttagccaaactggtggcacacacctgtagtcccacacaattctgtgaacattctaaaagccattaaattttacattttaggagccaggtgcagtggctcatgcgtgtaatcccaacactttgggaggccaaggtgggagaatagttgaggccaagaatttgagaccagcctgggcaacatagcaagaccccatctctacaaaataatttttaaaaatttagtcaggcgtggtggcgcacgcctgtggccccagctactcaggaagctgaggtgggagaattgcttgagcccaggaggcagaggctgtggtgagctgagactgtgccactgcactccagcatgggtgacagagcgagaccctgtctcaaaaaagagaaaagaacagagaaagaaatgcagattcttggccaggcacagtgagtgggctcatgcctgaaatcccagctgtttgggaggctgaggcaggcagataacttgaggccaggagtttgagatcagcctggacatgataacaagatcacgtctccacaaaaactttaaaaattagtggggtgcggtggcccccactatttgagaagctgaaggaggaggatctcttgaactcaggagttcaagcctgcagagagctatgattgtgccactgcaatccagccttggcaacagagcaagaccctgtctcaaaaaataaataaataaataaataaataaataaataaataaataataaagaaaagaaagaaatacacatcctcagcccccagattaagaaactctgggctgggtgctgtggctcatgcctgtaatcccagcactttggaaggccgaggtgggcagatcacgaggtcaggagatcgagaccatcctggccaacatggtgaaaccccatctctactaaaaattcaaaaactagccagatgtggtggcacaggcctgtaatcccagctactcgggaggctgaggcaggagaatcgcttgaacccaggagtcagaggttgcagtgagctgagatcacaccattgcgcttcagcctggtgacagagcgagaatgtgtctcaaagaaaaagaaaaagaaagaaactctgggcataaggccaagttgtttaatagttttagttctattactattaactagtaatagtaactagttattaactattattatattatattatatatataataataatatatattatattatatataattatatattatcatattagtatattgatattaactattactataactagtactattaactagtaatattattattaaatagtaatatactattactattaaatagttttacttctattttttgtgtgtgtctgttttcccgcgttccccagttggttctgatgctactcaagtttgaaaaccactgatctaaactgtccccagtacatcaaactctgacaaaactctacccaaagcctacacatggcttcagtcttgaactggttgaatcgatggccacggtatgccagaagcattccctaaaacatttggaaattgtctttgaaggaggatgttcaagaaagtgaagtcactgttcttgagagtataacttttctgtgttagttttataaaaagtggtgagaatgacttactgtaggtctctgatttttataggtgtagcaagtgctgaatttcatcttcctgaaattaacatggccttattttcttagtgtttgcttttgcccatctttttaacctttctgtgtcattttgatttgagtgtgttgcttgtgagaagtatgtggatggattctgtttttaaactcagttttggagtcttcacattgtagcatagaagcctgaactgtgttaactgtgttcattgtcagagctaataaccactgtcctcactccagtcctagtttacatctcctatttgcatccttccttgccccttgttttgtttttctccgatacttcttttattggtttttatcttctctggtgatttggaaaagatacattttattaagttggtgcaaaagtgactgtggcttttaccattaaaagtcatggcaaaaactgcaattacttttgcaccaactcaatagttttagttctattacttttgtgtgtgtgtgttttgtttgtttgtttgtttcgagatggagtctcgttttgtctcccaagctggagagcgcactggtgtgatcgctgctcactgcaacctccgcctcccgggttcaagtgattctcctgcctcagcctcccaaatagctgggactacaggctgtacaggcccgccaccatgcccggctaatttttttgtttgtttttgtttttgttttttgtatttttagtagagacggggtttcactgtgttagccaggatggtctccatctcccaacctcatgatctgccctcctcggcctcccaaagtgctgggattacaagcgtgagccaccgcacccggccaactgttcttgtggtaatgagtaagtctcatgagatctgatggttttatgaggggcttctcctttcgtttagttctcattctctctcttgtctgccaccatgtaagatgtgccttttgccttctgtcataatcatgaggtctccccagtcatgtggaactgtgagtccattaaatgccttttttttttttaataaattactgaaattactcagtcttgggtatgtcttttctttttttttttttttttttttgagatggtgtcttgctctatcgcccaggctggagtgcagtggcatgatcttggctcactgcagcctccaccttccaggttcaagtgattctcctgcctcatcttcctgactgcttgggactacaggtgtgcaccaccacacccacttaatttttgtatttttagtagaaacaggattttgccatgttggccaggctcatcttgaactcctgacctcaagtgatccacctgcctcggcctcccaaagtgctgggattacaggtgccagccaccacgcccggcctcgagtatgtcgttatcagcagcatgaaaacagaccaatgcacacacctataatgattattagacttaactgttagagatttttagtgccagccacaagttctttttagtcaaaaatgttctcacttatctttcttcattttcattcttggtaggatgttagacttttttcctggaagagagttgatgtgactgccgcttacgcacaggaccaggaatagaaacagtacctaggctatttccatttccttttctctgtcaaaaaccaatttcttttccagaatccacagccaattcctcacaaagtggttgagcctagtcgcaaaatcagacaagacttctcacactgaaatgcgaaatatattcttttgcaaaacggcaccgtcccatgctctctgcatttccagacgccagtctacttctgtggctttactgacatggttacatggaatttttattttttattttttattttttatttattgatttatttattttggagacagagtctctctctgtcgcccaggctggagtgcagtggcacgatcttggcacactgcaacctttgcctcctgggttcaagcaattctcctgtcttagcctcccaagtagctgggattacaggcatgtgcccccacgcctgactgattgttgtatttttagtagagacagggtttcaccatgttggccagtctagtcttgaacgcctgtgtgatccacctgccttggcctcctgaagtgttgtgattacagacatgacccactgcacctggccaattacgtgtgatttaaatcccctccctgactgccagtgtccagatacagcctcagcccctctcagtgccaactcctccaggaagtccaccttcatttctatggagctgtaatctctccacagtccattcgtctgcatcacaactatcatttcctttgccttactagttactaaattctatatctctatcactttcaccagtctctgagctctcttgaattcttttttagaattttaagttagaatcttgtcctctctttttgtgtctggtctgtattgcatctagaaggcattcaggctgtttttgttttcataattgtgattgttgatgtagctattcaataaaatgaatgaatgaagttaattcaggatatatgaaaacatcacccataaaataataaaagagaaaggtctacagatagttcagcatgatatataaaaatcttgtagaaaaaccattatatactggccattaggcaatacaaattcagagaagagaaaaattaggacaaagtcattgcataacaccgccgtttaaatgtgaagaactgcaattttcccccgattatgtgagatcagtcctctgaggatgtcattaaggtttctggtatgtaattgaaaggagccctgagcctagagattccaagtcttcaactgcatgaagacctatttctcctcatttctggcctgattatcatcctatcctctgcaggctggcacggaaggctcacttcactctcgacttcaagacttgtgtaaacttttaactgtcttttctcactgtgctcatttcagagttggtttgttaataaatatttgccatctgtagcaaatcttaaaatgtaccaaaatcttaaaatgtctgcaataaaaagcaagacaagaaacttggcagtttctaagaagagacctttattttatacttaaacactggcacgtgtgtgtatgcgcacgcgtgcatgcatgtacacacccacacagcacacacgcatatacacaccatacacacacagtacacacacactgcgctctgtcatagagacacaccctgcacatttgcactcgcttcactacaatccttctgtatttatctatcttttctctactttggaaatacaactattgcaccaaggttttttttaaccaaaattccctccagttttgtccaagttatcaaggctgtcgtgtcaacccaaagggtcttggcaagcaagctacaaaatagagagcttgaaacttagccattccaggacagggagcttgtactttgcaatctatggtacagaattatcgaatgcctttggttttgttgttgctgtttttgatatcatcttgttttgttactatctaaaaagcagacaaaatgggctgggaattccctagttttcacaactgttttcttagctagaaggcttttagaccaacatagcacacctgcatctctgactttatcttccactgtgatgtcctgtgggctgctcccatctgggagtctgccattagatatggccagggctccaattttgtcataattacatcagcaacagcaaaattgagaagactgcatttgctccactgtgtggcataaccagtgaccccaaatcatggtggcctccccagcgtaaggtcatggttgcccatgttccatgtcatctacaggctacagacaacatcttgaggcagtaggctgtctgctccatgtgtcttctcatcctgggacccaggccaaagagtagtacctatggggtccatgctgttcttagggaaggggcaggagtaatcagagccaagccacaaaagtgtgcctgaagatcttgtttgaatgtggtctacatcacattcatcatatccagttggcccatgaaagttacatgaccaaaacgggtgcaccaaagtctcagaaatcaccactaaagaacttatctatataaccaaaaaccacctgtttctcaaaaatgattgaaataaagtaaaaacagagaaagcttagggagaagatgaataaaacatttttacagtggttaaaaaaaacaaaagttgaccgggtgtggtggctcatacctgtaatcccagcacttcgggaggccgaggagggaagatcacctgaggtcaggagttggagaccaacctggccaacatggtgaaagcccgtctctactaaaaatacaaaaattagccaggcagggtggcgagtgcctgtagacccagctactaaggaggctgaattgggagaatcacttgaacccgggaggcagaggttgcagtgagctgagatcacaccactgcactccagcctgggtgacagaccaagactctgtctcaattaaaaataaataaataaataaataatgaaaaaattacattaccaagctgaaggtcagtaggataggaaataacccaggaaagcaaggttgcaacaggaaggggatgaataattgtgttgaattaataccatctctctatgtttacaactccaatatcttcaagggatgggggggcaattagaaattctagtgaaattaggtaccaaatggtagcttccacacatagtaaggaagaaaatttggcccgatgggcgtatggataaattcatattcacctatttgtaaaaaaaaatcgaagagacttacagtcaaatcacagatgtataagatttaaaccatgtgacataattaaatgtacaataaaatgcagagttatttataaagtagatatataaagcttcagccatggaaacgacccacgtagccgtccaggtaaagggaaatgggataccaagcttccatttggtggcagtgaaatgtgtacagacatattaagagagacggcttttcccagctctgagcttcaagtagcattctttattttttctttgcataaagggattgatactttcagtagcagatgaggcatgcatgccgcatgccacatgtaactactctgtaagagaaggttgagtatgtactgttactgcacaactaggtaattaataacctgtgaattttagttatgtttacttcagcatttgctaagctaattgttcaatcaagaattcattgttacaaaagagttgtttaagtttgactcctgggcttttctagggaaagcttttaaagtctaaatacctagaaaatgtaaacatacttttgtttaaaaatagagattaattatgataatcaaagtggaagcatttaatgaaacaatgggctttatgattagaaaggtaaacaagaacacataattagttagttgattacttttccattttaaccaaggcagtgtctggctactcatccttttttccacttacctggtcaactgttgcctagtggacaaagttctggacccagggggcaagtcctgggtccctgctgtccctctagcacagttcatatgctcctaagtatctggattgactgaggttttgttttgagttgggtttatgtctaacctttttgatgtctattttgctggttaattgtgaattcatagtattcgtgtatgtctgtgcaacgcaacaacacacacacacacgcacacacacacatttacttctcctaaagacttttaaaggacgaatgttaggagataagtactcattttctatctcagttattcttaacgtgtagtctaggaacacctacatcagcagcctgggagggactggttgtcaacaccgattgcacaaaccttctaaatcagtgtcttttggagaggtacaagaatttatttatttatttatttatttatttatttatttatttatttatttatttttgagacagagtctcgctctgtcgcccaggctggagtgcagtggcgccatcttggctgcctcctgcctcctgggttcacaccattctcctgcctcagcctcccaaatagctgggactacaggcgcccgcctacaggcctggctaattttttctattttttagtagagacggggtttcactgtgttagccaggatggtctcgatctcctgaccttgtgatccgtccgcctcggcctcccaaagcgctgggattacaggcgtgagccaccatgcccggccaagaattttatttttaacaagctctccagttaattcttaagcacacaatgatctaggtcagcattgtccaacagaactttctgtgatgatggaaacacttcatataggcattgtccaatatggtagatacatgtggctgcatgaacacttgaaatatagccagcacaactcactgaatctttattttaattactttatatcaaaatgtatttttattaaaatatttttaaaccattttattgtgatataattgacatataaaaagtagtacacgtatgcaaattaatgggtttgaagataagtatatactcacaaaactaacaccacaatcaatgctataaacctatcacctccattatgcatcaattaaaaataatagtaaaagcaaaaaaaaagtatttacctgctccaaaagttttctccaccctcttttattattattattttgtgatgagaacacttaacataagatctacccccttagcaaatattcaattatacatacaatattattaactataggcgctatgttgtagctacatgtggctagtggctaccatattggatagtgcagagctagatgataattcagcagcagctgcacacatactagtagtagtaacaatagtgaaaacttgtatgtggcttgactcaggctttttaaacttactatgtgcctgacactattctaagtacttcctagatataaactcatttaaatctcacaaacttttaggatgagattatatttttgagacagggtctcactgtgttgaccattgtgttgcccagactcactgcagcctcaacctcccaggctcaagcgatcttcccacctcagcctcccaagtagctgggactacaggcatgtaccaccacttctggtttaaggcatttcttaaagatagtagatcagcggggtccggtcaggaagacagaagccaagctaggcatttcaaacagagcggaatgcatataggatattgattggttacactggcattgaaaggctgaaagagaaaaaggaatactgaggtaaccaagaacaataatgtaggaagcagcttccaatccctagggctggggagctgaggaaacagaaggaagttgaacacgggagggacctggaccaccaaggggtgttaatggcaaatgctcagtgcatggggaagccagtgtggttggtgccaggaacttcatgagttcccaagtactgggagcaccagaagctggagattagagttcttgtcttccttcacctcttgagagatgtagacttgagctgaagatgggaaacaagccctgtttccttctcctgactttgagtctcctgcttgtgcctcccattggcagaatctaattttatggcacacaacacccgcatagctcaatctaatcagaagctaatcacaaatctaatcagaatatataatcaggcacaagggtctggaaaatgtgtttggggacttcttgccccagtatcacagttcaaggtgtagaaagatgggcttggagctgaggagaagagacagatcatttgcacgaaattttttgataagcactttgtttaaagtaccatatgtctaaatgtattaatgatatcatcactttctgggctaaatagcatatgtcaggcagttcttagggagatgacacggatgtaagtgaccaaatcttgattaattgtcaattactgcagtcaccccagctaggttctatgcatagttatgcatgcatatggggacttcctccctactttgctaattggtctctttcctcatttgctatgaggcgctcccatacagttggcttgaagcattagaggctacactacgggatctgcttcttgccctttctctgagttcactcccatctgcagacctccaaatccttctactctcatgtggggaggaacaaaggaattaaaaaagtagatgctagaggagttatctcttgctgctcctgtttacaatttctgagcttctcccagtaaaagccccattgccttcctaggaccaccatttctcctcattttggtgtggattatacaaagttcttcatttttggagatggactggggagagtgtgtgccccacctccacctacaaaccctgcatgaggtcggagagtaataaatgctcatgtttctctttgactaaacactcagacgaagaaatttagaaatatattccttgataaaactgtgaattatctaagagaattgatcttcaccacatggcttaaaagtcctcctatggaggagaagctgaggacttgaggcaggaaccaacacaagttagtaatatggtgactagcttgtgcatttgttaaactataagggaacaaaaatatgttcattttccctgccagaatccataaaacaaacatgatgtataataaattaggaaaggaatcagagaagactatgagacgatgtattcttgcgtcttgcagttgataacaaccaaaacatttcctaaatttctggtttctgtagcaaatcatttcagagctaaaatctttccttgagatttcaggaagtaattctctttcccttgctttgcggtatctttccacagactctcatcctcaggagagatgctgagcaacatagttgattatcttaggattgagttgctggtgagagcctgttttccactttaacagctggggggcagaacaatatgcacagatcacaagtatgctcctggaagcttccttcatggaataaggcggcattatctctgtaccccattcccaaaggtctctaaggtgctataggttcgctttgcatgcttgttttgggtttctttgcatgtgctgctgaatacctagaggtttggcctagatctggttgctcacggaaagccaatcactgaaacaataagtattgccagggaagacagctgtaacacaggtgatgtcagctgggagatggaaggctgctcccaaatccatctccctaaccaactaaagtcaggggtttacatagcgaagaattagagaggggtacaggaagaggagctggtcaacagtcagcaggtggtcagatgaggggtctggcgtctctttaaatcatgtgtggcaaaacaggaattcggagtaaggaattgattaacaggcagttgtccagatgcggtaatctggtaagtttcaattccctgataccgtctgggaggcctgatggttggttttctgagaaagaaactcagataaaacaaatgtaaggtgttcgtctgttctcatgctactaataaagacatactcaagactgggtaatttataaaggaaagaggcttaattgacccgcagttcagcatggctggggaggcctcgggaaacttacaatcatggcagaaggagaagcaaatgtgtccttctttacatgggggtagcatggagaagtgtaaagcaaagtgagagaaaagccccttataaaaccatcagattggccgggcacagtgtgtcacacctgtaatcccagcactttgggaggccgaggcgggcagatcacgaggtcaggagatcgagaccatcctggccaacaaggtgaaaccccgtctctactaaaaatacaaaaaattagctgggcatggtggcgggcgcctgtagtcccagctactcgggaggctgaggcaggagaatggtgtgaacccaggaggcagaatttgcagtgagccaagatcgtgccactgcactccagcctgggcaacagagcgagactccatctcaaaaaaaaaaaaaaaaaaaaatcagatctcatgagaactcattcactatcacaagaacagcatggaggtaactgctcccataatttaattacctcccactgggtccctcccacgacacgtggggatatgacaactacagttcaagatgagatttgagtggggacacagccagaccacatcaggaagtttcttaagcttcagttctatgcaaaaatcgggccaattttacatgcatcttaacgtattgactctcacaatctcaggcatgttgtaagtgctaccatctccctttcttgctcacttcggagaactacacttctgtgatacggtgtactaggttcccttctatcatattcccagctggttgtttctgggagtttcagggtcttaaattctgtacaaagagaggagaatagtacatacaaccctcgtcccccaaagtagtaggagccaacatgcctagttttgtattttcttttgtgcctgagcctttggaccaatgggaagatgtgaggaagggccacgtggcttccttgtcatccttcaagaggacaaaaatgttgtgttttaagagggaggccacagttgtgtttttccatccattcccattgaccgtggttactattaaatagctatttttttggcagagtctagcaataggttgcctgaatccaagccttgtgatgatgagaaattttattttcttctgcattttcatccgtcttagcacctgatgagaaggtggcactggggctgctagccagctgcatctgccttctggatctggcacatgcagccctttgtttgctgtctctttgttccatgatgtgacccaggttcatgctccctgtcgatgaggacacccagattaaatatgtacagaaaaaaagagggcagtggaataaaatcgagtacatttcctataatgtctatgtattctcacctgcaaagtaaatgtacataaaattcatgtttgaggaccattaagttctgcttatcaacacaaagattgtccaagcaataagtcaactcacaatgtgatgcttccctctaacatatggcctgataatgactctactttctttgtctctggagtttgcatcaaacatctgtgttaggaagagtggctaacatgaaatccttggtcatgatttctttgtacctgtttattaagaagacagatgccatttctgggccaagtgtcaagatccaacagagtcacttggcaatttgactattggttggtaaacattaagcattactgcacctgaggctgagttccccaaggccatttaatttgtagaaataaatgcatttaatttccaacagttagaatttttgactctgtgtactgtaacactggagcggtgtctatataacaccgcagccaggccattatcagagcttgtttagtaataaaaatcaatgaattcagcctagcaactcattttatgactcaactgactatttgagtctgttttggcatttagctttcaaagattaaagaccaaatatcagtgactgttcatagcaaaaagactgtttatctacttcggtgactgctcttgtctctaagctccttttcccagagatgatttggcaggctcgcatttacccaggctctgatgatgcccctgcctttgggaggctcctagatctgggtctcaccttttctccaggcacagccaaggcagcctggctcagagacccagaccctagacacagccatggcctgggcattgttcagggctctcagaaagcagcaaggaagacaggtcttcagctttcaggagctctgtattagtccattttcatgtggctgataaagacatatccaagactgggaaggaaaagaggcttaattggacttactgttccatattggttggggaggcctcagaatcatggcgggaggtgaaaggcacttcttacatggcgatggcaagagaaaatgaggaagatgcaaaagcagaaagccctgataaaaccatcagatctcatgagacttattcactaccatgagaacagtatgggggaagctgcccccatgattccaatgatctccaactgggtccctcccacaacacgtgggaattatgggagtgcaattcaagatgagatttgagtggggacacagagctaaactatatcaagctccttgtagaatgggaacgacagcaataaagataagttccaagtggcttgatgtttcctcttaaaaggttaagtgatggcaaatgcccggcaagatctgaacttggaagatcaagattcctcacgttctgatgccacatagttaaccctatctcctggaaacccttccccagcccctgcacagggacctgtccccttgagtcactctgtatgccctgaacataccatgcgcattcaaacctccgttcctgcctctgtgaacccatcatccttctactgcctgagatgtcatgttcatcccattgcatatttgtctgcctggtgatggcctagttatccttcaaggctcatcccaagtgcctccacttcttcagctttctcctaaattgatctctcggcttcaggagcattgtttccatccatcgattttgtttcattttgcattgtatatcatagtcatttgtttatgctatagagccaaccatgaaatgtttaatgaggagaagtgtggcttaaatctctttgtgtcctccatgcctggtataatatggtagggtgaatggtggcccctgcaaggatgtgttcacatcctgattcccaagcctgtgactgtgaacttgtttggaaagaggagggcttcgcagatctgattgtttggaagtgggtggcggacggttagggggtctttgcagatctgaaggtcttgagataatgagcatctgagattgtttatgtgggccctaagtcagacggcaagtctccttataagatagaagagaggccaggcactgtgacatgcctgtaatcccagcactttgggaggccgaggcaggcagatcacttgatgtcaggagttcaagaccagcctgaccaacatggcgaaaccctgtctgtgctaaaaatacaaaaattagccaggcgttggtggcacgtgcctgtagtcccagctgctcaggaggctgaggcaggagaatcacttgaacccaggaggcagaggctgcaatgagctgagatcaaggcactgcaatccagcctgaggaacagagtgagacactgtctcaaaaaaacgaaaacaaaaacaaaaagttgaagagaaaaagacacagagacagaggagaaggccatgagaggatggaggctgggtttgggattatgtgatcacagatcaaggaattcctgtggccaccagagactacaagagccaagagcagattattccctggagcccatggaggaaggacagcctgcctacgccttgattttggactttcagcctacagagaactctaagaggatgcatttcagatataagccatccagtttgtgctaagtggtaaaggcagcccttcggaaactaatatatataacaactggcacaaagaaagagctcagctgttaactgaacgaacattgataattttgtacttagaacacttcgagtggttaaagatatttaagatgaaagagaaaattctaaatgtgtcttctgctccaattatgtttttatgagtccacttgaaaccctggaaggcagagcttgccacggctatttcaagcacccctctcctccacgaaagaggaaataacctcttattccatcagcccataaaccagcggcacgtggacgcaacatcaccccctgcacttcttgtcttcagcaagaatgagggcacggagaactccacttcaagcttttcagtcaacccgacgggacgcgacagattacagagcaaagtgcaccaaagataccatcagttaacctaataaaattgatttaaaagcttttaaacttgagagtgagagttcagtgcctgcgaaagatctttcagtcccttgaagtgatgaaataaaatgatcaatcgcccttatcaacctccctttttttggtaatgtggtggcaggaacagcttttccactgtcaaattaaccctcttttaaaagtgggtttctgcagcttctgctccactctctctgagctcaggagctgagcccttggaactcttatgtcctctgttgctggtctcatcttctattgaagggaggaagggaaggaggaaggagggaaggacggacagttggacggagggagagagaaaggaaggagggagggatggtgggagagagggagggagggaaagagggacagagggagggagagggagactcaggatactcaatgtttttggggggtttttgtttgtttttgaggagtctcactctgtcgcccaggctggagtgcagtggcgccatttcaactcaccacaacctccacctcccaggttcaattgattctcctgcctcccgagtagctgggattccaggcgtgagccaccgtgctcaactaatttttgtattttttggcagagacaaagtttcaccatgttggccacgctagtctcaaactcctgacctcaagtgatctgcacctcttggcctcccaaagtgctggcattacaggcatgagccacaccgtgcccagcctcaggatactcattggtttttgatccttcatgctctctctgggcgcttggcatggggagcttttcttggaggttgcggttattaaaatgccttttgaatgataaaaatagaaatgtgtttattgttaaaaaaataaaataaaggaacctattgagaattaattatataagctcaaaaccccttatctcactctcttcctttgaacagcttggtgtagagccttccagcccctgttgcttatgcctttacaaagatgtgtgtgcgtgcacgtgtacaggtacatgcactcatgaatatacatggtgccttcgacatcaatccaacacacatatttttccagcaaatatttttatagcacctccgatgtgtcaaactttgagtatgtcatttaaattattctgtaacttgtttttttcactaaatgcatcagagacacatatggacacatatctatttcaggagtttagtcccacctttttttttttttttttttttttttgaggcacggtctggctttgttgcctgggcgcatgatcacagctcagcagcctctaactcctgggctcaagcggtcttcctgccccagccttccaagtagctgggactacagtctggagctactatggtagcacaagtaggtactccagacttccaagtagctggaactttctgccccaaccttccaagtagctggcacttccaagtagccaccactcctggctaatttttaagtttttctttgtagagacaagatcttgctgtgttgccgaggctggtcctaaactcctgggctcaatcagtcttcctgcctcaacctcccaaagtgctgtgattacagttgtgagccactgtgcctggcctttttttttttttttttttttttttttttttttttgatggagtctctctatgtcctccaggctggagtgcagtggtgggatcttggctcactgcaacctctgcctctctgcctcctgggttcaagtgactctcccatctcagcctcctgagtagctgggattacaggtgccagccactatgcccggctaatttttgtatttttaggagagactggatttcactatgttggccaggctggtctcgaactcctgacctcaagtgatccacccaccttcgcctcccaaagtgctgggattacaggtgtgagccactgtgtctggtccatgcctggcctttttaacagttaaatgtcatttcgttcatctagtaaacaactatgtagtaagcacctactgtgtgtccccgtggtgtgtaggtgctgggcttacagcagtgactcagcagaacaaaggcctccatctccctttgtagagtattttaatcaggacctactgatggacactagggttttgtgttgtttttttttccaacaaatgaagcaactaatagctttaaatgtatattttattacataggtatatttatgtaataaatgggccacctccctaggagtagaagtgttctatttaatcctagagcatgacagtgttatatgtatgtaattcacaagccagagcaggagattcaaactgcccctgatgacagcattcaccagtgggccattttcttagttaacacaggatcagttaactctcaacagctgctttaggtctgcttctccctgccttagattaacatctgtgcttgcctgccctggattctttaagacacatcgaagagttatgctaaagaaacgatggccagccgggcgcggtggctcatgcctggaatcccagcactttgggaggtcgaggtgggcagatcacttgaggccaggagtttgagaccagcctggccaatatggtgaaacctcgtctctactaaaaaaaaaatacaaaaattagctgggcgtggtggtgtatacctgtaatcccaactactcggtaggctaaggcaggagaatcacttgaaccctggaggcagaggttgcagtgagcagagatcgtgccactgcactccagctgggcaacaaagcgagacactgtctcaaaaaaaaaaaaaaatgctgcgtatgatgggtggcctggccttatgtgtgctgggcctggctgaactacacttcccgaagcaggtggatcacctgaggtcaggggttcaagatcagactggccaacatggtgaaatcccatctctactaaaaatacaaaaattagccagacatagcagcaggcacctgtaatcccagctattcgggtggctaaggcaggagaatcgcttgaacccaggaggcggaggttgcagtgagccgagatctcgccactgtattccggcctgggtgacacagcaagactctgtctcaaaaaaataaacaagaagagaaaaaaaagaaaaagaaacagtgatcactggttttcagtgtggagagagaattcctctgcccccggcttcacctcatttcctttcagagacccccttccacctgtgtcatgccactaagccaccctttccctgattcctaacaatgtaaggagattggaactgaggctgggatgccttgctgttaatcttccagagaacccgatgcaatcaagttgcacgtctaaaatgaaaaaggaaaggacaacctcattgtaaatattattaaatcaccattcagttacttgcacatcgtgtctttctgaattactgctgctctcctaggaatacacacacagggaggcccatttcagagacgacgtcttatttaagcagaacagttgctgaagaaagagtatgggaatcaggcccgttcattcattcatatagagcacttgctaagtgaaaaaaccttgtgttaaatgcaggcgatgatacaaaatggggaataaaacagggatacgtttttacagcaggggaaccggatcgtgcaggtgaataaccgcaatagaaagtcaaatggaataaatgcctgagatgtggggaacaggcttgcttggagttcagagaagcagctgcaaacctccttttctgatttgcaaattaaatacatgtaacactgtcatgctctataattaaacagaacacttctaggaaggtggcccataaatatacttgtgtaataaaacatacatttaaagtattaactgttgcatttattggaatttaaaaaaaaaacctagaaaatccacttgctttgctgctgatttttctgcaactctaggagaagtcactcttcactaaaagataatgataatcgctgggcacagtaaccccagcactttgggaggccgaggcgggcagatcacgaggtcaggagatcaagaccttcctggctaacatggtgaaaccctgtctctactaaaaatacaaaaaattagccaggtgtggtggcacgtgcctgtagtcccagctactctggaggctgagacaggagaatcgcttgaaccggggaggtgggggttgcagtgagccgagatggcatcactgtactccagcctgagcgacagagtgagactccctgtcaaaaaaaaaaaaaaaagataacgataatctggaagcagtgatggaaattgtcagatgtggttggagtgggatacagggatttgcattctactttccttgtccctttgagaattaaaatatacagcagatattttgcaagcagatttaccccgactccttcagccgaggttaatcaatccacaacctcatcagatttaagatcccacctggcagatgtgttgggggtcccgataacttttaaatctgagctgtaagactgtagaaatcaaacctgtttggtgtgggagggcttctcaggaatagggagcttgagtaactttagtgtttagtttgacctttgttaaaaaaaaaaaaaaaagcccacacaccaaaagaattttattttttcttgtctttgatcagagaatttcagtaacccatgtttgagttatggtttcatttcatggctgtgaatatgtttctcatcttgtgccctgcctgtgaaattgaccctgacatagttcccatccaagttatttttccctaaaatatgtaggaaatgaataatgcattgttgattattctgttaccaaacaaaagggtcttgcttcccaatgtgctagaagccaatattatgacactaggtttttgagaaaaggacagctttttattgctagtcgactaaccaggagacaggagtccagctcaaatctgtctctctgtgctggctttaaggcaggaattttatcagaaaacgtttagcatctggattccgagatttgcaggtgattggtggaaggaaaagagagatctggaaagtcctcggacacatacagttatctcttcatgcctcctcatgggtctcgtgcaaattcagggggagttagtatgaaacatgcctggaaatccaggctgtgatatccacaagctcattctgtgcaaaatcctgttggccatattgagtctaactgatttcagccagttttgttatcttacaagcagagggagttgcagcgtttcagcaggttttttttttttttcttatctgctgtcctgcaaactcaagaatttctgagagttactggcttctttaactttttctttcttcctttctttcttttctttcttttttttttgagatggagtcttgttctgttgcccaggctagagtgcagtggcatgatctaggctcactgcagcctctgcctcacagattcaagagattcttctgcctcagcctcttgagtagctgggattacaggcgcatgccactgcacccagctaatttttgtatttttggtagagacggagtttcaccatgttggccaggctggtctcgaactcctgacctcagatgttccacccgcctcagccccccaaagggccaggattacagatgtcagccacctcacccagccttttaactctttgaggcttgatttcttttttctttttttttttttttttttttttgagatggagtctcgctctgttgcccaggctctggagtgcagtgatgcaatctcagctcactgcaagctccgcctcctgggttcatgccattctcctgcctcagcctcccgagtagctgggactacaggtgcccaccaccacgcccggctattttttttttttttttttgtatttttagtagagacggggtttcactgtgttagccaggatggtctcaatctcctgacctcgtgatccacctgcctcagcctcccaaagtgctgggattacaggcgtgagccaccacacccggccaaggcatgatttcacgcctaccctaaaggataaagtctgcaataataggggttagttctgagaactggctgcagctagcaatctattcttttggaacccagtcttttgcctttcatcctctgcaagtgcagactcaatcaacctaagcagatagaggaggctctccaaagcccaggatagaaaatagctttcttgcctggggggagtagttgacttcacacttcaaaaaatttctagaagtttttagcatcgcagttggcatctctctttcatcaaggtgaatatccatcaagaagggatgcagtagagaggaaactcttggattctgaagattccatctcattttcagcttcatcatggatgagctgtatcattttgtgcaagtttcttacatctttctgagctttagtttttttttttttcatctgtaagataagtaatttaatacctgcacccccatcacatcgggatttttctggggatcaaatgcgttagataaattaaacttgaaagctttctttacaaattatttgaatgtagggcatttagtaattctcactactgttggcaacagggagaaattggcaagtttctagtggctggctggctagggtttgcatatcagaatccaactttcatattttatatcgttttcatattttccatctctttaatgcactaaagggtaatctcattgaacttatctctcgtcccctctgtttttctcctcgtatgtataacctatttgattgcttgctgtgttgtaagctctaaagactcttcatttctagaagtttcacttggctatttttcacatctctctgtttatttttcacaaggttttgttcttatggtttttgactcctatttttaggtttttactcgttttgttgttgtttcggttttttggtttgcttgtttgtttgtttttgacaaagtcttgctctgtcacccaggctggagtgcaatggcatgatcttggctcactgcaacctctgcctctggattcaagtgattctcatgcttcagcctcctgagtagctgggattacaggcacgtgccaccacgcctggctaatttttatatttttagtagagatggggtttcaccatattggctaggctagtctcaaactcctggcttctagcgatccacctgctttggcctcccaaagtgctgggattataggcatgagccaccacagccagcctgatttttactcattttgaacattcgtattttatggtgtctgtctaatggttctattatgtcaagttcttgagagttctaatcttactgtatttgctgagtcttacttacagtggattgtttcctcatgtgtttataatatctattaagagctcatctttgatggagcttcagctatgaaattctgggttgtatgtggatttctccggtaagttttctcatttgcttttgctcatcactcctaggtgtcatcttctgaggctactgtgcatgtacatttctaggcttgctgtttcctgactatgtacctaatgtaaattgaaatctggccaggcacagaggctgatgcctgtaatcccagtactttgggaggccaaggcaggaggattgcttgagcccaggagtttaagaccagcgtgggtaacatagcaagaccctgtctcaacaacaacaacaacaacagaaatctcaaaccctcagggacaggtcattatgaattcttgagggacactttttttttttttttttgagatagcatctcaccctgtcacctaggctgaagtgcaatggcacaatcatggctcactgcagcctcagcctccctggctgaagcaatgctcccatctcagcctcctgagtagctgggactacaggtgtgcaccaccactcctggctaatttttataatttttagtagagatggggttttgtcatattgcccaggctggtctcaaactcctgggttcaagtgatccttccaccttggcctcccaaaatgctgagattataggcccaagccactgcgcccagctgacaactttcttttatgcccagcgctcaagaagagacagacaggtttccttgtgatttatgattagagtagattttctgaatgcaagcagcctgtgtgatcaccatctgaacgtcaaagggattcaggtttgcattttcatagctgtgttagaacaaggtactcaacctttctgaacttcagtgtttccaactctcaaaagcagatactcttactcacctaaaagcattgctgtgagaatgaaatgggatcctacatatatatgaagttcatggccttggacctgcggtaaagggaatggtccataaatggtagctgttcttggtcttcccatttcagagatgagaaatctcagaccctggaagtcatggtaccactgggcaagggcaccatggttaggccattagcctcctctcagaaactcttttatgggtccacttacccactttcctgccttgaaacaatagaagaactaagggttttatctttatcttggttttttatttcttaaattctgtttctttggttttcttttttcttttttttcttgagacagagtctcactctgtcgcccaggctggagtgcagtggtgtgatcctggctcactgcaacctctgcctcctggtttcaagtgattctcgtgcctcagcctcctgagtagctggaattacaggcatgcaacaccacacccagtcttattattattattattattatttttgagaaggagtttcattgtgtcacccaggctggagtgcagtggcgcgatcttggctcactgcaacctctccctcccgagttcaagcagttctcctgcctcagcctcccgagtacctgggattacaggcccctgtcaccacacctggctaatttttgtattttaattgagacggggtttcaccaggctgatctcaaactcctgacctcagtgatctgcctgccttggcctcccaaagtgctgagattataggtgtgagccactgcgcccggcccagctaatttttagtagaaatagggtttcaccatgttggccaggcgggtctggaactccctgagctcaggtgatctgcctgcctttccctctcaaagtgctaggattacaggtgtgaggcaccgcacccagccttaaattctgtttcaaacttaagcccggcctctggtttcagcctgcagcaggagtgaaacccgcactgagagaggagagactgtcactattttcattgataatgaaagcagttttctaatgatagaggaagcacaataaaagctatctcataaatggcttttattacccattgtctagtctttcctaaacaataggttattagccatatgtaatagggattgaagctaattgttttccttatttttcagataaagaaatgagttgtacacagtgatttttttaaggacacttatagcactaatattgtgtgaatcgatttagttgagagccatgtgagagagttaaaagttcatagaggagttgggtgcggtggctcttgcctgtaatcctagcactctgggagggcaaggcgggtggattgcttgaagtcaggagttcaaaaccagcctgaccaacatggtgaaaccctgtctttaccaaaaataaaaaatttttttttttaaaaattagctggtgtagtggcgtgcacctgtaatcccagctacttgggaggctgaggcaggaaaatcacttgaatcaggaaggtagaggttgcaatgagccaaaatcgcaccattccactccagcctgggcaacagagcaggagtctgtctcaaaaaaaaaaaaaaaagttaatagaaactgggtgctttgttcatctctttgttttcttgagtggttgagatgcattcctgtcacactgtgcccccaaatgacaaggacagcaatctttttttatgctttcttgcccatgggttacaggggtttggccttgtggccatgggccacaccatcttttcttttgttgggaggagggaggaaactggctggccttagagttcaacattgacaatctggtagaaggtaattgaatcatggtggtaggtttctcccatgctgttctcttgatagtgaataagtctcatgagatctgatggtcttataaagggcagttcccctgcatacactctcttgcctgccaccatgtaagacatgtctttgctcctccttcaccttctgccacgatcgtgaggcctccccagccatgtggaactgtgagtccattaaacctctttgtctttataaattattcagtctcaggtatttcttcataggagtgtgaaaatggactaatacagtgtcctgtctcttcttcctcagagcggacacctccagaaaggaatgctttcattaaggaaaaaggcagccaaaatcctgtttccatagagtcttgtttaattctttgtgttacatctccatgtcattatcaatgaatcagcctccagtgaaataactgactgcacttgtggtttacgtcactgagccaggaagccagggagtggggtgtgtgggagaaacagctttgcttctgagcctctgggggttatggataggaatgccccttgccagctactggacctggtactgtggtggcctctgtgtatatccctcagtgtgctgtgatcttcaggagggaagggatgatagagtccacgtttcagctggcctttctattactcgagcagagtcgccagtctttctggatatatgttcctttgttgacttgtttctggaatggaattccataggcttttagacctatatggcttgaagaggtgataaaagaaggcatctacaagaccattagaaaagatcttggctgggcacggtggctcattcctgtattcctagcactttgggaggcctaaggtgggaagcttgcttgagcctaggagtttgagaccagcttaggctacatagtaagactctgtctctacaaaaagtacatgagttagcctggcatggtggtgcatgcctgtagtcccagctacttaggaggctgaggccggaggattgaggattgcttgagcctaaggagtttgatgctgcagtgagctacgatcatgccattgcattccagcctgggcaacagagcgagactctttctcataaatagataaataggtagatgaataaatatattacaatatacattaagacttcatgtaagtttcattataccgaaagagtaattgtttttttctccttgagttgtgttagaaaaagttcttttctgttatcacagcttagtatatgccaggcccaggagggaatggggtcataccaagcccctggaagaattttggaggaaaaagaatcttgttctgtttcatgggtcttctgggaatgcagaagaggaggatccgagggaaaggaggttctgagagaaagtagattctctccgtaaaagcatccagagaaagcgtgtggctttctcagctatattctgaccctgctcaagtaataaccatgtttcaacctaaaaccgtctcctgcttgtctttcaatgcacagagctcaacatactttaaagacagaataattagaatgtactatgtacaaaataactactagctcagatgagtcctgccccaatttaaaattgagaacagtgagtgctagtgttatgtttttaaatgaaactaagcaaaaccacttcttttctgattataaaagtcaacaggttcattgtaaaggcatgggaaaaaatttaaagaagaaaataaaagtatcccacaaccttacaacctagaaataatgataggtaactggtttagcatattaccttttattgacctgtatataaataaatattgggtcatacatagctatgattgtgttttgactttataactagcattattacatgagctttttattatatcattcagttgttttttgtttttttgtgtgtgttttttttgttcttttgagatggagtctcgctctgtcccccaggctggagtgcagtggcgtgattttggatcactgcaacctctgcctcccgggttcaagcaattctcctgcctcagcctcttgagtagctgggactacaggcctgtgccactatgcccagctaatttttttgtatttaatagagacaggattttgccatattggccaggctagtcttgaacacctgaacttaagtgatccacccacctcggcctcccaaagtgctggtgggattacagacgtgagccaccatgcccagccttcattcagtattctttatatgatgttttaatagctgcattcattttatcatggactgtgccaaaatatacttaattatatcccaattgatataaatttagaagattttaattttttcattatgatcgataatattttgatttaaagttttgtacaaaaactttttttaaatctctgattttttttatttcctcttctggctttttacaagattttgcctttgtttttaaatttcccattatgatgtatctaaggatagatttctttttatttgttctgcttgagatttgttgagctttgaatatatgtgttcatttccttcctcaattatgggacattcttatctattatatcttctaatatttcttctgccctgtttactgtcctctgggatttcacaaactggtgtcagatcttatcattgtattatttatgttgcctaccctcttttatttattcttcatctttttctccctctgtgcttcattcttcatagtttcttctgtcttagcctctagttcattaatgctctcttcagctgtgtctaatctgctgataaatgatccactgagttcttaatttttgaactttttgattttagatttttctctttttcctttttcaaatatgttgtgctactttttgtgatttccagtttcctgccaaaaattttaagcttgctttttaattttcttaagcacagtaaacatagatgttttccaataagtctgatagttccagtatctggaagtcctgtgcctctcttttgttgtctgttattttcatgcaagtctaacttttggcctcttgattcctaatgcttttgattgtctttgattaggtgttagagatgttagctactgtgtttgaaaaagttatgtatagcctgggcaacatagtgaaatactgtctcttaaaaaaaatacaaaaagaaattagccaggtgcatggcacagacctgtagtcctagctacttggaaggctaatgcactggagcctgggaggttgacggtacattgagctatgatcacaccactgcactccagcctaggggacagagtgagaccctgtctcaaaaaaaaaaaaaaaagagagagagagagagcgggaaagcaagagttatttgtcaagttaatttgtaaccgaggacggtgttacctgcctctagtgagaatttttgtttacttctgccaagagcacaggagtgctcacagcctctgattcccttaatggaaatgcaaggtgtgagattttctgggcttcccagaggaaatgaagtgagcttgcagtttgggagagaggccaggttgactttcaggttgctctttttatttatttatttatttatttatttatttatttatttatttatttattttgagtcagggtgttggtttgtcacccaggctggagtacagtggtgtgatcttgggccactgcaacctccacctcctgggttcaagcaattctcatgcctcagcctcttgcatagctgggactacaggagcatgccaccacacttgtctaatttttgtatttttagtagagacggggtttggccatgttggccaggctggtcttgaactcctggcctcaaacaatccacccaccttggcctcccacagtgctaggattacaggcgtgagctgctgtgcctggcatatagcacttgttatatgctaggaaggcactttacaaattctgatacttttagttctcctaagaaccttatacagtaggtaccgtgcctggctgtgactcttttttttttttttgagatggagtctcactctgttgcccaggctggagtgcagtggtgtaatctcggctcattacagtctctgcctcccagggtcaagtaattctcctgtctcagcccccctcgtagctaggactacaggcccgtgccaccacacccggttaatttcttgtatgtttagtagagacagggtttcaccatgttgtccaggctggtctcaaactcctgaccttaggtgatccgtccgcctcggcctcccaaagtgctgggattacaggagtgagccactgtgcccggcccaccaggttactcttaagggcagactttttgtattttagccaaaaatgaagggtggtttaccaggttgcccattattagtgggcactgaaacccaactctcggctttctggccttttgaggtggctagaagtgcaacccagcctctcagtcccgctttatggactggaacacacctcaaggtagaaggaaacccagttgctgggcatctgtctcccttttctagtctcggccagagttcaacctaataattttcattttgttcatctacagtggttttattaagatcaaaaaattttatccaggctggtgtggtggctcatgcctgtaatcctagcactttgggaggccaaggtgggcggattgcctgagctcagaagtctgagaccaccctgggcaacatagcaagactttctctcttaaaaaaaaatgcaaaaattatctgagtgtagtggtatgtgcctgtagtcccggctactttgggggctgaggtgggaggattgcttgagcccaggaggttgagactacagtaggctatgttcgcaccacctccctccagcctgggggacagagcaagaccttgtctctttaaaaaaaaaaaaattttccagcttttttagtttttttaggctatagagttggtccaaattacatcatctgacagtctcagaggcagaagtcattattatcctttatgataaattcctaagagtagaatttctaggtctaagacatgtttatttttaagacttacgagacagactgccaaattactttccagaaaagttgtttttcatattgaatccttgttctttttcttcccttctcctaagtatctgttggtgtctcaaagttctgttcattcttctacagtaatttaaaacctgtaacacaatttaaattttagttgcaagtcagatgtaagaaagggtgactttatttttccaaataagaattcaacttgctctccagccctcgtgttcactgatgatggaaaagaaaactaatctttttgtttcaaggtaactcagtttcttcccattgaaaactccatctctttcaggacaattgctccattaaatcaagattttgacaggctgttatttgttaagggtcgctcttcccccttgaaagttctccctctcccagctttcctcttaaatagtgcctggaagcaaggggagctggtgctgccttggggcaacgagagaggtgtctgggctgcgcctgtcttctgggacctttctggcttctgttgacacctcccaatcttgagttttgtcccttctgtattcatagccgatgcccttggccctgcttctgaacttcaggcaagatatccacccagtgggtaccctcctgtcccctgactccctttgtgaaccaacctgtctagttctttgcttcctgatatggtttggttctgtccccacccaaatctcatcttgaattgtacctcctgtgtgtcgtgggagggacccagtgggaggtagttgaatcctggggacgggtttttcccatgctgttctcatgatagtggataaatctcgtgagatctgatgggtttatgaagggcagtttccctgcacactctctgttgcctgccaccatgtaagacgtgactttgttcctcctttgcctttcgccatgatggtgaggcctcccaagccatgtggactgtgagtccattaaacctctttcctttataacttacccagtcttggggtatatctgtattagcagtgtgagaactgactaatacacctccccttcgcctggggtactcaggaacttcaggatttcctacaggccaggagctggctgtgggcatttagagcattattttaggtcctctctctgcctaaacatcactccaccattcctgccccactgcccatagcacgctgcaagacaattgcctcccgccagagtgctaggcaggaagcaaaacatccatctctttgccttcccatcctcaaacccatttgcagatttctgtacccactccctgaattccaacgtgagcagtagggtgaggctgaaactcccccaggagagaccttctcttatgtctgtctcttctgtctccagacttattccccagcccagggagaattagcttctgtgtgtgtctgttttgcattgctctaaaagaatatctgaggctggataatttataaagaaaagagggttatttggcttacggttctgcaggttgtacaagaagcatggtgccaacatctgcttggcttctggtgaaggcttcagacatcttcagtcatagtggaaggggaagggggagccagcattacgtggtgagagagggagcaagagagacaagggaggtcctagagtcttcgttaacaaccagatcttgctgaactcattaccacagggaaggcaccaaaccattcatgaggggtctgccctcatgacccaaacaggtcccatcaggccccacccacaactctggtgatcacatttcatcatgagatttggaagggactgacatccaaattatatcagtcttttggggcactggaactttcccatatgtcagtacttctcaaccctgattgtgctttagaatcaaatatggatgtcgaccaatcaaaccagtgtctgggagtgtgcctgaacagaggtcatttttcaagattccccaggtgatcctaaagtgagccagcagtgagcccagcagctttgtcttactgaactcattaccatggggagaacgccaaaccattcatgaggggtctgccctcatgacccaaacaggtcccatcaggccccacctataacactggtgatcacatttcaacatgagatttggaagggagaaacatccaaattatatcagccttttttggcattggaactatcccatatgtcagtgattctcaaccctggttgtgctttagaatcaaatatggatgtagacccatcatcaaaccagtgtctgggagtgcacctcaacacaggcaagttttcaagattccctcgttgatcctaaggtgagccagcagtgagccccacggctttgtcacaaccgccatcctctggcttcaccggtctgctgtccttaatatctaaagggaggcttttggaatttagcaaatgctttctgtctctgatgcacggctcgtgcgcttgaaatccgggcttagggactattgcttcagcagttaacgtcaggaatctattttatagtcacaacagaaaattaacatctcctttgcttttctttctatctcagctctgacagtcttcccctagatcaaggctaatgactgcctctggatgagatggcaagtccagcatagaaaaagcccattcataagtttcaaaataaattattatactcttttatttgactactttcttacaactattttgctgctactgtagcccttaaatacgcaaggccatcagaaagctgtcttcttacctgaatctcatttggttccgagaacaattgctgtcacctgactgtccttgggtaaacatcataggccaatgctgagaagtgttttaaaaatcagatttgtggagcttattgtatttgctgaagtggtgttaaggagacttggttaaggagaccaagtcactcagtagagaaatttctcttgggtcttagtgatcaagtaactatctttctcttattaaaaatcttttagacactgcagatccagccaacggttctgtctacagtggggatgaaagagcttggagctgagtttgtggcccactgttattaaatatgtaatatgtcagagcctgcattttgtctgctaaactcaccctcggcatcatcttttttatttttttattttttgagacagagtcttacttcatcacccagggtagagtgcagtggcgctctgctctcggctcactgcagcctctgcctcctgggctcaagtgattctcctacctcagcctcccgagtatctgggactacaagctcgagccaccacacccagctattttgttttgttttgttttgtttagagacagggtttcaccatgttggccaggctggtcttgaactcctgatctcaggtgatccacccaccttggcctcccaaagtgctgggattacaggcataagccactgcgcctggcccccttgacataatcttattttgctctttgtcctctaattcccaattaattatttttatttttaacctttttaaagtgaccggttctttctctgtggcccaggctgtagactcctgggctcaagcaatcctccctcctcagcctccagagtagctgggattacaggtgcacaccaccaaacccagctaattttttttttttttttttggggagagatagggtctctctatgttgcctcactggtctcaaattcctggcctgaagcagtccttctacctcagcctcccaaagctctaggattacaggcgtgaaccaccacatctggtattaattactttcttttcattttgttttatcccatagtgcctgcattgatataggatgtcctaaaacattctcagaaaacttctccaccatgcaaaaatctcaatactctttctttctttttggaaccctgtcagtgttgctagcctgatgccattctcgaatgtacatcctaaagcttttatcaaagttgttcttgcatcagccctggaagttgaagagggattattgccctccttttacagatgaagaggaggctgatccatctttcaagactttctcttcacatgagtccccattcattctttcaaagttaccttcctagctgggtgcagtggctcatgcctgtgatctagcaatttgagaggctgaggtaggtggatcacctgaggtcaggagttcgagaccagcctggccaacatgatgaaaccctgtctctaataaaaaataaaattagccaggcccggtggcgtgtgcctgtaatcccagatactcgggaggctgaggcaggagaatcgcttgaacccgggaaatgaaagttgcagtgaaccgagatcgcgccactgcactccagcctgggtgacagaatgaaactcttaaatacccgggcgcagtggctcacatctgtaatcccagcactttgggaggccaaagcaggcggatcacttgaggtcaggagatcgagaccatcctggctaacatggtgaaaccccatctctactaaaaataacaaaaattagccgagcatcgtggtgggtgcctgtaatgtcagccactcaggaggctgaggcaggagaatggtttgaacccaggaggcagagattgcagtgagctgagatcacgccactgcactccagcctgggccacagagcgagactctgtctcaaaaacaaaacaaaacaaaaacacaatcacctttctgccagtctctcccagtccagagactgtactctcctccacggcttcatcttctagcacagaggttggtgaaatttttctctgattggctggatagtaaatccaggcaaaatcaaggatattatgtgggtacttataaacaaagtgcaaaacctgatttctacaaatattttattgacaaaatccaaaatgtaacattaatgagtctaggttttttttttggtaatctgggtctactaatgagaacatttgaattttcgtgtgtacaggtgacatgttgctttgtttaggttcaaagttagtgttcccatcatcatcatcaaatcagttataagtgttcatctgttaaaaaaaatccttaattctctggccagacaaaaacaggcagtgtagtttgctgatgatgcctgttctagacctttctctttttcttttccccaaatgttcactcaaccatgtctcatctcacaagatagctaaccagacactttaaaatatatatacacagtatatataaagtgtcgatggctgacaacagcttaatgtgtcaccacttcttaagaagcatagtgcatttacaaaaacactcttccaaggcttatttgcaaatcagtttctcaaagcttcaaggaaatatgattaccaaaaagtaaaagtattatcccgagaaaattgcttatagggaatatcttactagggagtttcgatgtggatctttgttttaataaaacaagcccagacagaaatcagtcagccaaggaaatgagttttgagactggcaacttcagtcaccactggcgtttttttctgcatctgtgaaaattcacaccccacagagatgaggcttcctttatcctacaaaaggaaatgctcttaattccttgacagttccctttccaatctgaaggaagttgttgtttcagcatgaattatcttttcagcaacaaaggtgaaagtgctacttccacttaaaggcaaagcactggcctttgggtcctattttcttgtgagattatttgtgagctggatgcagtgtttgattgttttaaaaggcagccgacttgtccttttggtatttatatgtatagcagaggcaattggaactctgggcattaaattaccgtaatgtgccagttgagaattctattcaagccagccaactccttcctcaaaattatatttttagtgtttagcagctgcaagttcccagaaatcttcaaagtgggatcacttatttcacccagtgcaagagctcttagctgctgccagtgtgagatgatctggtctgggaggcagttgggtacctgggaggggcgagagatcagaggccccctgggttgcccttagttctgcacttatttgcatatgcttccccttggtcaggttactgaacctctgagcctcagttggaaaatggggctaataatatctaccaaatggagctgctttgaggattcaaaataattatgaatcaaccaggcgcagtggctcacagctttaatcccaccattctgagaggccatggtgtaaggatcgcttgaggccaggagtcggagaccagcctgggcaacagagtgggaccttgtttctaccaaaaggaaacaattcgcagggcatggtggtgtgtgcctatagtcccagctatttgagaagctgaagtgggaggattgcttgagccgggagatcgaggctgcagtgagccgagattgcactactgcactccagcttggagtgcaggttcttttttctgtcttatgtattaaaaagaaacacattttcaacattaaaaacaaaaaaaaaaaaatcagccaggcgcggtagctcacgcctgtaaatcccagcactttgagaggctgcagcgggcaaatcgcgaggtcaggagttcgagaccagcctagccaagatggtgaaacctcatctctacaaaaatacaaaaaattagctgggtgtagtggtaggtgcctgtaatcccagctactcgggaggctgaggcaggagaatcgcttgaatccgggaggcggaggttgcagtgagccaagatcatgccactgcggtccagcccaggggacagagtgagactccatctcaaaaaaaaaaaaaaaaaaaaaaagaaagaatcacaaattgtcctaaggtagcagcagatgcattgagatgcccagtaaagggtgctgttggtctcagtgatgtgctcctatctcattctcctcctccttccctgcctggtcttttggccaccgtggcttaccgttatccccgcaaaacaggatccatttgcttggggagtaacaagcaactccccatgagaacacaggctttgatcaatagggaattgatcacttgtcacaaggaaggagagcatgggagtatcctccaaagcagtgtctcccgtgggaaagtgacaggagggttttatggaatgatggagaggggagagggtgtgtcatcacatgcagaggaggggtcctagtggcgcaggcacagggagccatcatgccttcgtgccagcacccaggttgcatgtgatggtaacggagctgtagctctctttagcaccgtcatgagaaagttcacttgagttcatctataaatcgctgggggaggtctgtcaggaggcggtgttaaccaactaggtgaccatatagggtttaggaagaaacaggcttcagggcaggagcctgtaaaacaggctgattgctcaaattgagcacattcctataatccctggagaccctgcctgtttgcttacaatactggtgcctgtgccagtgggtatagattggatgtgtgatacaaccaaagaagggcaacatctgcattggacatttattctactgtattaggagatggtgtaaaagaattcaccgttgctgatgtaacaaaatgcactgaaatgagtgaatttgtttttgtttttgttttttgagacagagtctcgctctgtcggccaggctggagtgcagtggcatgatcttggctcactgcaacctccacctcccgggttcaagcgattcgcctgactcagcctcccgagtagctgggaccacaggcacgcaccaccatgcctggctaatttttgtatttttagcagacacagggttttgccatgttgcccgagctggtcttgaactctgacctcaggtgatccgcccacctcggcctcccaaagtgctgggattacaggcatgagccactgcacccagcctgaaatgagtgaatttgcattaaccaacctactgattgccaaagaagttggcggtactacgaaaacactcagtactgattataccttgagggttggatttgcagacattcataccaggacaactccaggggtgaggatgagtgttttgcacgtgggaccttggaatgagaaagtgcttagcaaacagctgaagcagaactaagaccaaagaaaacggcagcctgtttgagtctgaggtcagagaaaagcagcaagtcccagcaggccagtgggaatcaggaaatagaaaatagagtcagcccctgatccctgggtcaggaaccatcatcatgatagaatttggagatatggctgccagagaacagagaccaacgggtggctggggtctaagagaatgtcaagagatgacaggtgtcagggaaaagcaagggtaagacatgacaccaccaggacttgtgcccaacaggtgactgagacagcgagccacatggtgacaagcaggcatccaagcgggagaatgtcaccaaacaggggaatgaggggtgggtggaagacactggtccaaaggggctgccttctggtacattctggagatagacactcccctgatttacaggctatggatcagcagattttgttttgttttttgtctttttttttttgagatggggtctcgctctgtcacccaggctggagtgcagtggtgcgatcatagcacactacagtgtccaactcccaggctcaagtgattctccagcctcagcctcccaagtaactgggaatacaggtgcgcaccaccatgcctggttatttttttaaaaaattatttttggtagaaatacatagtctcactatgctgcccggtctgttctcaaactcctggactcaagcaatcctctagccttggcctcccaagtgcaaggattacaggtgtgcaccactgcatctggttcacagtctctggtttctagctccttcttttctctccaccactggagcctgctcttcccatacctacagcctcactcattgatgtacaacacagggacacaagccttcaaccagaaatcattattattacattgtaatatataatgaaatagttctacaactcaccatcatgtagaatcagtgggagccctgagcttgttcctgcaactagagggtcccatctgggggtgatgggagacggtgacagatcatcaggcattagattctcataagcagctctcagcctagatcccttgaatgcacagttcacaacagggtgtgcacacctatgagaatctaatgccgctgctgctctgacaggaggcagagctcaggcggtaatgcgagtgatgggaaacctcatctgtcagtacagatgaagctttactcacttgcctgccactcacctcctgatgggcaacttggttcctaacaggccatcaactggtgctggtccatggcctgggggttgaggacccctggtatagagtagccaggcgaaaggatctatagggttgatggctggaaaggaattaagagaggcagagatgccaaggaagaacttgtacttaattcagaagggaatagtgagccactgaaggctttagaggaggggaagcatctagaatgaagatgagtcctttttcacctatgaaaagaaaacacaatgagctcaagaaagctgtatatgtcttggtgcaaatatcgggctgccaccctcttctcactgtctattccttttctgtcattcagttggaactgttgtgtgtgttgcatatatttctgtaacagcaccaataagtgattatttttaatttctgttcttctcttctgtaatggagctattaggctttggcagatcccttaatatgattatcatttttgaatgattttgaattgaagtgtttgcactcatggtcgtaatcgcagttgactttgaaggatgaggctggagactcacgttctctgatctcttcagcccgcaagtggtatcaactgcagcttccacagctgggtaggtggtggggacaccttggaagggaagcagcagccgtgctttgctcctgattgtcaggatgaagtggctggcctgccactcacgaggcaggtgccagatgggatgggtggtagcttcctgttggaggactgcccctccccagtcagaggacaaggacagctcctcgtttatcagtccaggcaggtagctccagaatacaaagcaggtgcccactgagctcgccagcaacgctgactggcctgtccatgggcagatatgtcttttttttttctttttaaatttgttttgagacagggtctcactctgtcacccaggctggagtacagtggtgcaattgcagcctcaacctcccaggttcaaatgatcctcccaacttaggctcccaagtagctgggactataggcacatgccgccacacctgactaattttttatttttcatagagacagggtctcgctatgttgcccaggctggcctcaaactccttagctcaagcagtcctcccaccttgacctctttaaagtgctgggattacaggtgtgagccaccatacttggctaattttttaattttgtgtagtgatagagatttttgtactttttgctttgttgcctgagctggtctcaaactcctgagctaaagcgatcctcctgtctcggccttccaaagtatgaggattacaggcatgagccaccctgccagggtgatatgtcctttcattatttaatgtcctccacaatgatccagttagacattagccacgtggcaggggtcttgccagctcccagcactatagggaagacttggtgtttgcagaacagaggctttctgcttctgcttccagggagggtcacctgctggggccagttccagcctctcctttccagcctctgtcaggctctgtaagcagattttgatcgtgacgggcaattttctttctttttttttcttttcttttcttttttttttttttttttttttttgagatggagtctcactctgtcacccaggctggagtgcagtgtggcatgatctctgctcactacaacctcctcctcccaggttcaagtgattttcctgcctcagcctcccaagtagctgggattacaggtgcctactaccacgcccggctcatttttgtattttcagtagagatggggtttcacatgttggccaggctggcctcaaattcctgacctgaagtgatctgcccacctcagcctcccaaagtgctgggattacaggtgtgagccactgcacccagccagttaggacaattttcctgtgacaccaacagcgaccatcgtcacacattcattccacatccccgctgcactgggcttacctcctgcccattcatctgtgggttctgatgaggcccgcctgggacacaggtggaggtctggtttcccacagcctcctgggcacctctgggctgctgacctgccctggcctggtttgaaggaagacataccaaatggagacctcaccactttgttgtgagaaatcccaggactcagagaaccctgtcatgtgtgctgagcagagctgtttccagcacagaggggactccgggcaagtcatgctgcgaagctttctctcattaccacacacagccacagacaccatccagataaaacccagttacattaaagtatcaggctgggccgggcacggtggctcatgcctgtaatcccagcactttcagaggctgaagcaggtgaataacttgagatcaggagttcgagaccagcctggccaacatggtgcaaccctgtctctactaaacatacaaaaattagccgggcatggtgctgggtgcctgtaatcccagctacttgggatgctgaggcaggagaatcgcttgaacccaggaggcggagactgcagtgagctgagatggcaccgctgcaccctagcctaagcaacagggtgagactccatctcaagaaaaaaaaaatcaggctcctgacggggaaagatgttgcccaaagggtaactgagagggatctgaagaagagggagcctgtctactcccctcctcagtgaaggtgatgtgatgagcttctgatccctctgtctgctcccctctttcctctctcctttcctctccccttctctactgtcctctccttcctctctctagcacttcatcctgctctcccttctccatctttcatccctccctcccacccctagttagagcacactcccctgatacccagttggtccctgaggcatcatggtgctcttccctaccaggagtcctccccagatctgttctgcacattcattcactcaacagtatttggtgagtgctctagctgctggaaataccatgagaaatgacaggcataacttctctgctctcagggagatacctgaacatctggtggggtagaaggctccacagccacagcatggtcccacagatacaaacacaaatctctgagtcccatctctggacccagtccatagttctggaccagacccaagaagctgcatttttttttctcttctcttttcttttttttttttttttgaaacggagtctcgctctttcccccaggttggagtgcagtggtgtgatctcggctcactgcaacctctgcctcctgggttcaagcgattctcttgcctcagcctcccgagtagctaggattacaggtgcgtgctactaggcctggctaattttgtgggttttgtttgtttgtttgtttgtttgtttgtttgtagtagagacagggattttcccatgttggccaggctggtcttgaactcctgacctcaagtgatctgcccaccttggcctcccaaagtgccgggattacacgcatgagccacaccacacctggccagaagctgcattttctaaggagttattgggttgatgctgatgcagtcagcccctagactgacctctgggaaacaacttttctgcacacagggcaatgcccaaagccaccgctttgggagagtttgtggcctgggcgctttctgtgattttaactaccctgtttgcctctgagaggttagaaagcagagtcttagagcagggtcttcactacacactcttgtcaatgttgggtgttttcagactccaagcataggcttttggggagattttttgtaacttatcagaattgcttgatgtgctcagaaacaccctctagaaaatggagctaacgccgaggacatctcccagtcccctgcttctgtgctgatgccagcatacccagggacctgtggcactagcatatctccataactcgggcagactctgattccggctcttccagaaggaatcttccctgtagccttcctcttctagctgcgagataaagcttttttttttttttttttcctgctctggatcataagtaggaggggttagcgtaggtcatcatcaccgtttggttgcaaagaacggaaacttatctaacactgtttatgtggagaaggaccgattgcaaagacacaaaggaccctcctgtaacttaggggcggagagcagagccagggctctcagcagatggaaagccaggattcctgggtggccagtcacccccacgtccatgtagtctccattgtacatctgcctcctccttctgctcaatcatccgtgtgcatggagcccctcaggaactgctcacggtggcggcctgagccctgaacgcgtgtgagcctattgagttctagctcccagagttgtcttcatttccaaagccaccccttcaggagaaacctaattccaagcttcagaggaaacataatttgtcctggcttgggatcagtgctcattttctggtttggttaactgaggccagggaatgggctcatttgatgcttttccagactaaaggtcaggctgcttctctaaaaggcgccaagagctgggaggaaatgatgcacattagaagccatgctttcccctggcatagtccagggtgaacctgctacaccagcaggagcaaggtcccgtttgcataagtgtgattggcatgcgatttctgtaaacacacagaagggcacctcccagtaagaaggtgaaggcgcattacttattgagctcctgctctgtgcactgggcccattgcaggttttctcttgtttaatccacacaacaataccctgtagagatttttttgtttgtttgtttgtttgagacggagtctcgctctgtcacccaggctggagtgcagtggtgcgatcttggctcactgcagcctccgcctctcaggttcaagcgattctcctgccttagcctcctcaatagctggggttacaggtgcacaccaccacgcccagctaatttttgtatctttagtagagacggggtgtcaccatgttggtcaggctggtctcaaactcctgaccttgtgatccgcccacttcagcctcccaaagtgctggggttacaggtgtgagccaccgcacccagccccttgtagagatttaacaggaatctagagtgctccattgacttatgcaattatagtcttcggtggcagcaccagcgtttaactacacatttcatgcttgtgccaccactgaaggtgaatgaagaggctcatccactgctgcctcaccacatgggtaccaagtggctttccatggaatcagaaacctggatgtgaaggtcgaagtcaagttagaagtcataaccagccgatgagggtccgagactacagtccaccctttggctccaaagaattccacctaatagcttcctggtggccccagtggagtttcaatggacctcctgcgtgaggtgtctcttttgcccagggaagcaccttaacggtgtttctggcctttggcagtgggggcatttgccagttcctccatgaagccttttctaaagcgtgcagtaaagcaaaagggctaaaatcaagggctttgaaggcaggcagatgctgagttctattctgtgactcagggcaggtcacctaatctccgtgtgcctcagtcgttcagtggagatggttctgcctccttcagtggattgtggcagtgcatacacgagatgtgcgtggaaagtgctttgcatcttgtgcttgagacaggaaattgctaaataaatggttgcaataacaatactaatttttgtattattcttatattcactcttagttgctcggatgacagaggcatgtctgctattttcccatctgctacagcaccagcaaaatgccttaaacatctttatctccatgtgtacccaatgtttagctccaaattacaagtgagaacatgcggtctttggttttctgttcctgagttaatttgcttaggatagtggtctccagctgcatccgggatctagagtacatccagccatagcaaagggcatgatttggtagatgctgagcaaatatttactcaatgaatttattatgtaagggtgactataaagtctggaaacagaggcaaaaagatataataaattatctattgatactatactacaatgcacaatgtaatacaatacaatacttaatatttatcagtgtgatttttctaatttacaatgcatggtcccatgcatcatacaacattgcaatgaacgtggtagaataatgcagcattcctgtcaaccactgcacatatatgcatgtgtggtattgtctcacatgatttatcaattgattgattgattgattgatttttgagatggagcctcactctgttgcccaggctggagtgcagtggtgcgatctcagctcactgtaacctctacctcccaggttcaagtgattctcctgcctcagcctcccgagtagctgagactaaaggcacgcactacaatgcctggctaatttttttatctttagtagagacggggtttcaccatgttggccaggatggtctcgatctcctgaccttgtgatccccctgcctcggcctcccaaagttctgggattacaggcgtgagtcatcgtgcccggctctaacatgattttttaagaattttggatacaagaggtacacgtgcagatttgttacatgggtatattgagtgatgctgaagtttgggcatctgttgatcccatcacctaaattgtgaacagagtacccaataggtagtttttcaactctcccctctccctccctacctgcttttggagttccgaagtgactattgttaccatctttatgcctgtgtgtacccaatgtttaactctcacttacaagtgagagcgaatggtatttgattttctgttcctgcattaatttgtttgttagctcggccagaagatgcattgcattttcaaaggagctgttgggttgatgctgatgcagttggtccctggactgaactctggggaacaacttttccacactagtcttgaatggctgtgtccatgctgcagcaaagggcatgatatcgttcctttttatggctgcatagtattccatggtgtatatgcaccacatttttttttaatccagtctacaattgatgagcacatgggttgatttcatgattttgctattgtgaatattgctgcaatgaacgtaggaatacaggtgtctttttggtagaactatttattttcctttgggtagatacccattaatgggattgtttggttgaatggtagttctatttttagttctttgagaaatttccaaactgctttccacagggtctaaactattttacactgccaccaatggtgtgtaagtgttttcttttctccacaccttgccaacatctggtgggttttgtttttttggttgttttttttttttaactttttaataataattgttctgacaggtggcctcacatggttcttgtctctaattttcaataggtcaacttgtgcctttagccttccccagaagaaacaaccaaggggatgaatttatacaaaaataaaataatcctttgtcccgacttcatggttactctacacgtgctctctttgtctctcctgctgagacctcctctctgcgggctgaggtcatgcccttgccatttatgatggatacctttaggcactaggatgtgtttcctccctgagtcttctcccttctctaaagaccccaccctggtccactttcttccagcataacgtggaaattggagcccttgcttgcaatcttcctctctccagtttcccattgcactcctaacttgctcattctctttttcctggggtggggagtggtgcatcttgcttctcacctccaagcttctttgagactgcacaaggaccccccatcccatcactcagctgtcaacagagtgcagcagggaccgcttcctatgtgtgcagacgccatgggatacgggagaccagcccttaccccatctatgagggagtcacattatccctagatgcttttgaagctaaaagacagcctcacaggctgggcatggtgtttcatgcctgtaatcccagcactttgggacgctgaggtgggcagatcacctgaggtcaggagttcgagaccagcctgaccaacatggagaaaccccggctctactaaaaatacaaaattagctgtgcatggtggcgcatcctgtaatcccagctactcagggggttgaggcaggagaattgcttgaacctgggaggtggaggttgcggtgagccaagattgtatcattgcactccagcctgggcaagaagagcaaaactccgactcaaaacaaaaacaaaaacaaaaaacagccttacagagtaacagagagaggaggtgtgggaattgagggaagtgacttgatttgctaggctggaaccagtacatgctaggctggaacccagtacatgctaggctggaacccagtacatgctaggctggaacccagtacatgctaggctggaacccagtacatgctaggctggaaccagtacatgctagaccggaaccagtacatactaggacggtgcctatggaagggcttctggcactgacacctcaatgagcttcccttctttctccctccctcaggaccccagccatgataggctgctcgttcgtggtcaacaggaagttcttcggtgaaattggtcttctggatcctggcatggatgtatacggaggagaaaatattgaactgggaatcaaggtttgtgacatggtgtcccttcctcttggtgtgcccatgtttgtgagcagagcgtcttggtcatccgtggggtgtatttaaagctccttacagctgatgaatgacagattcatttactccaccttgttcctgggggatgcatgagctgcactgtcacccctccttatgtagggaaacctgggctttcccctgtctaaaagttggctgataggtttcatgccattgctacccactctgggcattagctggagagggtggttcccactcccattcagttttggtctctccttaaatttttcttaaatgatctccttaaattaatattttcaggccaggcacagtggcttatgcctgtaatcccaacactttgggaggccacggtggtgcgatcacttaagaccaggcattcaagacaagcctgggcaacagagcaagaccctgtctctacaaaaaataaaaaattagccaagcgtgatggtgcatgtctgtgtcccagctcctctggagactgaggtaggaggatggcttgagcccaggagttcgaggctgcagtgagctatgatggcatcactgcactctagcctgggcaacagagcaagagagaccctgtctctctcacaaaggcatttgtggtttagtttttacatccgcagatttatttttaacagttttattgagatgttattgacatatacagattttggtggctcacacctgtaatcccagtgacttgggaagccgagtcaggaggatcacatgagcccaggaattcaaaaccaggctgggcaaagtaggaagacgctgtctctatgaaaaataaaaaaaaaaaaagctcatatatataatcccagggacttcggaaaccaaatcaggggggtcacttgagcccaggagttcaaaaccagcctgggtgacataacaaaaccaccatctccacaaaagataaaaaattagccaggtgtgattgtgtgaacctgtagtcccagctactcaggaggctgaagcaagaagatcgcttgagcccaggagttcaaggcttcagtgagccatgattatgccattacactccagcccaggcaacagagcaagaccctgtctcattaaaaaaaaaaaaaaaaaaaaaaaaaactacatgtttaaggtgtacaggtgatgtttggatatacatatacattgtgaaatgagcaccacaatcaaactgagtgacacatccattacctccatctaattaccactgtgtgtggaggctggtgagaagatttaatttaagatctatcctcttagcaaattaaaagtctacaataccatatcattaactgtggccaccatgctgtacattagatctccagaaatgattcattttgctttgcagtgacgtggcaggaaaagtctgagtgtgaggctctgcaggcttggtggtgatggtggtaactgcttagcaggcaagactgtgtggctgtccccaatccctaaagcaaggaggggactcctgggtccttccccagcagcacagtcctgtccaccaacacccctgtacgaccagattgtgggatcatgtagattctcccttcactccctattttttgtttttttatttatttattttattttattttattttatttgagatgaagtcttgctttgttgcccaggctgggtgcagtggtgtgatcttggctcaccgcaacctccatctcccaggttcaaacgattctccggcctcagcttctcaagtagctgggattacaggcacgtgccactgcacctggctaattttttatatttttagtagagatgggatttcaccatgttgaccacactggtcttgaactcctgaccttagctgatcttcccgcctcggcctcccaaagtgctgggattacagacatgagctcccatgcctggcctttaattaattaattaatttatttatttatttattttttgagaagtagtcttgctctgtcgcccaggctggagtgcagtggcgcgatctcggctcactgcaagctccacctcctgggttcacgccattctcccacctcagcctcccaagtagctgggactacaggcgcctgccaccttgcccggctaattttgtttttgtctttttagtagaaatgggatttcactgtggtagccaggatggtctcaatctcctgaccttgtgatctgcccacctcagcctcccaaagtgctgggattacaggcgtgagccaccacacctggcctattttattttttatttttttcttttaactttcattttaggttcaggggttcatgtgcaggtttgttatataggtgaattgtgtattacctgtattgataattgacacctcaatgagcacagattggtgcacagattattacccaggtagtaagcatagtacctgataggtagttttgatcctcaccctcctcccaccctctgccctcaagtaggccccagtgtctgtggttcccttctttgtgatgatatgtgctcaatgttcagttcccacttatacatgaaaacatgcagtatttggttggatgttcctgcattaattcgattaggataatggcctccagctccatccgtgatctccttcttcttacagctgtgcagtattccattgcgtacatgtacaacactctctttacctgttctgccattgatgggtatttaagttgattccatgtctttgctattgtgaatagtgctgcaatgaacatacgtgtgcatgtgtctttatggtagaatgatttgtattcttttgggtctatacccagtagtaaatgagatactgggtcaaatggtaattctattttaagttctttcagccgttgtggaaggcagtttggggattcctcactccttgttgatgggctggaatgaatggtccctgcagagcccagtctgcccccaggcaatttctccctggctttgtctccatgacaattcagctcccccactgctcagggtaggtctttattaaagtgtcacttgcatcagggtcatagatgtcactccagagtgcaattacctgcctcttacagtacttcaaggcatctccagcttctggagatgggggaataattttgcctcttaactttccatagaccacatcatcctgcaggctgcaaggtgatcttgacataagccttggttttctgccagttcttaaagtgggattgagtgctgctggttgcagaaaggcaaaggtctgggtttggagtctacacagaattctctggttctcatgtttccagtcagaagcattcacctcacctgggaacttgttagaagtgaaaattcttgggccccatcccagacctactgaatcagaaactctggagtggcagggagtccagctccctgtgtttaccaagccctcctaccccaccaggtaacttagttatgggcccttgttggagagctactggtctacccctaggtttagccgacttcctggcaaatgcatgtcctttagcagaaaggagcccaggtgagaatccacctctttctagtcccttctccaggtgcccttccatggccacactggcccaaagtgagtcctttcttctcactccagcctacacagccagagtcctgtaggcaccaacatctactacctttttaacttcatgtacgggtgtctcgaccaggtgactacagggttcctgatgacagagctccgtttttcaaatgaaataatatacacaaggcacttctgagacaatactacttctcctttcattttgtgctattttgtactacttagggcttgaatgaattgcataataaatgcattcttaagaaatccatccccaccgcctgaataaagaagcagggctttatgtaaatatatatacatgcatatatataattttcatgtagtgtacacacatacatttacatatacaagcttacctgtaagtaatgacccaaaaccctatgctttcattcaatggaaaatttttaacatgagaacactattttcttgatttttttttttttttgagacagagtctcgctctgtcgctgaggctggaatgcagtgacgcgatcttggctcactgcaggctccgccctcgagttcacgccattctcctgcctcagcctcccgagtagctgggactacaggtgcctgccacctcacccggctaagtttttgtacttttagtagagacagggtttcaccgtgttagccaggatggtctcgatctcctgacctcgtgatccgcccgcctcggcctcccaaaatgctgggatgacaggagtgagccaccgtgcccggccattttttttttaaaccaagaaatggctcaatctgtgatctttctaactagtctttgaaattttgtgttactttttaattccatcctcagtaagtaaagatctgtcagaagaacacaagaatagaaagtcttactgtgaacaaaaatagcagttgactctagggctcttgcctgcatgaaaggcaacttgcctgtgactaaaacaatcaatacagaaaagaagtttttaaaaaagccagaattgagaaaataaatgagatggaaattgaaaggtttcatcttgttctgagtaatagtaatcagaaactattaacaaagggtattatagtagcatgtctaaatgttaagagaaaaaaaaattctccaaggacagaagaaaagataggttactttaaaatgatgtaaagtcattctctaatatatcagtccatttacgaagaaaaggcattctcttcttctgttctcttatataaaaacatggcacccaagactgctgcgtcctgctggggagtcctttctaaaggaagacaagggagacacactttcagatccccaaatgaccaaagactgtcttgactttatcacgaatcccaaggactgaataaaaggcagaattcttgtgtggatgcattgaattgtgaaaacacttgtgagaatgatttatttattttgggtgtatatccagtaatgggattgctgaattgaatggtagttctgttttaagttttttgagaaatctctgaactgctttccacagtggctgaagcaatttacattcccaccagcagtgtacaagtgttcctgttctctgcagccttgccagcatctgttgttttttaactttgtgtgtgtgtgtgtgtgtgtgtgtgtgtgtgtgtgttttgtttgtttgtttgttttttgagacagagtcttgctctgttgcccaggctggagtgcaatggcacgatctcagctcactgcaacctccgcctcccaggttcaagtgattcttctgccttagcctccagagtagctgggactacaggcacacaccatacttggctaagttttgtatttttagtagagacagggtttccccatgttgcccaggatggtctcaaacttctgacctcaagtgatctgcccgcttcggtctcccaaagtactaggactacaggcacgagccacgctcctggccttgaatttttaataatagccattctaccaaaaagacatctgcattcatatgttcatcacagtgctattcgcaatggcaaagacatagaatcaaccaggtgcctgtcaacagtggatgggataaagaaaatgtggtacgtagacaccacagaataccatgcaaccctaaaaaagattgaaatcatgtccgttgcagcaacatggatacagtgaaaggccattatcctaagtgaattaacacaagaacagaaaaccgaataccacatgttctcacttatacgtgggaactaaacattgggtacccatggacataaagatgggaatgacagacaccagggactactagagtggggagacagacagcagccaagggttgaaaaactacctattgggtactatgttcactacctgggtgatggcatcggttgttcctccaaagctcagcatcacacacaacacccatgtgagaaacttgcctatgtatcccctgaaactaaaacaaaagttgaagtttaaaaaattaatacaagaaatgagctctccattcccagacacacacaaacacacgcacacacacgcaaaattttgacaccagtaagccatcatggaggaaaggatataagagggtttgaggatgctcaagtgagataaccttcttgccgattccagcccagccctcagggcctttccatggttcagcccctgcaggggtcttcttgttgggttccctgttgctccataacagtcaccaggaagcgattcagactctgagtccgtgttggcttagatgagtcatgatgagtgatgggcaaagaacaagcgtattttaatttgcactcagggtaaacataacattcttaaaaagcagagtttaacccagatgccttaattgctggttgcatagctcaagatgtctctgagccattccatttctctgaggagttggagtgccactttcaggactcaggtggagacatggttagaactcctgccatcttgtctagctctgtccattcaagctgaaggcactgaagacctggggggtggttcgcagactcagggtttcatagtgtctgagccaactgagatcacatcagcagtgggttttgaaggcttgctccttcggaggggttgtttacatttatttatttatttatttatttatttatttatttatttatttattttgagatggagtttcactcttgttgcccaggctggagtgcagtggcgcagtctcggctcactgcaacctctgcctcctgggttccagcgattctcctgcctcagcctcccagctagctgggattacaggcacccaccaccacgcctggctaattttttgcgtttaatagagatggggtttcaccatgttggtcaggctggtctggaactcctgacctcaggtgatccacccacctcggcctcccaaagtgctgggattacaggcatgagccatcacacccggcctacaatttttatatatatagacaaattctcactgtcatctaagctggagtgcagttacaaaaattatagctcactgcagcctccaactcctagaatcaggtgatcctcctgtctcagcctcccaagtaggtgggactgcaggtgcacaccactacaaccagctaattgttgttttttggttcttttgtagagatgggggtctcactatgttgcccaggctgatgtcaaactcctgacctcaagggactgttccatctcagcctctcaacatgctgggaccacagccgtgagccactgtgcctggccttatatagaaattatgagccatctggaatagccaaagccccaggaacctgaatgaaaacagcatttcccactcccacaggtctctttgccctgtctcttgttcttagttttgcttccctcttgtctacagctagctcttgcaaggccttctgcctgccctcctgatccccgccctagccacttctctatggttttagggacccatccatccatgttaaccaagagagatttccccctgccttctctgagacctctggcatcaggaaccctgatgtcccaaagccttctgtggcctgtgttgtccatttggaactctcgagctcaaatttgctacatccattgaataatgtaatttgcatcatggtccatcccagagaggaccagatgatcagtccgttttcattttcatactttttagattgcatgagtctttgttctctcacctattggcactggtcaaggttggatccaaggcctggtgtgaaggaagtcatccttggctatgtgaatacctttgtagggcagagcccaagtttatctgtgatacagatcaaagcaaagttcctggtcttgtcccagtatagagtgagccttgagatttcacaaactggtctttcatggaggggaatgtatgactggtggccaacagttcaactgaatacttctgattaaatggaaacttggtgagtgccttctgtagcccagcaggcatttccactggagctaccacagtcaatacatggggtctctatctccatgaaatttatagtcagacagaaatactgttcatgaaataaataattagcactgtgatgagtgtgaaaaaacaagatagagcaatgctgtgggaaaatatagtaaggaaatatagcctagtctagggagttgggaggaaccttcttacggaaatgctgtttaagaattctaaagtgagtttaatatagataagcaaagaaggaggtgtgcaaggaagaatattctagacagaaaaacatctgcaaagatttggaattctgagagataaatgtgtcctgaggaccttgggagttcaggatggttagagcagagaaagggggaagaaaacctcttagatgcagcgacaaccatcaaggtggggcccagattatgaggattgataagcagaaagttggctttttcttaaggatcactgtagacattttagataggtaggttaggtagacaaatagataggtaggtaggaagaaagagagagagagggagagacagagacatgatagatacatagattagagagagaaagatgcatggatgatggatggatggatggatagatagagggatgatagagatagatgatagattaatgatagagatagtaggtaatagagatatagacgatagagatgatggatggatagatagagatgatggatagaatgatagattagatagatgaaatatataggtatggatagattgatagattatagattagattgataatagagataacagatagatggatagatgatatagatagatgagatataggttagatagagatgatggattcgatagatgattgatggatagatagagatgatagactgattatatagacagataaatagatgatagtttgatagattagatagatgatagataagatacatggatgatagatgtagatgatagatggatacaaagaagatagatatagatgatagattagacagatgatatataaatagatgatagataaattgatagatggatgatagatagatagatagatagatagatagatagatagatagatagatgagacatagatagtctcaagtacccattacttaccacccttgaggggatttaaaagaagtaagaggattagacttttctttttactaaaaagataatgatgacagccatgtggaaaatagatgataaagctgcgtacactcaggaaaagctggtgaggaggggcttgacctatatggttgtgacagtgggagaggaatggacaaattcaggaagtggaagagacaaggcctggagattgagtgtatgcaggggatgaagagaagtgggagtccaggctgagcaggtgggaaatagtgttgctgttctctaaggagcactgttggaggaggtttgggagaaggtggaaagattatatgataaatctcatgtttctgagacaccccaggccagcccagaggcatttgcatgtgtggggattaagccaaggagggagcactaagcctgagatagacttggatgtaccggtgccctttaggaggtgtgatagacagagagtggttgtattaatctgttcttacactgctataaagacatacctgagactgggtaatttataaacaaaagacagttaattgattcacagttgtgcatggctggggaggcctcaggaaacgtacaatcatggtggaaggggaaggagaatcaaggcatgttttagctggtggcaggagagagaccaagcaagggaggaagggctaaacacttttatgttttgttttgttttgattgagacatagtctctcgccctgtcacccaggctggagtacagtggctcaatctcagctcactataacctccatctcctgggctcaagtgattctcatgcctcagcctcccaagtagctgggattacagatgtgcactaccatgctcggctaatttttgtatttttagtagagatgaggtttcaccatgatggccaggctggtcttgaactcctggcctcatgtgatccacccgccttggcctcccaaagtgctaggattacagctgtgagccactgcgcccggccacgtttaaagcatcagatctcgtgagaactcactcactatcataagaacagcatgggggaaaccaacccccatgatccaatcacctcttaccaggtccctccttcaacgcgtggggattacaatttggattacaattcacgatgggatttgggtggggagacagaggcaaattatatcagtggtggtccactgaatgagaggagtgaatgagaagggattattaagggtatctcccaggcttcccagcaactgactgcaatcccctaaatagaggactctggtagggtaggtttgtcagtggggacatgagtagttccattttagaaatgctgagtttgaggagtagcagttctctctaacctgacagtgagatgtcaagggaacacaaggctgggaagggactctggccaagagtgggatttggcagaggggtgccaggacaagagttggctattctccattccaccctggagtctgcaaggccacagtgcttagggtgtgggctgacttagaggagcgaggacatagggattcctgctatggtttgagcgtgtgagttacagcaggtagtggccatatgtgttatacctggtgggaatgtaaactagaacaatcactatgaaaaacagtatggagattccttaaataactaaaagtagaactacgatttgatccagcagtcccactactgttatctacccagaggaaaagaagtcattttacaaaaaagatacttgcacacacatgtttgtagcagcacaattcgtaattgcaaaaatgtggaaccaacccaaatgcccatcaatcaaagagtggatggagaatctgtggtggccgggtgcagtgcctcacacctgtaatcgcagcactttgggaggtcaagacgggcagatcacgagatcaggagatggagatcatcctggccaacatggtgaaacactgtctctattaaaaatacaaaaaaaaaaaaaaatagctgggcatggtgacatgcgccttagacccagctactcgggaggctgaggaaggggaatctcttgaacctgggaggcggaggttgcagtgagctgagatcgtgccactgcactccagcctggtgacagagcaagactccgtctcaaaaaaagaaaaaaaagaatctgtggtatatatatacaatggaatactactcggccataaaaaggaatgaattaatggcatttgcagcaacatgaatgagattggagactattattctaagtgaagtaactcaggaatggaaaaccaaagatcgtgtgttcttgctcataagtgggagctaagctatgaggatgcaaaggaataagagtaacacaatggacttcggtgactcaggggaaagggtgggaagggggtgagggaaaaaagactacaaatagggtgcagggtatagtgcttgggtgatgggtgcatcaaaatctcacaaatcgccactaaagaacttactcaggtaaccaaacacccccgttccccaataacctatggaaataaaaaataaaacaaattgggaaagtaggattttaaaaaattgaagcctatcatctttttttcccctcccgaaataattttggggaaaattagtttttcaaaatgtttacaactttcacatctctgctccatactccaatttcaggccagtatgtgggtttctgaatttctcaactggagtgcagtagcaggatcgcgactcactgcaacctccgcctcccaggttcaagcgattctcctgcctcagcctcctgagtagctgggaccacaggggcacaccaccacgcccggctaattttttgtatttttagtagagatgggatttcaccgtgttagccaggatggtctcgatctcctgacctcatgatccgcccacctcggcctcccgaagtgctaggattacaggcctgagccaccacatctggccacctgtttgcctctatgtcacctgccaggaagagatagtcaggcccccgtagcccctccctagagctgcagatgatgagctgctcacctgtaagtttgtctctgcagtggcacctttttcttccagctttcactgttacacaacgtactcagcctcagtgcagaacgaagttttattggacatggaaaaaggggaaaaattaaacagattccctggcattagatagcagggccattttgctatctttattaaaatgtattgccatcctcttaaagaagagtaacaggctgatctatgtagaaagctataacatgcacatgcatgaacacacatgcacacacacacacacacacacacacacacacaccacacaccaaacagcccttcctcaagagaccttccaaacgatgtccaggaccgtgaagtcagttgtagactaaggtcctcctggctgggcgcggtggctcacgcctgtaatcccagcactttgggaggctgaggcaggtggatcacgaggtcaggagatggagactatcctggctaacatggtgaaaccccgtctctactgaaaaaaaaaaaatacaaaaaattagccgggcgtggtggcacgcgcctataatcccagctgctcgggaggctgaggcaggagaatcacttgaacctgggaggcagaagttgcagtgagccaaggttgcgccactgcactccagcctgggagacagagccagactgggtctcaaaacaaacaaacaaaaaagggcctccttcttagagtttcttaaattctgtaatgctaaattttatacagtctggaaattttcccccgagtggatgagaggtttagattattttgtctcactgtttttttcccttcaaaacaaactggaaaatgaagaattcagtcattacattttatgctaatttcttttattttaattcaacatttttgatggaaaacttgaaacatacacgaagatagcacagcataatgaatccaaatgtactgatcattcagctttaacaaatattaacattttgctgtttttttcagttactgctcattgactttttaaaaacaaatccccagacatcgtctcattccatctataaatactttacagtgcattgccaacatataaagactctttaaaaacatagtctcgacataaaattacacttaggaaaatccattacccagtccatgttttctcaaaaatatttctcaaaactcagttatattttctcaaaaaaatttgtttgatagtcagcttactcaaataagaatcccagcaaggtctacacactgcatttggctgatgtgtctctaaagtatctttcaatctgcaacatttcttctcacctttatttatttatttatttaatttatttattttgagacagagtctcgcgaagtgcagtggcgcgatctccactcactgcaagctctgcctctcgagttcacgccattctcctgcctcagcctccggagtagctgggactataggcgtccgccaccacgccaagctaattttttgtatttttagtagagacggggtcttctcacctttattaatttcatgtcattcatttgtcaaagaaaccaagtcatttgtcctatacaatttcacacaatctggatttagcagattgatgtttcttgatgtctttaacttgttcctttaatcttctttttatttttctaagctgtaattagatctacaaggttgattacttcttcctttattttttcctttctttctttttggcaagaacactttaagctctgctatgaacttcctagtgctgacattgggagatacataatgtctggttatctcactgtttctgatgttaggattcaacagcaggttcaggtgttgtcagcctgattgattcattataaagctccccatcaatctttcacttaattaatggttttagcagctaccaatgatcactgcctacacccattaattcattagggcctacggaatggtgatttttagactctacactcattctgcatttataagctgtaattcttccattaaaagtaacttttcctactcaactatttgtgtattctgaaatacaattcaaaccaggaaagcaggataaatgcttgatttcttctttttatttaaacatcttcagaataatgagttggtgtcatagcaccctcttaagatgaccaatgaggttttcttttttttcctcaataatatggactcaagggtttttttttaaataaatattttatatgtctaaatccattgtcattattcattttttgcccactgtatatttacttttattaaagcataatttaatacagtccaatgtacagattgccagtcttcagtctgatgaatttcacagtctgattaatatatacccctataatcacctctgaaaacctgacattggacatttctgttgcctgagaaagtccctttttcctatcagttctttcctcctccccaccccacacttcccgccccagcaagcatttcctgatttcttttttttttttttgagaaggagtcttgctctgtcacccaggctggagtgcagtggcacgatcttggctcattgcaacctctgcctcccaggttcaagcaattctgcttcagcctaccaagtagctgggactacaggcgcctgccaccacacctggctaatttttgtattttagtgtagacgaggtgtcaccacgttggccaggctagtcgcgaactcctgacctcaactgatccaccctcctcagcctcccaaagtgctgggattacaggcatgagccaccgcacccagccctgatttttatcaccatagattagttgtgtctgttccagaatatcacataaatggaatcacatcttatagtctctattgtatctgacttctttcaactaaaggaatgtttgtgagattctccatgttgcagttgtgtgtatctatcagcaacacagtctttgtcgtttactgagaagtattcctctgtgtcaatatatgacaatttgtttattcattgtcctactgaggaataattgggttgtttccaatttgggactggtatgagcattcatataaaagtcttttatgaacatttgtttagatttcgcttgggtagatacctaggatttgaatagttggaatatctagaagatgtgtgttcaacttttaaagaaactgtcaatcaggtatccaaaatgtgccattttccactgttccacctcttttgcagtatttggtattgtcagaatctattttaccaaacctagtagggttttttttttttaattgcatggcacactgaaaggattcttttatttatttatttttattgacacataatagatgtacatattttgggggtacatgtgataatttaatatgttcatataatttgtaaagatcaagtcagtgtaattgagatatttatagtcataaatatttgacttttttctaaaaacattcattctcttctagctgttttgaaatatataaaaggtaatggtatacaatattcaccctactgacctatcaaacactaggtcttatttcttctatccaactgtatgtttgtatccattaatcaagctctcttcctcctttctcctctctaccttttttgttttttgttttttcttttttgaaacaaagtcaatctgtcacccaggctggagtgccatggtgtgatctcagctcactgcaacctctgcctcctgggttcaagcgattctcctgcctcagccttctgagtagctgagactataggcgcacaccaccacaccaggctaatttttctatttttagtagacatggggtttcaccatgttggccaggctggtctcgaacttttggcctcaagtgatccgcctgcctcagcctccaaaagtgctgaaataacaggtgtgagccaccgcacccagccacctctttaccctttgaaggggggtacttcagtatggttttaatttactcttccttgaaggaggatgagcacctttttttgagcttatagttaatttgtgtatctccttttgcccatttttaaacatcatgttttttcattttgttgttgatttccaggggtctgtggtatgtattctgggtactattactttttcagtgatatgtactatgtgaatatttttctactgtctgtggcttgtctgttcattttcttatgtattttcttctagaaagtttatatggttctatctttcacacttaggtctatgatcataaaggccctgctgaaaacataagagagtatcttgctgtgggtaatacttttttgtactgaaaacattaaaaaaacactaataaagaaaaaatgataaatttgacttaaaatgtaaatttcagctcatctaaacaaagtattaaaaaatgaatagccaagccacatgccgggaaaaatactcataatgcctgtaactgatgaaggaatcttatgcagattatgtgtaataaatcctaaaagtcaaaattaaaatattgcaaaaaggcttaagcagccactttgcagaacatccttgctttctggcacaagaagaagttcctgtcctgtcttgttatttactgtcctagacctggaattggccatttctctaaggaatcccaatcccttccaatgggaaatggtatttagagaccgaagtcttgtcagtgagggtgctcattgccactaggttgccattgtttctaagccttttccatgaacaaagctagacaacactgatttttgtttttttagaaagagtaaggtaaatcattatttcatactaatgtcttctgttcaaatttgtaattaccaggtatttacttcttatattttatatttacttttcactgaaagtcttggttcttattgacatcatttcttatttgacttatcctacaatatataaataatagtttcaaaataagaatactaacaagttgattggatgaggtttaatatttctttatggtttgttttgtccctaggatatattccattatagatgtacaaccaatgtctttaaaattatttgacataattttctctgtgtgattataccacctccttgatatagactattagagctatatggcattgaacaattaagttcacttttgttttttcttttctaccgaggctacaagtcagttaactaaactcagttgacctaaaattttagcattctttaggtattgctgtgtagtcacagccacatgcaccaaacactctgcttttaggttgattctacccagcactctcttgggccttcagttctacaatgtcggacaacccatactcccagagaagctgccaatctggacttctgcttaacatggatttgttttgtgtggtaatttgtgccagtccaccatcactgtggctggtctcatgaatccagctggaagctcggtgattactattattgctacagcactggggaaaaatccaagaacttccagacataagaaaaaaaaaaatcctccaccctccctcccccaaattaccctattgattgtcaaagctaaactatatctttgcataccaaaactgagccagagaggacacatagcccacataagggtcaatacggggcccttaaaaagctaaacgtgggaagtgagtgtcaagaaacaccagcactgttattagtgtgtggaggtagcagagaacagaatggactgctcggagaaggaaagagaagccacaatgaggggaaaccatagactggtcttctttgtaattttcattgagaagcactttttgcaccacagttagtctgtattcagagtacttagcttactaaggcaagctggcaggtaccagttttgagaatgagttcacacaaatgttattacgttaaatgggacaaaggagaacttaaaagtaatacctagccaggcacagtggctcacacctgtaatctcagtgctttgagaggctaagacaggagaatcacttgagcccaggagttcaagaccagcctgggcaaaatagggagacccgtctctacaaaaaataattacccaggcatggtggtgtgcccttgtagtcacagctactcatgaggctgaggcaggaggatggcctgagcccatgagtttgaagctgcagtgagctataatcataacactacactccagcttgggtgacaaactgacaccttgtctctgaaaaaaaaaaaagaaaaaagtaatacctactgtggattgccactaacagtactccagacactgtagtaaacgctttataaacattacattattcagtgctcgtgagatttctgtgcgtttttcattattgaacctattttacagatgataatactgggattgacacaagtcaacttgtccaaggtcttacagctaataaatagaacagccggaactcaacccaaatctacataatttgagttctatgaggcttgcgacctcttgcttggaatttattcatccatataactttattcttccaccatctggataactgtgacaatattgcagatacacggtgacgcagtcatatggtaggtgctatggatgatgcttgtatataatgcatatcataaaacaattccatctgcaatagattatgttcataatctttatgtagacacacagataggaaccatgcccgtacatgtatttcatgtactacactatctcatatatagagaactgtagttatgtaataaacaaaaatgtgtttgaaacagcatgaaattggatttcctcatccataaattgtattatatttatgtcgaagttatagttcaagaaatagaactgcaatgttgatatttttataaatgatgtctaatgtatttctattaaggggagatagatttgctctgctgaaatgtattatcataatagccaaaccatttactctaccactggaaaatagtgtggtattctgtttggaatttcacttgcctgctcccagcctgccagatctattgtaaattattgtaggcatctgtgagttattttataggaagcatccatctatttttataactccaaaaagcctgtcactctcattcatctccttgggaataaagcaataatttgattctctataaatgtgaacctgaatttacaccatcctctccagttgggactttagtgatgtgggtgatttatggctctgggtttctggggcaaggccctaggagatgacatcctgatgtgcttgttgtcattttctactatttccacagaaaaagggaggggactcaacctgcccctattctatttagggcacaactatttgttccctgtccatgtagccatgttgaatagcactttctttttgttgttgttgtttgtttgtttgttttttgagatggagtttcactcttgttgcccaggctggagtgtagtggctcgatctcggctcactggaacctccgcctcctgagttcaagcgattctccagcctcagcctcccaagtagctggaattacaggtgcctgccaccaagcacaagtgggattacaggtgcccgccaccaagcacagctaattttttgtatttttagtacagacagggtttcgccatattggccaggctggtctcgaactcttgacctcaggtgatccacccacctaggcctcccaaagtactgggattacaggcatgagccaccgcgcctggccatttgtttggttttgagacggagtctcgctctgtctcccatgctggaatgcagcggcttcatctcggctcactgcaacctccacctcatgggttcaagcgattctcctgcctcaggcttctgagtagctgggattacaggcatgtgctatcatgccgactaatttttgtattttgagtagagacagggtttcaccatgttggccaggctggtcttgaactcttgacctcaggtgatctgcccacctcagcctcccagagtgctgggattacaggcgtgagccaccaccacgcctggctctaggcctgttgaatatcaaatcacaaggaacagctgtaagggtcccgaattgctccctgcagccctggatccagcagttgggtagatgtctgtgaaagagccatagggactgtgatgtgctcagccttccaggacctccactgcaatttcttacattttcagagcttccacaggaaattagtcgcatgtctgggaaactcctcaggtatttgcaaccaagttatctatctatggtttcccatcttttggctcattggaaatgggctcatctgagaaatgtcactgttgattgtttgtttgtttgttcgtttgtttgtttttgagacagagtcttgctctgttacccaggctggagtgcagtggcgtgatctcggctcactgcagcctctgcctcccagattccagcgattctcctgcctcagcctcctgggtagctgggattacaggcgcatgccaccacgcccagctaatttttgtatttttagtaaagacggggtttcaccatgttgcccaggctggtctcgaagtcctgacctcaggtgatccgcctgcctcggcctctcaaagtgctgagattacaggcatgagccacagcaccctgccgaaatgtcattgttttatttcctcttctcttgcaaagatgccaagggcgcagatggagctgtccgtctgtcagttgcctgtggtgctgtgggaccaatgctttttgtgcctggaactgtggatgcttccagggccagggaactgggcagtgggaagagtctgaattatcacttgaaggaggagatgccatgagcaggaaggaatcaaggctggagtgtgtaaaccaaagcactggagagccaggaagaccagaggaaaaatgatggaccaggccaagcgatgcagagactgggtccagaggagccacttgagacaggtcgggtctttctggcgcccacactgtctttcctatgcattttgcagcatgacgcttaggtgggctggctgccagctgtagtggcaagtgcctgtaatcccagctatgcgggaggctgaggcaggagaatcacttgaacttgggaggcagaggttgcagtgagctgagatcgtgccactgcactccggcctgggtgacaagagcgaaactccatttcaaaaataaaataaaataaaataaaataaaataaaataaaataaaataaaatagcatagcatagcatactaaaataaaataaaataaaataaaataaaataaaataaaataaataaagcatgcagagtgaggcaacccattcctcagcttcaggacccacagaggaacctggattcatgcataaaacgcctctgacatctctttatgattttctcagtctggatggtttctgctgggggctccccctgattggaaacatttgtccttgaacatcatttttgaagtattatataccagcctagctcagcaagaaaagtactcatgccagtgaccatcattattgtggaagctcttacttaaatcagttagggctgagcatagtggcacattgcctgtaatcccagtgctttgggagggagaggtgggagaattgcttgagcccaggagttcgagaccagcctgggcaacatagtgaaactcttgtctctacaaaagctttacaaaattagctgggtgtagtggtgcacacctgtagtcccagcaactcaggaggctgaagtgggaggattgcttgagcctcaggtggttgaggctgcagggagctatgattgcacccttgcactgcagtctaggcaacagaccaggaccttgttgcaataataataataataataataataataataaatttttaaaaacaattagttttgggacaagaagtctaaatggaaatttcatggatagatttaccaatatttttcttccttttttttttttttttttttttttgagacaggagtctcactctgttgccaggctggagtgcagtggcatgatctcggctcattacatcctccgcctcctgggttaaagctattctcctgcctcagcctctcgaatagctgggattacaggtgcgtgccacgacacccagctaatttttgtatttttggtagagacagggtttcaccatgttggctaggatggtcgctgtctcttgaccacgtgatctgcccatcttggcctcccaaagtgctgggattacaggcgtgagccaccacgcctggccccttgacaattttgactctcacccttgaagctactgtctgtagatatgcagaatgtcatggatgggaacttcttcaatggagacccatatgcaaccagtgtctgccttacaggaaacaaagtggtacccgtttcactattttctcatgaattcccttcccttttgaaaatctaaaaggagaatgaggagaatgcattgtgcgttggacaactccacaaattttaaagcattcaagtttagaaatacagctttgtgctttctccatgtgacagaaatggaaagaactaaaactacatatttttctaagcttgcttttagacttttctttttctaaactttctgggggcgcgttcagattccagctctcctacaagaacaaccacgcagggaaattacaaatgtccattctccagatgtaagaggccaaaggaatgtgcagatttcagtgaaaagctatcatttttttttaatgttttggctcttgttgacacacatcaagttctcctttttttgctcacccagaaaatcagccatctctttgggcttaaatggtgatgggaaatttggggctctttttggaacgttatcaaaggaaaattatgcgggagacacagggaccagctggggtggatggtctgagtctgagaacacctgggcaggtttggggtttgctctatgtgactggagggagctctaaaggtactcaaagtacctaaagaaccaggattatttatttatttttttaagacagagtctcgctctgtcacccaggctggagtgcagtggcacaatctcggctcactgcaacctccgcctcccgggttcaagtgattctcctgcctcagcctcctgagtagctgggaccgcaggtgtgcaccaccacacctggctaatgtttgtatttttagtagagatggggttttgccctgttgcccaggctggtctggaactcctgagctcaagtgatccgcccacctcagtctcccgaagtgttcatattatagggattagccactgtgcccagccagaaccaggatatcatgagaaactctagcaaagctgttaagataggaagagatctatgctcaggcagaaggggaggaggcaggcaggaattcttgtgaaccagacaagtaacacatgagatgagcttgaggaggttggtcgatattccagttctagctatgtagcaaatagcccaatagtaaatggtttaaaataactgtaatcattttattatctctcctgtgcaccaggaattcagataggaaatagtgtattatgggttgcattgtgtcctgcaaaaggcatgttgaagtccttacccctggtgcttgtggacatgaccttattgggacatagagactctgcagatgtaatctaggtaacatgaagtcattagggctggccctaatccagtgtgattcatgttgtgataaagagaggggaagacacagatacacaaggagaactctatgtgataacagagtcagaaattaggatgatgtagctccaagccaaggagccccaaagactgatggccaccaccaaaagctagaaaggagatgaggaagagggttggatgcagtggcccatgcctgtgatgctagcactttaggaagccgggacctgagaatcgctagaggttaggaaatcaagaccagcctggacgacaaggcaagaccctgtccatacaaaaaataaaaataataacagtttaactgggcatggtgtcacatgtctgtagtcatagctactaaggaggttgaggtggaaggatcacttgaagccaggaatttgaggctacagtgacctatgatggtgtcactgcattccagtctgggtaagacagagggagactctgtctcaaaaaaaaaaaaagatgcaaaggaaagtaaaaaaatccaggatgaattgatagtcatgataccctggaagatttaaacagctgggctggaacagtgagagtttcttgggcatttctttctgtgtatctacagttcctctcctggtcttcccagcatgatggctttgaagacgccatccttcatatgtgttggctcaagactcctaagatgcatagagagagagactgagacacacacacacacacacacacacacacacacacacacacacaccatattgcctgttatgatctaaccagaaggtcaggcagcaacactgccatcacattccattggccaagacaactacagatattctcccagttccaatgaccccatctttcagtggaggatggtcaacatgacacgcaggaagattgtgggggatgagatttatactaatgtagttgtctttggaaaagacaatttgttgcaggaatcaatgggagatgaggatcccataaagggcaagagagtagatgttggcaaacgtgagattaatctgctttgttttttatattctttgcgggtattgaaaatgggattgatttcttgatttgttttttgttgttgttgtttcttgtttgagatggagtcacacattgtcacccaagctggagtgcagtggcacaatctcagctcactgcaacctccgcctcctgggttcaagcaattctcctgcctcagcctcccaagtagctgggattacaggtgcccaccaccactcccagctaattttttgcatttttagtagagacggggtttcaccatgttggccaggctggtctcaaactcctgacctcgtgattcgcccaccttggcctcccaaagtgctgggattacaggcgtgagccactgcacctggcctgctgctttgttttttaattcaacagctcatgcatgttgaaagcccagtgggaaagatccatttgagagggaaaggttgaataaacaagagagttaaaggattatcgataaacagtgcaaagtacctgcaaagacagaggatggaatctgagtacaggtgtaggaactgccttaggagaagtcagggcttctctagtgaaatgggagggaagaaggggagtgtggagatgtttcttcagtttgagtttgcaaccctgaagatgagcaggtttgtgggagatggctcctgcttcctctgtgcaatggaagatgtggtcatgtgctgcaagaaaaaggcagaagcaaggtcagaggtttaggagagttggctaaactgtgaaacactcactgtgactattggaattgccttaatcacaggcacagagtcggggaccacttgtgggtggtgatcagggcccatcttccctgcaataagggaccctagcaacactcaggacatgagtttgggctggaggagacccactcagggttgaggctttgccatctgtgtacaacaaaatgacagaggggccaggcacagtggttcacacctctaattccagtgctgtgggaggcccatgcaggagaatcacttgcagctaggagtttgagaccagcctgggcaacatagtgagatcccatctctacaaaaaaagggtttcgtttgtttgtttgttttgaggtggagtcttgctctgttgcccaggctggagtgcagtggtgcgatctcagctcactgcaagctccacctcccgggctcacaccattcccctgcctcagcctcccaagtagctgggactacaggcacccgccaccatgcccggctaattttttttgtatttttggtagaaacagggtttcaccatgttagccaggatggtctcgatctcctaaccttgtgatccacctgcctcagcctaccaaagtgccgggattacaggcgtgagccaccgtgcccggcctacaaaaaagttttaaatgattagctgagtgcagtggtgcatgcctgtagttccagctacttgggaggctgaggcaggaggatcacttgagcccagaagttggaggctgcagggagctatgattgtgctactgcactccagcctgggtgatggagtgaatccccaaccttaaaagagtaataaataaataaataaataagtaaataataaacaaacatttctgaatttcacatgcaagaaagtgagctgaatgtggtgtcagagaggaaaggcagacaggaagggcagctggcctagaggcgttacagtgatggagggttgtcagcagatgagccatggtgatttgtgccccatgtcacacaaatgcagtgttggagaaccaggaggccaaagagctttcctggcagaggttgtgggactggccccatctctgggttccctggcagccggtgcttcgtgattaccttgcttgtcaatgtgggacctgtgtagtgtcgtctgccccaagttcttctcagtgcccctcaaagtcctcatcctactgatcttggcattcactttttctcatgatcccctgctccctgctgtaataacacggtactttcatttcctttttttttttttgagacggagtctcactctgtcacctaggctggagtgcagtggcgcagtctcggctcactgcaacctccacctcccaggttcaaataattctctgcctcagccttccgagtagctgggactacaggcgcacgccaccatgcccggctaatttttgtatttttagtagagatggggtttcaccattatgcccaggctggtctcgaactcctgaccttgtgctctgcctgccttggcctcccaaagttctgggattacaggcatgagccaccgtgcccggccggtagtttcattgcttattatgatagtagaagtcattttctaattcagaacacaggaacaaaactcatattctagaagagatgtgtcactctgataatcctggttgactccctcaaaagcagcggagtgtgtcattaacatgctgcagttgacaatgggtcatcagagatataggcaatgcacccatataggcatggatctcacatatgtgaagatgaaatagctgtgtttagtatttctcttacctggatttagtggtagttttttgtttccagtgtattttggggctttgtttggatgtctttttattcttttttaatttagtagatttcagatagaaagacctaggagatccatccataggaatgagatgtctcaacaaactatctagaaatattctaacatggacttgagatgaaaagaatctatggaaatgcctagacttcaatcggcatgcaaacatttattgagcgtctactaggtgctggcactctgccaggcctggggtaatcagaggtctctgagttgtggagacattaagtgactaagcacacagaaatgggcagtagcaaatcgggtaaatgatcagaaggaaaagtactgagtgctatgagaaagaacgggggggattgcgtggtgggtggtgggggtggtgtcggtggtcttagttgacctgtctagggaattgcatggaagcatggcttgaaagtggaagaagatagccaggcacagtccaggcagagagcaggactcataggggcctcaaggtctggaaagaaatgggtttgttgagttccaggacctggggaaggcctgtagctgagcagaacagtgcaggctgagagtggtgaggttggaaaagcaggaagaagctcaatcttacagagcctcatgggacaccatgagtcttgggaactttatctcaactttaatgagaaatcattgaagggagaaccacatgatcccacatgggttcagaacagacttggttagggacagagcctaagaggagactgacttggtccaattgcattgggaagccctgtatttaagggctttgctttcttttatttaaaggtttgttgccaccctctgacagtgaacctctaagggtctctggaggatgactgcttgggcaaagacagccagaattgaggtctgagcagggcctgtgagcctcacttgctgtgaaagtgtggtcttggctagtgtctccagcagccccaagtttgagtcttgttccaccccgcatcattctgtgtcctcttaaaaaatatccttccctctactggagcagctctgaataccagtcagggaccagctgaattttaagcctaggctgtttcttctgcctgagttgaggaccctagagggcacttgggggtcacccatcagagcagaatttctcacctagacattgatatctggtgggtagaggccagggatgcttctaaacatcctacaacacacaggataccccccccaccccaccttaagaaattacctagcccaaaatgttgacaaacatgcaataataattgcactattgcaattgtgcagtcataattgcactgttgacaaatatgcgataataattgcactattgcaattgacattttgggctaggtaatgtcttattgtggggtagagggtatcctgtgtgttgtaggatgtttagcagcatttctggcctctacccaccagataacagccatgcctcaccccccagccaagttttaacaaccaaaatatcttcagacatggacaaatatcccccaggagagaggacaaagtcatccttgcttgggaaccatggatttagaacatgacttcccaagagggtaatacgccccccacctcaaggagatagaacattagttttggggggcccaaaatcttagatgttatagtggtttgtagttgaccaaaggagccacagtgtataagcagatgtacagcagatccatggtattgaaatttcatgggaaggaaggcaattagggaaggaaaaaaaaaaaaagtctaaaggctcctgggcaggaatagggggatgataataaaaaaaaaataagaaagattgatttagaccaagagagagccagtttttcctggaggataggaaactggatattgaactggggaaccagagggtacattgggaggatcaggcaggggattagcaaggcacggaaaaccagagactcatggtcataatgacacctaactgtaatcattccccacgtgcccggtaccgtgcccagtggtctgagtgctcacagcaacaccatgatgcagctgctcttatttatctccaactttatagataggaaacagacagacacagattaagcaatcagcagagccgtaatcagatgtccaagtccagagccagtgccctttgccatgatgggtcaggactgacctgtgtccctggaggaatgggacctaaaggagctgattagaggggtttgtaccttggagagtaattttggttttttgtttgtttgtttgttttttcactcttttttttatttttccataagttattggggtacaggtggtgtttggttacatgagtaagttctttagtggtgatttgtgagatcatggtgcacccatcacccaagcagtatacactgcaccatatttgttgtctttatccctctccccactcccactcttccccccaagtccccaaagtccattgtatcattctatgcctttgcatcctcagagcttagctcccacgtatcagtgagaacatacaatgtttggttttccgttcgtgagttacttaagttagaataattgtctccaatctcatccagctcactgcaaatgctgttaatttattcctttttatggctgcgtagtattccatcatatatatatcatatatatatgatatatatatctaccacagtttctttatccactcgttgattgatgagcatttgattggttccatgattttgcaattataaattgtgctgccgtaaacatgcatgtgcaggtatcttttttgaataatgacttcttttctttgggtagataacagtagtgggactgctggatcaaatggtagttctacttttagttccttaaggaatctccacactgtattccacagtggctgtactagtttacattccttggggagtgatttggtataatggattagtagagagcaggggagataggacggagacagagctgggaagagagcaaagggaacacaggaaaggggagggggtgagttggtagaaaactggccaccatacctgtaatccaagcacttgggaagctgaggtggaaagatcatttgaggacaggagcttgagaccagcctgggcaacacaggaagaccctgtttctaaaaaatatgtatatataattagccaggcatggtagtgctcgcctgtggtcccagctacttgggagactggagcaggaggatcagttgagcccaggagttcaaggctgtaacaagctaagatcacaccactgcactccagcgtgggcatcagagcaagaccctgtctttgggaaaaaaataaaataaaataagaaaactgaaaattgggaaattacccaagagggaagaaggaggcagggggttgagagtccaagaagcatggaatcaatcaacctcagaatttcagtgaaatcatgatatgactttctcctggtgcctttgtgcggatcttccctctcctctggctgcacagtgagatgggaacagactgggctgagcagctgcagatggagtctttccagctgacccgtgcaagactggcctttgccatggcctttcacacttgctaagtgaatcaatatgctcccgacttcccccggggcctgtcttaactgacttctttcttgtcctaaacttatgatcttttcaggaaggaattttacgaccatccctaattttaaaaaatcaaaatgcgtagagtatttctcacccaaacttttcatctacaaagagaaatgatgctattttatgccatcttttgacaaatattgctctcttctcagaccccaaatgttggctctttttatctttagtctgtgctgaggaagggctttagattccagtcctgttgctgcagaggcagctcccagctcccagcacacaccccaaaacagattgaccctccttaactctcctttggtaacctaggaagccaataaaagctgtatctttgatgtctcggctttgaaaaagaattgctgtaatgtggcgtaattggagcatttcaaattaggaatggaattatgataattgactctacgtgttactgtctctaagattgttcttgcacacagattcggttttgcttctgcaccctctctctctctccctctgcagcttctgggggatacacagggcctgtagccatgtggcaggggaggtgacaggccagatcattttcaggctcccagattaattgtagattgtcagagggccccaaaagttcatgtagtgtaaacagtgaaatatctgtgtgagttgtcaggtgacctgggcttaaactcctccagtgacaagacactcaactccttcactacttctgccactggactgatgggaacactggaaatagtggatacacctggtactatgccaagtgcatatactgggtactgtgccgagtccacacactaaatgttatgctaagtgcatataccaggtaccatgctaagtgcatacactggatactatgctaagtgtatataccaggtcctatgctaagtgcatacactggatactgtgctaagtgcatataccagttactatgctaagtgcatacactggatactatgctaagtgcatacaccaggtactatgctaagtgcatataccagatactatgctaagtgcatataccagatactatgctaaatgcatataccaggtactatgttaagtgtatacactggatattatgctaagtgcatatactagatactatgttaagtgcatacactggatactgtgctaagtgcatataccagttactatgctaagtgcatacactggatactatgctaagtgcatacaccaggtactatgctagtgcatataccaggtactatgttaagtgcatacactggatactatgctaagtgcatacactagatactatgttaagtgcgtactctggatactatgctaagtgcatataccagatactatgcgaagtgcatataccaggtactatgttaagtgcgtacactggatgccatgctgagtgcatacactaagtactatgctgagtgcatatgctggataccatgctaagtgcatacagcaggtactgtgctacgtgcatatgctggataccatgctaagtgcatacaccaggtactatgctaagtgcatacactggatactgctaagtgcatgcactaagtactatgctaagtgcatacactaactactatgctaagtgcatatgctggataccatgctaagtgcatacactggatactatgctaagtacatacaccaggtactatgctaagtgcctacagtggatactatgctaagtgcatatgccaggtactatgctaagtgcatacactggatactatgctaagtgcatacaccaggcactgtgctaagtgcatacaccaggtactgtgctaagtgcatacagtggatactatgctaagtgcatttaccaggcactatgctaagtgcatacagtgaataccatgctaagtgcatataccaggtcctatgctaagtgcatacagtggatactatgctaagtgcacataccaggtcctatgctaagtgcctacagtggatactatgctaagtgcatataccaggtcctatgctaagtgcatacagtggataccatgctaagtgcatataccaggtactatgctaagtgcatacaatggatactatgctaagcgcatataccagatactatgcttagtgcatatgccaggtactatgttaagtgcatacaatggatactatgctaagtgcgtatacgaggtactatgctaaatgcatacaccaggtactatgctgagtgcatacactggatactatgataagtgcattcaccagattttatgctgagtgcatacagtagatactatgctaaatgcatacaccaggtagtgtgctaagtgcgtacaccagtactatgctaagtgcatgcactaggtgctgtgcataaaccaggtactatgttaagtgctcattgccttatttcattcttagaactgaccaatgaactattattcttattcttattagcatttcacaggcaaggaagctgagtcatggtgcttgcaacaggaggagccagatttgaactcaagcagtgtgacccagcaggttcaattaactaccatgcgatactaccctataatttatctcactcaagctttaatacaatgcttccctgtggctcttatacagggcattggttctgttcgctggagctttatagcacaagcccaagtcctcttctgtacaacatccttcagataactgaccacagttgcatgtctcctcctccttcagagtcttctacagggtaaatgtaccaagttcctcactggtcctctaatctaatgcttcaagtctcctgctgttgaggttcttctcctgtcttgctcagaaaagaacacacccatcatatgtggcaaagagcagagtgcccccattctaggacaagggtgtgtcctatccatttttctggaagctacacttaaagcctgaaatcgtatcacattgtggacagagtgaatcactgcacctgttttcccacaaacaaataaatgctttggggctgtcccttcagaaactaccagtgaaactacattgagaacacttaattcaaggatatcttgaaagctggacacattcttcaccctcaaacttggctcgctcttgaatactatgcagttaaggaaaattacaccggatgccagccttccgtttatttattcttttgctcatgtattcaatatttacacagcaaaggagtgcctactaggtttccgacagaggactgggttccaggcatagaactggccaaccacgatggctcacacccataatctcagcactttgggaggccgaggcaggcggatcacaaggtcaagagatcgagaccatcctggccaacatggtgaaagccaatctctactaaaaatacaaaaattagctgggcgtggtggcgtgcgcttgtagtcccagctactcaggaggctgaggcaggagaatcacttgaacccaggaggcggaggttgcagtgagacaagatagcaccactgcactccagcctggcgacagagtgagactccatctcaaaaaaaaaaaaaaagaaaggtgaagaacttatcagttttgttctcaaaggagaaaacaaacaactcaatagttacaataaggtgtcattagcaaaataaaactgatgtgcccaggataatctggggttagagaagaggactccagggtgcagaatgaattttgactctgatggtgtttcaagagagagaatacataggaaacagaaattcatttagcctaaggaaggcttgatctagccctaacccgaatctacatcatagctaatagcacagtgaatgaggcttacccatttgattgattgattgactgagacaggatcacccactgtagcacagtgaatgaggcttacccatttggttgattgattgactgagacaggatcacccactgtcacccaggctggagtgcagtgctgtgatctcagttcactgcaacctctgcctccttggctcaagggatcctcccaccttagcctcacaattagctgggactactggtgtgtaccaccacactcagctaatttttgtatttttttttttttttttttttgtacagacagggtttcattatgctgcccaggctggtctcaaactcctgggctcaagcagtctgcctgccttagtctcctgaagtgttgggattacaggcgtgagccactgcgcccaaccacttacccatttaaatgcttatggactgtgactattttgaaaagagtgcaacactctttcgaaagttactcaccccattccgaatctgtcacctttggtggtcagcatgcttagatgaacagcgcttcacacaaggagtgtaaaggaggctctataactcttggagtgacacctttttgtgaaactgtcctttctcctatcatcttccatctgagtgagttcctgtttttactgacctgtaatagcatctgctcttctcttgtggcagcaacagcacacttccatcttcacatatgtcaaggttcttgcacgtggtacccagtagtctgattagactgtcttatctcttcgtgggccagatacccaccttcatcatcctctgttctcctagtatataaacaggcctgtgatgagtgaatatttcttaggaggtccttggtttcgttgggtttacttctgtcagcattagccatcatcaagtcttgttcctgcccacatatgtgctggcaggtattcacatacacatgtgggaatcccatcttgattttttctgctcataattctggatcacagttctctacaactggatgagatacactgatatattcaagaagccatatgcggtatgaatgcagtgtacagtaaatctgaaagacaagggtagtgggggtggaaagtaaagctacacagtaatttggtggtcagaaacaaatggcccatccccacaagatcaccttcttggatagatgccttgttaaaatactaattgataccaggagtgttggctcacacctgtaatcccagcactttgggaggctggggtgggaggattgcttgaggccaggagttcaaggctgcagtgagccatggtcatatcgctgcactccagcctaggtgacagagtgagaccctacctaagagaaaaaaaggaaaatacaaattgatacccaagatagcgatatggtgagaagcccactaaaaatacttctaatactgcctgagaaactaaaggagttcatcatcagttcactaaagaattttgtttgaattcttgacttcagtaaattgatgatgaaagaatatgaataaacttaaaaaatctaaagcctgtgagaacattttgtaacacaaaacaataaagtcgtaagagtttaaaggtggatctaattatttcttacttgaaacacatagaaaagttggaagacaatttttacaaattctcaataagatagaggagggctttatacctattaatcataaacagggtggcaggtaataagcaagtggaataaaactgttagaaaacatgacacgtactatttgtttgttgttaatttccactgaagagcaaattaacactgaaagatataaagagataaactcaagaaatactgctgaaggaaaatgagaaaagatgacctgccagggttgtaagacataaagatataatctatgaaaaacataatttcccaaagaaaaggagaaaaaaaaccccacagattaaaagaggaaaacaatctatcccttgattttcacttttctcttggtactttctcaatagagtaaaccaaatgtgaaccagacttccttcttccttcttgatggttaacttccttgggatgcacactgaactaagttaagataggataagctatgctacagtaacaacttagtcctgaactttcagttgcctcacacacaaaacttatgtctcatacctgtaaaatccagtgagagttgaatgactctctagagcagtttccttccaggtggtgactcagggatccaatctgcatcccacttacatgacatagggagcccatattctgttttccccaggaaagttctgaattattcctgttgagctgacataatgatcactaatacctctttttactctcagaaacgtgcatgtgagtacataaatcatatagtcatctgagagtttcaccccctgaatctggctttcaggtcactgcagcaggaaagaaagaatggagactcatgggccagttttgttctgaaatgctttgatcctggagtgatggatactgtttcccacttgccactcatgcagttgctggctccatccatctaccaggggttgggggagggggaagggacaggacttgggttgggatggaggtgtcacgtggacagtcagtgagcagtaaatgtcaggatcacaataaccttagtaaaaaccaaaataaaatgaaaagtgttacacaaatacaagtagtatcaacataatgaaattctcaagtaccatcatataattttgagctctgctattgtaacagcaaagggagacctgaattgtgcttggtttcctccactgtctggccaggttcatagcaaacaccatctcattttttatcccagcatttgaggagtagtcaggtaccagtggagagctgaaagtggaggactggggtcatagaagaccctttgtgagtagtgagggcttgaagaagagaccgaaaaaccagcaactggagatgaactgggaatcctttattattaataattattattattagaaatggggtcttgctctgtcacctaggctggagtgcactggtgcaatcatagctcactgcagccatgagctcctaggctcaagtgttcctcccacctcagcctcccaagtagctggggactataggtgcttaccaccactcccagctaattttttttttttttggtagcgatggggtcctgttttgttgcccagactcatctcaaactcctgggctcaagtgatcctcccattacagcctcccaaagtactgggattccaggtgtgagccattgcacccagccatcttttactcttcctgatcaaagccattctagcatgctctgcctgtctaagtcttctcactcaggatccacatcacagccttgatgtctataccaaaggatgtgccttttatctatttccccggcattggttcgtttattctgaatcttttgtctggacttgtctgtgtggattatggattcagaatgagtgagcatttgagagggagtcgggtaccatagacctgaaagatgaggactgaggtcaccaacgttcctttttgtaagccgtgaaggcttgaagaagaggccaaagaaccagccactgtggaggtgaagaaagaaagcaagttcaatgcatcaggcgaatgggagttgcaacaagaaagtagacattgttgttccaccattcttaactcacagcaaactgagaaaacagagagagagaaagagagaaataatttttttcatttttattatttaaaatttgtttatgggtacatagtaggtgtatatatttatggggtacatgagatgctttgatacgggcatgcaatgcataaaaatcacattatggagaataggatatccacccccttgagcatttatcctttgaattacagacaatccaattacattcttcaagttattttaatgtatactatatgtatatagtgtgactatatactatgtacataatatgagtatatggtgtcaccatatagtcaataataacttaattattactaagttattattaataactatctaattgtgctattagtaggttttattcattcttaagagaaagaatttatatagctgatgtgaaaagtataattaggctcaatcgataaatatttattcatcaattatatgatgagtgaatgaacacatataattaatagacattttttagaactttaatacctcccaaaaagagaatgtaatgtctttttaactgtgtccatgaatcagtcacaaaaattgatctactaagctgcaaaattttcatagaccttaaaaagtagaaaatttacagaccttattctccgatcacaatataataaaatcaaaaattgataatatagaattaaataaaaagacccctgatggaaagatatcctagccattaaaatggtcctaaatgactaggtgtggtgactcacacctgtaatcccagaactttggtaagtcaaggtaggaggaccgcttgaggtcaggagtttgagaccaacctgggcaacgtagcaagactctatctctttaaaaaataactgggcatggttgtgcacatctgtagtctcaggactagctactcaggaggctgaggtggcaggatcacttgaacccaaggctgcaatgagctaggatcatactactgcactccagcctgggtgacagagtgagaccctgtctctcactaaaagaaaataaaaaattttccctaaatacagcattctggggcaaaggagaaaaccaaaaatatcctaacaggctgctaaaaaattattgccagtgacaacaatatttatcagaatccaaggaatgttgccaaaataatgtccaaagggaaatacacagcttttaatgtggtcattattattacatgagattctggagaaatcaggaatattcaatctccatcaaaaaggcatgatgcggtggctcatgcctgcactttgggaggctgaggtgagcggatcacctgaggtcaggagttcaagaccagcatggccaacatggtgaaaccccttctctactaaaaatataaaaataagccaggcatggtggcatgtacctgtaatcccaggtactcaggaggctgaggcaggagaatcccttgaatttggaaggcggaggttgcagtgagccgagatcacgccactgcactccagcctgagcggtgacagagcgagactccatttcaaaaaaaaaaaaaaaaagtccactggccacataacctctgagcttctgtctgatcttttgtctccactgtcttctttatgcttcacatcccattcatccacaggtttcccctgggctccttcagattatctcgcagcaaaacctactctctactccagtgccttctttccccgagaccattattcctccccaccatgggatcttccagctgtctcttcttgctaaggcagatagagtcctgttgttccctcatgagaaacattggttatatccctctactgtctgattgaaatctgtcctctggggtgggcactcaaggcccattccacgtggaccccatccaactcactggattttaagatccagcccagtgttagctgacttttagttaccagtcatcattccctccatcctgggactcttcctctgcttatatttgatttgaccctgtgatatcacagagaaacaaatatcagttgctttgtcttcttcccaatagcttatacgcttctgtgccctgacccacttcctttaggaatctctctgctcctcctcttcctcactgtgcccctgcagaaggtctggagcacacaaatccaagataaatgtttccttgatgacaaagaactcttgtcacggtctagagcagtcatacatccaaaaaaaacacgcacttgcatggtggcatgcacacattaaactcctaggaaaatggagaaattatgtattatctagtgccatgaaaatgctaaaggaatttggacaaagcggaagaccatggtgtagaataacctcggatgccctgatgttgcaaaatggaaagcattgtgtcagtaaagggatggatggaagaaaatgacctcaagcagagagagaaagtgagtattgggagtgtgtggtacagcttaggggccgccttatctggagaggaaaatctccaatgagaagcacaggagatgagcttggatgatccacacacttaccacccagccacaatttgggtgcaagttggtgccatctcttggttgaagcaatcggcatcattcaggccaaaatagatgtctttgttctttttgttcttggaaaccctgctcagtttgtattgacaatgtacattaaattcaaatggaatgttcccccagtgcagaagattttttcaaacttagactatgagagcaaaggaatttgaggtcacacttgagttagtgtgagtaggagaaacaggacattgacccgaatgctttggattttttgtttgcatttggattctatgcctttggattttcatcccacattgcactgtggctaactctagcacaaccacataccccatctgaagaattgggcatatggaaatagacctttagacactaaatatttgtcattttatattgtgcataattactctgcctgcattgcaacgtggaccaccagcatccagctccacgctcttcgtgcattgggtcgaaattagttaaaggaatgcgtaaagaagaggttgtgttcagcaagccatggtgctaatattctgattaagtgtgagctttttggcacacagcgtagatgagatgtgctgttgtattaataggctgtaaattataaataattgcttgataggatgagaacctgaagcgatgggtttctttacagaatgctgattattccctcagtaacaaaagacaagggaaccgattcctgcaattgtttccctttggaaaggaaaggacattttggtctgtcatgttgatggaaaacactagaaatttcctttgtgattattttgttccctttcatccaagctcctagtttattctcacacatgcagacataaactgggcagggtgaaaattccctgcatgaaccattcggttttcggtttgccagtccccatcaatgacaagtatttctttatctggtcagaaaatggaaattctgttttctgagccagccaagataccaggtacaaacagagcttccccctggggattcacagcctgaaggtggttaacggcccccctctcgcctatcaccagactccagtagacgtttctgatgcggggaggctagttctgaatccaagccaacactggttgttggttccaattaaaaagcaattgcattcccagcagttcagggctgcagccaaaaatacagcatgttcagaaaagcatgatcttttttgagaggcggttactccatcaagggatagatgctgccagggagagctaatgatggtacattcgtatgtgataaaaatttaaaagttcaaagaagaaagcaaaaggtagatgatttactttgaagttatttgtagatggcaatgaggattttctgttggtctctttttcccccagcattaatcagcccatttattagaagacaaacaggaattgaccgtttgtcagacagcaaagaaacagagcaatcacattaaggaaatcaaaggcgagaatgtcaaaaggtcagcattaagcagccctgggaagcagtgtcactctgcagacgtttcagccaaatccttctttccatgagtagcctctgctttttgggaggaccaatgagcatagagagcttggagggactttccagttcattgcattctgtctcctctgctggtcagaggcttatgtctgggtatttttagcaacctccctctgtctttgttggctccagaacacataatttcagaaaaatcaggtataaaatctcaatcccagcactttgggaggctgaggcaagaggattacttgagcccaggagttcgagaccagcttgggaaacatagcgagaccccatctctatgattttttttttttttttttttagttagctggacatggtgatgcacacctgtagtcccagctgaggcaaaaggatcacttgagcccaggatttcaaggctgcagtgagatatgatcgagtcactacattgcagcctgggtgacagagtgagaccctgtctctttaaaacaaacacacaaaaaactcataacatggagagtcaagaactctgatttgtttcagatctggatcactcactacaagacctattactttttattttagtcctcatagtgcaggattttatgataaaactgtttagacttgtcaccaacaaagttagtatttcaaaacaaaacaaaagccctaatcccccaaacttttgtgatcacattaagttggatcaacccaaattttccttctggagagagccaagaagtcatagggagcaggttgggtatctctaatccaaaaaatctgaaatccaaaatgctccaaaatctgaaactttttgagcacagatatgactcaaagaaatgctctttggaacattttggatttcagatttccaaattatggatgctcagcctgttaaatacagtgcaaatatccccaaatttgaaaagatccaaaatctgaaatgcttctgaggagttgcagatcagcctaggtaacatagcaagatctcatctctacaaaaaattagccaagcatattggtgcatgcctgtggttccagccactcaagaggctgagatggaagattgcttgagcccaggagttcaaagctgcaacgagcagtgatcacactgttgcactccagcctggtgacagagtgagaccttttctcaaaaaaagaaaggaagggagggtaggacaaagagacagagaggaagaaaggaaggaaggatggaaggaagggagggagggaagaaagagaaaggaaaaaaagaaacagaaagaaaaagaagtggagagagcgaaagaaacagaaagagaaagaaacagagaaagagaaacagagaaagagaaaaaagtaatagagaaagagagagaatgaaagaaacaaagaggagagagaaagaaacagaaaaacaaagaaacagggagggaagggagggagggagggagggagggaggaagggagggaaataagcaaaaaaaaccacttctggtctcaagcacttcgaataagggatactcagcccatgatgtccagcctcacatttctagtgctcctcaagaaggacacggattactgtttgttgccaaggtggcttgtttcaagaccagcgtgattggcaagaatcttccagcaccactgtggcagcttttggtggaaggaatatagccctgactgggaggctgctggggagatgacaaggccagcgcttcagcacatagcctgcagaggccccattgccagtgcctaatgtaactgaacaggccatttgtcatatttaattttagctgcagtggctcaattgggactttatccagactggcttccactctgctagcctgctgtgctccccttgtcccaggctgagtcacttatgtccctggccctccatctgccagcgagacctccgagtcactgatactgagatcatgggccccagatgtggcttttccagcctgtgcagtaaattaaagcaccttggtgccctttttctatctgcactttaggagcaaagcacttttttttttttttttttttttttttgagacagagtcttactctgtcacccagactggaatgtagtggcacaatcttagctcactgcaacctctgcctcctgggctcaaaggattctcctgcctcaccctcccaagtagttgggactacaggcacatgccaacacgccctgctaattttttgtatttttagtagagacaggattttaccattttggccaggctggtctccaactcctggcctcaaataatccacccacctcggcctcccaaagtgctgggattacaggcgtgagccaccgcgcccggcctcaaagtgctttcttactttttactctgcatcaacctcttttctctccaaggaactctgaatgaatgagaccatgagaagaggcttagcctccactcggcttgacaggaggaaaggaaggagctttcccctgaggatagcaggggaggaggtgtcgtcttgcccacctctgtccagggcaggtgtagcacaaggcagcaggaaaagcccagaatttggattcagaaacctcgatcccagttttgaatgtggttcttagttgggcgagactgagtgtctgtaagattgaaccaatgtgcctatagacgagctcccagttgggtgggatgggagggcactcttagatcatcagagagtggggctttgtcagtggtgaagatcagaatgcgcctggcaggtggtcaagactggggctcttactagaatctagtctgttcgagtaccctagggtgggcgattcacagtagtgtctgaagctgaacttgaagacaagtaaattccagattctttcccccccgtcctctcagagacttgattgcttctcttgtcctcactcgctcctcaacctcaccttttgttggctcttttttaccatatgaactggccagtcttcttcctttccagctgtgtgcttctctcctggaaatatttttttattattatttttattatttatttagtaaatatcattaattatatactaatatataactaataactaatatataaatatttgatatgttaatacattatatgtaatataaatatataataattacatataactatataatctgatattctggatattaggcctttattggatgtacagtttatatattttatatttatatgtaatataaatatataatgtataattataatcataacatgtaatataatacattataatatataatatattgtgattgatgtatataatatataattacaatttgtttacattatatattatatttatatgttatatattatgtgttaatatgtaactaatatattagtgtatacattagttaattatataatcatattatatattataattatgtattgcatattatattataaaagtatacattatataattaagaatatataattcttataagaatcatattaagaataaataattattatatcatatggttaataattaactaatttatatatgaatatattagttctatattaatatataaatatattaattacacattaaatactattaactatatgaatatataaatatattaattatgccacatataattttattatatatgtgattatgtatcagttatatacttaattatatagtaaatattatttatacaatattatttatttacttattcatttgcatttcaacttttattttagatatgggggtacatgtgcagatttgttacatgggaatattgcatgatactgaggttggagtatggattccatcacccaggtagtaagcatagtacttgatagatagtatttttggttttttttttgcaggggcggggggggttggtttttttgttttttttttttttgagacggagtctctgtcaccaggctggagtgcagtggcacaatctcagctcactgcaacttccacttcctaggttcaagcaattctcctgcctcagcctcccgagtagctgggactacaggtgcccaccaccactcccagctaatttttgtatttttagtagagacagggtttcaccatgttggccaggatggtctcgatctcttgacctcgtgatccacctaccttggcctcccaaagtgccgggtttacaggcatgagcaactggctgcttttgtttgtttgtttgtttgtttgtttgtttgtttgtttgttttgagatggaatctcgctctgtcacccaggctggagtgctgtggcgcgatctcggctcactgcaacctccacctccctggttcaagcacttcccctgcctcagcctcccgaataggtgggactacaggtacttgccaccatgtctggctaatttttttttgtatttttagtagagacaggatttcaccatattagccagactggtcccaaactcctgacctcaggcgatccacccaccttgacctcctaaagtgctgggattagaggtatgagccactgcgcccagccgatagatcgtttttttaacccaccccctgcaaaccctctagtagtccacaatatctgttgttcctgtgtttatctccatgtgggctgagtgtttagttcccatttataagtgagaacatgcaggatttgattgtctgtttctgcattaattcacttaggataatggcctccagctcaattcatgttgctgcaaaggacataatttcatttgttttatggctgcctagtgttctgtggtgtatatgtaacacatttcctttattctaccattaatgggctcttgggttgaccatgtctttgctattgtgaatagtgctgtgatgaacatacgagtgcaggtgtctttttggtagaatgatttcttttcttttggatagatacccagtaatgggatggctggctcgaatggcagctctgttttaagttctttgagaaatcttgaagctgctctccacagcagctgaactaatttacattccttccaacagtgtgtaagcattcccttttctcccgtgccatgccagcatctgttgtttcttgcctttttagtaatagccattctgactggtatgagatggtatctcactgtggttttgatttgcatttctctgatcattagttatgctcaccattttttcatgtttgttggctcacttatatgtcttcttttgagaagtgtctggtcatgtcccttgcccattttttaatggggctatttgctttttgcttgttgacttaagttccctatagattctggattttaggcctttgctggatatataatttgcaaatatcttctcccgttctataggttgtctgtttgctctgttgatagtttcttttgctttgcagaagctctttagtttaattaggtcctacttgtctatttttgtttttgttacagttgcttttggggacttagccaaacattctttgccaaggctgatgctgagaagagtatttcctaggttgtcttccatgatttttattgtttgaggtcttatatttaaatctttgatccatcttgagttaatttttgtatatggtcaaagataaggttccagcttcaatcttctgcatatggctagccagttgtcctggcaccatttattgagtagcaagttatttgctcattgcttctttttggcagcctttttaaagatcagatggttgtaggtgtgcatttaatttccatgttttctgttctgctcattggcctatagtaccaagctggtttgactactgtggctttgtagtatagtttgaagtccagtagtgtgatacctccagttttgttcttttagctcaagattgctctggctatttgagctcctttttggatccatatgaattttagaatagtttattctgattccgtgaagaatgacattggttgtttaataggaataacattgaatctgtaaattgcttttggccatatggccatttttatgatattgagtcttctaatccatgagcatagaatgcttttccatttatttctgtcatctctggtttctttcagcagtgttttctagttctccttgtagagatctttcacctccttggttagctgtattccaaggtatttcattttctttgtggctattttaagtaggattgtgttcttgatttcaccctcagcctggagattgttggtgtacagaaatgctactgatttttgtacattgattttgtatcctgaaactttacttaagtcgtttatcaactcaaggagccttttggcagagtctttagggttttctagatatacagttttattgtcagtgaagagagatcattggatctttttttcctgttggatgccttttctttttttctcctggctgattgctccagctaggacttccagtactatgttgaataggagtggagagagtgggtatccttgtcttgtttcagttctcaatgggaacaatttgagcttttgcccattcagcatgatgttggctgtggtttgtcatagatggctcttattattttgaggtatgttcattcgatgtcttgtctttcgagggtgtttatcatgaagggatgttggattttattgaaaaccttttctctgtctattgagatgattgtatggtttttgtttttgattctgttctgttggtgaatcacacttagtgatttatataagttgagccagccttgtatcccagcaatagagcctgtgtgatcatggtgtattcacattttgatgtgctgctgaattcagtttgctagtattttgttgaggacttttgcgtctgtgttcatgagggatataggtttgaagttttccttcttgttgcatctctgccagattttggtatcaggctgatgctggtttcatagaatgagttagggaggagcccctcttccttgattttttggaatagtttcagtaggcttgatatcagtttttctttgtacttctggtagaatggagcccaagagtttgaggttaccatgagctatgatcatgccactgcactccagcctgggtgacagagcaagaccctgtttctaataaattaaaaaattacagtcacaaaaactgttttaaaaataaaagtttttgaaaccattcttgtcactcagagagtaatttttaaataaattggaattaacaaaaaaaggcacaaaacctttatttaattgatgcataacggatatacatagttttggggttgatgtgatcatttaatgtattcgtgtaattttcaaagatcaagtcagtgtacgtgggatatctgtcaccttaaatatttgccttttctttatgcaccaaacctttttgacagaaaaggaataattgtcagaagcataaagccttgtcagtgtcaagtttctgctgacctcttcagctattctggttgtcatttttttttctggcatcaataagcattttttccctttggataaatatcaagtttattctgattctcaattcacattggcttgcaaattcagatgacactgaagaccaaattactgcctgtgggacaatggactttgtttagttgctaataggggatttagtagatagcccaagagacaggatatgggtctgagattacacttagttgcattttttaaaaactatgttaattataggcttaagtcatgtattcaaatgcagatataagaaatacagcattcccatattttaattggatccttaggtaaagagagttttagccactcagctattaatccagcctgaacaactctgctataaacgcactttcttctgagcgccttttttttttctcccttgccttacatcatgctctgtggcctcctgaacttttccttttcttctcagtatacatgaaatacttatagctacttcattagctttcttctgtcttggatcacaagctctctaagaagagcatctatgtcgattttattcatcagtgtatcacctgacctgcctagcatggtgcccggtatgacacttaaccttaaagaaatatttgtaggaaggatggctgaataggcgggtggatggatggatgaatggatgaatggatggattgatggatagatggatggatggatggatggatggatggatggattgatggattgatggatagatggatggatggatggatggatggatggatggatggacagacaatggataaaaataataattttttctttcttctatttttgacaactgtgataagatcataacatcctaggctagatggatggatggacaacagataaaaatatttttttcttctgtttttgacaaccgtgataaaattataacattctagggtagaaatggaaccctatttgatgcaccctttaattcttcatcgaagggttcccttggcctctcttccagattggtcacatactgtgtcactaagaaagggctcttgccctcctcccttagaagagtaaactaactttcttttgatcatggaccctggggttcaatttttttcatttgtcaccaacaaagagaatatcattcctgcatggatatcttggcagctgcttgattttccctccttggagaggagagaccagtaaaccttacaccataatctacccaactcctttgctgtgagagactttccaacttttggtactttggaatggtggccctgcaaccgaagaggtcagtgggcaggaccacaggctgcatagctttggagcacacctcacaggggaacagggacccagcacaaaatctgcgggaatggaactcctagaatgggcaacatggcggctctgccattgggctggtagaaggcctgttctgcaggctaccaatatgagagtgccccattgtatcaatcaaatgttctaggcattcttctggggctttcctcacatagaaaatgaaatcatactcttccaagtgttaagtgcatcaattcaaacactggacacagaagactttaagacttactcgatgaaagcagctggaatcctgagtcttcaaagatatcttcttgtctctaggatgagtggcctgacctgcaagccctctgggtgtctgtcttcactctcactggtgtctctctcggcttctgctggctttaatcttgaatgcatcaactgtcttggactcctaccttgcccatgacaacatgaagtttctctttatgtcactttaggatctaacacttccaggacacaacagctctcatgagttgacctgactctttctggattgatctctgtcactcctgtttgtaggctgagagactgctcttctggtctggttagagatgggaagaggtggaaggactgggaagaccacaggctcttcagacaatcctccataaatacagattctcccaggcgagttctaaggcactataggtagcaggaagttggcaatagtgctcttggtaatgtttagaatgtctcttacaaaaccctgtgctggactttgagggattcccatggggatgaatcaagatctttaagcccagactttcctcactgaccctgccttttcccttctcaccatcccctctggactccatcttatgctcttcaagttgtcaagttgtttcctctgaatgactgtggtatttggcctacatcacaattcacctgccacttgccatctcctgggtctgaaccttatccccgctttcagactatgagctcctaagttccctgagagaggatatcatattctctctgtttgcgtagcagtgaaaatcatcaaacttcctgaatgcaaaccctgtctctgtggtttactagttgtgtggcattaggcaagttacttaatctctctgtgcctccttttcctcatcagaaaatgagaagaagaatcatatctgctttccagggtttttgtgaggtttaaataaataaatacatgcaaatgactaaaacagtgcctggcttggaggaagccttcgtacgtgtaagcgcttgtttctgctctcggtggtagttttttttcatttctattttattttattttatttatttttgagacagagtcttactctgtcactcaggctagagggcagtggtgtgatcttggctcactgcaacctctgcaccctgggctcaagtgattctcctgcctcagcctcccaagtagctgggattacaggctcacaccaccacgccaagctattttttgtatttttaaccttgcccaggctggagtgccggacaaggtttcattacgttggcgaggctggtctcaaactcctgacctcaagtgatccacctgcctcagcctcccaaggtgctgggattaccggcgtgagccaccgtgcgtggcctcagtggtagttttgtttctcctggcatgaaggtgcttaggaagcatcagccatggtgtgcatgcatgtgtacacatgtgagcatacagtcttcccccgtcctgtcatctgcatttccaccatctttgtcccttcaccagacaatggcaaaagacaggaccaaaactccagttgcttaaagacccaaaacatggatctatagtggaccaaggggtccccaaaaccgtggtcagaatgacaactcagaatatcccccaggaagtcaaggaagccaggcaggacaaggcctgtcacagactggacaagagacacagacacccagggctctgttttatggctttgcgatgtcggcggctgtcccactctgtgcttacggttggggtcagcagtgaggtgctgatttcctgtatttgccactacccagagggcatggggctccaggttaagatggatgacagcacttcaaagatgaatggagtgaacattgggaagttagggagctgtgcagcggccattatctctgagtgtcctcacaccagggcctaggatctgaaaaggtctcagggcccccaggcgttccatgggccatactttgaaaaccacagcagaagagcataaccaagggagggctgtgtagagaagagcagctgtgaggccggtgcgttcatggggttctaggtataattaagggctgttttacctttctgttagggcccaagggaaattaaacctggccttataccaattgcaaggggaaaaaaatgacgtaaaagagaatggagaaaaatgatggtttcatcagtaagtgtcattcactgctgtagagcaccctttctcaaactctggtttcagctcccctttaccatgttaaaaatgatggatgaccccaaagagcttttgtttatgggtgtcctatctatcgatttttactatgttggaaattaaaatggaaaactttaaaaatatttctgcattaaatcattcaaaagcaataataataaacccattgcaggttaacataaatcacacaattttgtgagaaataactgtattttccaaaacaaaaacatattagaaggaggacggcattgttttaaccttgtcgcaaatctcttgaggtcctggtagacagcaggtggatgcttgtttctgcttcatacatttcattcatcattagagcaatgacatcgtgccatgtgatgtgtcctctaggaaactccactgtacgcttgtaagagagtgaaagtgaataaggcaagtggcgtcatagcataattataaaaatcattttgacctggtagagccctgaaaagctctcaggatccccacaggccacactttgaaaaccacagctgaagaacctaaccaagtccatgtcacttctttggtctccagcctttgtttttatttatttatttatttattttgagacagagtctcactctgttgcccaggctggagtgcaatagcacgatctcggctcactgcaacctccatctcccgagctcaagcagttcccctgactcagcctcccgagtagctggaattacagatgtgtgccaccacacctggccaattttttatatttttagtagagacagggtttcactatgttggccaggctggtctcaaactcctgacctcaggtgatccacccgccttggcctcccaaagtgctgggattataggcgtgagccaccgagcccagctggtctccagcctttataaaaccacactccaagtatttgccttgcccttagagatgtatgttttctcctcctctctttttaaattgcttataattttttggtgttttttgttgggggtggggtgatcatgtaatggaagcctgggaaggttctgattgactggccctcgggaaccctgggtttgagctcagagcccatgagctgtgtgattgcaagcaggtacttctcctttcgggacctcacttttccagtttatgaaacacatgacttcagcagtctccaaagcgctgacagtctgtgtttctctgagacttaaactggagagaccagatgcctttcccatctgttatgggctaaattgtatactccaaacaatcatatgttgaagccttaatccccggtacctccacatttgactgtatttggagatagggtctttaaagaatgaagttaaaataaggtcattggggtggactctgatccaatatgactggtgtcctcgtaaaaagaagggattagggctgggtgcagtggctcacacctgtaatcccagcactttaggaggccaaggcaggcagatcacaaggtcaggagagcgagaccatcctgaccaacatggtgaaaccctgtctctactaaaatacaaaaaattagccgggtgtggtggcacgtgcctgtagtcccagctattcaggaggctgaggcaggggaatcacttgaacccgggaggtggaggttgcagtgagctgagatcacgccattgcactccagcctggcaacagagcaagattctgtcaaaaaaaaaaaaaaagaagggacacagacacacacaaaggcaagcccatgtgaagacaaagggaaaaatggctgcctctaagccaaggagagatgcctcagatgtaaccacccctgtggataccttgatctcagcctgctcgcctccagaattgtgagaaagtacattcctgtggtttaaatcaccagtctttgggactttgctatggcagccctagcagactatacacactatttattatgttctctaatcctgagtccaggcatcttttccaggctgttgctttgaactcaggcttacctctttgttttcaagataattgctctagaagctgaatgaccactatttggagatgtaagctaaagattcttctggaagaatacaccatctggacagctcaggagccctgagtgctgaaagtttctgtgatgttcattcgctttgtctgttatccaaggggagagaaaatgagacacaatgggcatcttcagggtagaactacaccacctttgattaaagagaaatcaagaaatgaagttgaatttctgatgtctgcttactctcatgctgagcctcgcagagggagaatgactacagcctagagctgatggcttcaggagctgtagtgtttatcagatttgctccatgggtggccaaagctgggtgatggggtctcaatggccaggactgggcgccccaggaacctcaggcctttctgcatcagcacagatgcttatccattgacttccagtcacttgtgacctcggggtaaaggaacatgaattaagaaaacctcaggctcagtttttccccaaagtatgttgcatggaatacagtttcatgggttgtcataggtcttctgcaaaaaataaaggagtttcgtgaacagacacgtttggaagcttgtgacttaaacagagttaagtgggcttcactgctgagtgcaacgtggtctccccagcatctttacaatgctgtgttcattacaaatatgtatatgagaaaggggcatttcccaaaccggtgcttctgcagatgggtttgctatgctaggttacccacactggagcaacagcctttccaggggaggattgcttgagcccaggagttcgaggccacagtgacctgtggttgcaccattgcgccctagcctgggcaacagagacagacccggtctcgaaaagaaaataaaaggaaaagaaagaaacagcctttccagatgaccttcagagcttgccatggctgccttgagataccccaatggcgggcagtgggcagtcaaagggcaaatggccagagtagtgagaacagtggaggccatcaacagaggtacaaccacggcctccccctccttttcatctgtcaaagaaccacaagacctgtccggtagacaatagataacaagacctactacatccacagtatccacagttctttttttgtttgttcaaatcattgtcataccctaactctaacggacaagggaaataaaagaaaggtaatttacaataacatgtatattgcaacgctccgactcagctatcaactgccaagaacaatgcccccccgccccatagacttgtacatccctcctgggccagagccagctctcctaagaccataacagttcttttcgaactatttatagcctgtatccttattaggagtgatacggctgccaacagggcaataattggttcttgaaggggggtgcaaaagagtattacacttttatgtgtaaatcacagatacacatacagcatgcaagcagatatacagcgcatctgtggtattaaaatttcatagtgggagcaggtaggggatctcagggggaaaaaagtctaaaaatgcctcatagagaggtgataatgaaaaaaaaaggctgagagacactgatgtggagtgaaggaccagatcttatttccaatctatcacgcaatgatacttttataaaatatagtaaaagtgaattcctagaaaaataaaataggaaaaagagaaacaaatgttaagctccacgtttttattattagattcaaccgacataaatttgctctattgaattgctagaaatgcttttttttattttttatttttttaagacagagtctcacttttgtcgaccagactggagtgcagtgacatgatcttggctcactgcaccctttgcctcctgggctcaagcaattatcctgccccagcctcccgagtaactgggattacaggcgtgtaccaccacgcccagctaatttttgtattattagtagagacggggtttcaccgtgttggctatgctggtctctaactcgtgacctcaggtgatccgcccaccttggcctccgaaagtgctgggattacaggcctgagccaccatgcccagccaatgtttttaaagcttattcagaattggccaggtgcggtggcttatgcctgtaattccagcactttgggaggctgaggcacgtgaatcacttgaggtcaggagttcgagaccagcctggccaacatggtgaaaccgcgtctctactcataatataaaaaattagccaggtgtggtggcaaacgcctgtaatcccagctactcaggaggctgaggcacgagaatcgcttgaacccaggaggcagaggttgcagtgagcccagatcgtgccactgcacctcagcctggatgacagcgagactctgtctcaaaaagtaaaaattaaaatttaaaaaaaagcttaccatttgcatctgaaccactgttcagactgtttttggatggggagtagtccatgggccacgcccctatctgggggcactgagggtagagaagcagggcctagaagaggggtctagaagggtcaagaggagttggctggtggagaagaaggaaagattgtttcagagagaggaccctagcagaggcaccaagcaggaagtgcatggcacctgtggagtggccagtggcaagttagggttctagcagagagtgagggggcagaggaataggggaggccaggcaggaggacagatcaagctgctccagccaggagccagcccacaatcctgcgggctgcattcacaccgtgttctgttaataaccaagtggagcttcatgctttggggtcattgagaatctgatgacatctacctatgcaccctgtcctgaagacattacaaactcagaacatcatctaacaatcttgggagctggttttgggatcccttaaagcttatctaaaatctctaggttcgtttttatttttattttcagttgtattttgagacagggtctcgctttgtcacccagaatcaagtgtgatcatggctcactgtaccctcaaattcctgggctcaaacaatcttcccacctcagcctcttgagtagcggggactgtgggcacttgtcccaactaattatttatttatttttggagaattgggagttgggaggtcttgctatgctgcccatgctagtcttgaactccgggcctcaagcaatccccctgcctcagcttcccaagtagctgggacagcaggcacaagccaccatgcctgaattatatttttaaacttttttatagagaggcagtcttgctgtatttcccaggctggtctctaactcctgaactcaagcagtcctcccatcttggcctcccaaagggctgggattattagtgtgagccactataccaggccaaagtcaccaggttcacaatacctcccaaacagttgagctgataaaccctcctcatgtactcattccttctagtccatgtttattatatcgtaactttgtgctgactccagtactatcaggcctgccagatagacacaggactgacaccacccagagatcattagcctgggatccagacatccaggggcaatgctgagactaaagccaactcctgaactcaagcagtcctcccaccttggcctcccaaagggctgggattataggtgtgagccactacaccaggccaaagtcaccaggttcacaataccacctaaacagccctttcttcaggtaactgaaaagatgctcttacaaggaccattaaggctcaagataaggaacagccttcgcttggcaaactcccgtgccaaaaaagccaaggataaactcagaacatccagtctggatgaaggtctcagcattgccctaacacacccataaggcccccagtgcactgatcccctcctcctttccttgacctctttttgtctggctgactctgcatttctatctcttttcatggaccctaatgagtttcaccgggtagctatggtggccaaggacactcagaaccggaatttcattgatgcttgttaggattgatacccatttagtggacaatctcatcaatgtttgcatggaatgtaaaaatcagccagcaaatggaaacatacccagagaggcagctggtgtaattggccctcacaaacacatgagaagtgctcttctaaaaataccagggcacctcatactgaaaggcaggccagagactgaattcagcaagagctgaaaacagccaggacaaagtgtttggatcttccagtgcaatccggaaatcatggagcttgatattgaggacccaagggagaagtgccatttcagatttaaagaaaataagcaaatttgagataggccacgtcgttagaatactacccaagaatagtatgtgttgatgctgataaattagggtacaggtacttcaattcgtttattcattcagttgttcaatgagcacttactgggtaccaggccctattctggccctgggaatgcaggaaggaacagaacagatacaattcctgcctgttgcagtggacaatgagcaaataaatacataatttggagaaaggagagagagattggaagggagaggggagattgttttgcattctgtagccagggaacattgtggtgtaaggaagtgtttaagtagtaaatcttttatttttatttttactttttttttttttcttgagacaattgccctgttgcccaggctggagtgcagtggtatgatcatagctcactgtagcctcaacctcctgggctcaagcgatcctcccatttctacctcctgagtagctggtactgatggacatgcatgaccacacccagctaatttttaatattttgtagagaggtctcactatgttgcccaggctggtctggaattcctgggcttcagctatcatcccttattggcctcccaaagcactgggattaggtgtgagccaccatgcccagactcagtagtaaatctgaatgaagtaagggaacaagtcttgtgggcttctggaggaagaatattccatgtgggaaggatgggaaattcaacagcccttcaacaagaacaagcttggtccagttgaggaagagcaaggaggccactgtggccggagtggcatcagcaaaggtgagagtgagaggagataagggaaggaaggaggaggatgaaccatttgccgtcatgtagatcttggtgtgtactctgagtagaatgggagccatgggagggttttgagctgaggtgcaatattgggatggttaatttcataggtaaatttcactggtcgcagggtgcccggattaaatattaattctgcacgtgtctgtgctggtgttttcagaagagattagcatttgaatgggttaactcgcccagctgagttattctttttttgtgtgtgtagagacaggggtcttgctctgttgcccaggctggtctcaaactcctggcctcaagcaattctctggccttgttcacccaaaatgctgggatgacaggtgtgagccactgcatccagccctttaaagaaggctttaaaggacctgaagatgtttagtctaaaaaaaaaaagaaaaagaaaaaagactggggctgagagagccctttcttcagatacctgaaaagatgctcttacaaggaccattaaggctcaagataaggaacagccttgtgtccggccaagcttttccactgtggagcaggctgcttttccactgtgagcttttgtccctggaagcaaggccctgggggaccacctgccgggtgccgggagcactgggatctgcctgccctatttcaggttgtccatgcatgcattcattcctgtgatatggatgggattcccattgcccggtgttggggttcgaatattacacaagatccagccctagccctcaaagaaaggagaaggcagtaggtgctctgatggggtgagagtgtccatgaggggccctgttctgacttgggtgagtagagtgatatctacgaccaagctcaaaagcacaagcactttcagccgagctgaatacatctaatgcatctgtgggtctgtgtgtgttggggacaaggatgaggagagaatctgggaccacgctagacatggatggaaaatacaaccagaatgtagcaagtgagaagggctggtggaaactccttctctcagggcccagaccagggggaggattgtgagcccggggaacctgtctttatttcaacttctgacattttgctcaccgtggattttctgcatgatttttgatttattaaacattgcatcaaaatactatttatcttggccaggcatggtggttcatgcctgtaatcccagcaatttgggaggctgaggtgggtgaatcacttgaggccaggaggtcgagatcagcatggccaacatagcaaaaccctgtctctactaaaaatacaaaaactagctgggcatggtggcacacgcctgtaatcccagctacttgggaagctgaggcatgagaatcgcttgaacccgggagtgggaggttgcagtgagccgacatcgcaccactgcactccagcctgggcgacagagtgagactctgtctcaaaaaaaaaaaaaaaaaaaaaagaaggttgattattgattatttagttctagggggtgcttaaatgtggttcacagagaatggcactgggaaggtgtcagtgaagaaaacatagtccctgccattctcactcgccatgtcccaggcacagcccggctgtgggttgggaaggtttcccaatatggaacactctagtgcaatgtggggagtttgcatcataaaatcataggatggggcttcaaatcatggcctgcctaacctgaccccctgcaaaggggcagactgaggctacgcagtttgtcctgggggccgggatagctctcctgtcggctgatggcttggggaggattctcccgaagtccttattcagaagcaaacttcttttaccaggcagggagtgttaaagggaaatgtggccgaggaaatgaatgcggctgtcagtatttaccggctcattatttatttatttatgtaggggatttctgttctctctgctaatcttcatataacatgcctcattgccctctgagggccccgagaggatcctcgcagcatttgtagggtggaatttgttcttgaagctctgtttctggttgctcattccttgcttccttgcaaataccagagaggaaatgagtcatctcagagacaagcctctcactcattcctaccagctgctggcaaatccaaggcgtaattggcatttgcaggtagggtccaaaggaaaaagcacatttttttgctttcagtttgaagtcatgtgctcagcgacatcaagcattgagaagggagccagccccgggcaaggcagagacaaagggggttggggagcttgggtggagggcccaagggcccagcccatgcccacacacatggtgtgactggcctcctgtctattaaactctctctactacaatactgtggtctttctttatgcagtgggcaggaagaacccctcgggcagtgacatctctcaaatattgtacattgtattcgacaggtaatcttgcaaccctcagccccctccttccctccccctttttggagtctccagtgtctattacttccatctttctgtccatgtgcaattggtagaatttagacctcctaagggccgtgtggagccactgaagatggggagtgccatggtcagatttgcacttttggggggtccgtttgttgacaaaaagagtcaaactctgtaaaatatttgaagagatttattctgagccgaatgtgagtgaccatcgcctgggacacagccctcaggaagtcctgggaacttgtgcccaaggtggttggggcgcagcttggttttatgcattttagggagacatgagacatcaatcaaatacatttaagaaatataagccaggcacggtggctcacgcctgtaatcccagaacttcgggaggctgaggcgggcagatcacctgaggtcaggacctcgagaccagcctgaccaacatggtaaaactccgtctctattaaaaatacagaaattagccatgtgtggtggccagtacctgtagtcccagctgcacaggaggctgagccaggagaattgcttgaacctgggaggcggaggttgcagtgagccgagatggtactactgcactccagcctgggcgacggagcgagactccatctcaaaaaaaaaaaaaaagaaaaaagaaaaagaaaaaaagaaatacattggtttggtccagaaaggctggacaactcgaagcagggggtttccagcttataggtcgattaaaaattttgctgattgacaattggctgagtttatctgaagacctgggatccataaaaaggaatgccagccgggcatggtgactcacgcttgtaatcccagcactttgggaggctgaggcgggtggatcatgaggtcaggagttcaagaccagcctggccaacacagtgaaaccccgtctctactaaaagtacataaattagctgggcatggtggcaggcgcctgtaatcccagctactcaggaggctgaggcaggagaattgcttgaacccgggaggcagaggttgcagtgagccgagatctcgctactgcactccagcctgggtgacagagtgagactccgtctcaaaaaaaaaaaaaaaaagaggaatgcccaggttcagataaacgattatggagaccgaagttcttatttgcagaggaagcttttaggtactaggctttagagaaaagaggttgtaaaatgtttcttactagacttaaagtctgtattgatgttaatgctggagagatatcatgaggcctgtctgacccccacttcccatcatggcctgaaacagtctctcgggttaaattttaaaatagccgtggctaaggaggaagtacattcggatggttgaggggccttagaatttcatttttgtttacacattatatttgtatgtatttatggggtacatgggaaattttgttacctgcatagaatgtgtaattgttaccagaaaggggtcctgatccagaccccaagagaaggttcttggatctcatgaaagaaagaattcagggcgagtccatagagtaaagtgaaagcaagtttattaaaggaataaagaatggttactccataggcagggctgctggttgcccatttttatggttatttcttgatgatatgctaaacaagaggtggattattcatgcctcccctttttagaccatatagggtaacttcctgacgttgccatggcatttgtaaactgtcatggcgctggtgggagtgtagcagtgaggacgaccagaggtcactctcgtcaccatcttggttttggtgtgttttggccagcttctttactgcagcctgttttatcagcaaggtcttcatgacctgtatcttgtgccaacctcctgtctcatcctgtgactaagaatgcctcaacctcctgggaaggcagcccagtgggtctcagccttattttacccagcccctattcaagatggagtcactctggttcaaacgcctctgacataatgatcaagtcaggccatttggggtatatccatcatctgagtatttatcttttctatgtattgggtacatttcaagttctttcttctagctattttgaaatgtgcaatacattgttgttcactatactctgtgctttaaaatcttgctgcagaagagatgtggctcatagctagaagcagggagtgggggacacagggagactattagaacactgcagttctctggggaagatggtggacttgggaagaggcagtggggacaggtgggataggctcccaaggaaggaggatggacagatccaacacataggggaagggccacatctcccctgtaacaggagggtaggtgggaatctggttcaggtggaggcaaactggtttggcaacagaggactgagtgacttcccactgggtggtttccgtttgctccagtaaatagcaggcgacgtcatcagctgaaagtgagaagtggttggagatctgagaacagggaagactgaaatagctgcagtgaagacccaagaaggagttttccgggtagacttagcaggcttctctggctgtatcaagtgaccagtttaggtttgaggacatacattgatagtgacaactctgtgtgcctgtacatttttctccagtcttattcagtcgttgggatattggtccagaaaatgcaggtggttggttcaatcccaggttgtggttttgccatgtgagtgcagtgataggtcagtggtacaagaggtaaaacagtaagagggtgtggaagtgatggagaacagactgtaagctggggacgaaaagaagagaaatgcatagcaaaaatagaggagtagtgtctgcagatggccaggattcaaatcccagctcaacctgggatggagtcggatgacttagagctattttttctttaactctctgtgcctcagtttcttcatctgtaaaatgggcagcacagtagcacataactcatcatgttattacgtgatcgaattaacaaggagttaataaatgtaaagtgctgaaaacacagttacatgctagctctcattactttgttgttgttattatttatttttatttatttatttatttttgagacagagtcttgctctgttgccaggctggagtgcagtgacgcgatctcggctcactgcaacctccatctcccaggttcaagtgattcccctgcctcagcctcccaagtagctgggactacaggcacagccaccatgtccggctaattttttgtattttagtagagacaggatttcaccatgttggccagaatttttctggtcttgatctcctgacctcgtgatccacctgcctcggcctcccaaagtgctgggattacaggcgtgagccaccgcacctggccatttttttttttttttagccatcaagtagcctgagggcttccctccaaataggtttagtgggagtaagtgaatgagagaaccagaagaacagaagcctgaggtcagagtgagatgtcccaaatggggccaggatggaaccatgggaacaggggcttgccagggagggtgagggtcagtcgagatagggagtttgggacatagctcagcactgacttggtagatgagtcacaggctgggatctcctgtacgctgtcgctgtgctcagccagcatgtcagaccatctgctccatctggtgaagtgagcagtgctaatattgctggaaaggggtcccgatccagaggccaagagacggttcctggatcttgcgcaagaaagaattcagggcaagccatagagttaagtgaaagcaagtttattaagaaagtaaagggttaaaaggatggctactccataggcagagcagtcccaaaggctgctggttgcccatgtttatggttatttcttgatgatatgctaaacaagaggtgagttattcatgagttttccaggaaaggagtgggcaatgcccagaaccgagggttcctcccctttttacaccatagagggtaacttcctgacattgctgtggcatttgtaaactgttatggcattggtgggagtgtcttttagcatgctaatgcattataattagcatatagtgagccttgaggaagaccagaggtcactctcatcaccatcttggttttggtggatcttggccagcttctttaccgcaactgttttatctgcaaggtctttatgacctgtatcttgtgccaacctcctatctcatcctgtcactaagaacacctagcctcctgggaatgcagcccagtaggtctcagctttatcttacccatcccctattcaagatggagttgctctggttcaaatccctctgacactaatatcaagtcttagagtggtagatgaagaaaagaggctgtccctcccctggaaggttaggaaagggcttctggaagagggtccctgggccttgaaaagagggtgggatgtggacgaaaagggcatcccgatacagacacggcatgggtagtccttgaggttagaatggacggagaagcatgcagtgaagtctaatgtggatggctggggaggtgagtctgagagtgtaggtttatcaaggtctaatcagacaggtcttttggtattctggttttagcacctgccatccaaagagtaggtgaggcctctaagtctggattctgcatactgcgatccatgacgttaggtaggtggacagtgctgtttcattatgttaaatgaaacaagccagacacagaaaggcaaacatcgcatggtctcacttatttgtgggatctaagaattaaaacaattgaacacatggacacagagagtaggatggttatcagaggctgggaagggtagtggggggttgtgcaggggagataaggatggttaatgggtaaaaaataaaaaataaaaagaatgaataagacctactattggatagcacgacagggtgactatagtctataacaactcaattgcattttaagataactaaaagagtttaattagattgtttgtaacacaaaggataaatgcttgaggggggatgaataccccattctccatgatgggattattatgcgttacatgcctgtgtcaaaacgtctcgtgtaccccataaatatatacagctactgtgtacccacaaaaattaacatttgtttgaaaaaaaaggagtcaacagataaaaaccatttgaggagacttgaatggcacttggtgatttgatgagaccctctgtcctgtctaactgatctgcactctcttgttcggtgttcacacttaagagaaatgtaaccatctgtggaggccccatcttctcctcctaggtgatctgggctgtgcctactggtgtcccagagatgacagctgtccatcatcctctttggctggtgtctctattttgccttcagaggttctgacactgagcgattgcacgaggagggctgtggggagggctcgcctccagggagtgaagctgaactccctgctacctctgccatggagatgaataattgtgaacggcccgggaaacatttaaacccacctaaaccatagcacacaaccgaaagcagcaagcagggaatgctttaagctgttaaatgctgtgcgaacatgcacaaaatcctattatctactgtatatattgaaaagctaaaaacagcaaactttctgaggttcataaagcattgttcttggttgcaacttggagatttccattattgctttggctgttggaacctttaggtaatctctttcagaggggggtgagctctgacaaggcaaaggagaggatggttgattgcgggaagatcgcagcccatgaatatatctccagcaccatttgctctgaataaggataatcatttctcgcaatctggaaaccatgttatttagaaaattagggtaagtgcaaaacaaagcaagagtggggaaaaaaacaacgttcatcttagaatatcaggatgccgacaaaatgataaatcatgcaccattttttccaataagatttgcatgagtgtgatttctcatggttactattccactccagtattgatggtaaatttttaaatccatcatttaatatggtccctttgcaagaaagaaaagatcaagatatccacgcagacttcttattgctaatgaaaatcaagcacctctttggttcgattttccctcttgtaaaacttgtatttgcaggaagatttttttgtaagtctcttgaaatctgcattctacattttttttttagatgatggctggccatagctccacaccaggggctcttggcttggaatccactcatctccaaggagtctgtgatcatatctgagtctgtaaacttggtcagaaatataaaatacatgttgatgtttccctaatctctaactgatattagtgtttgtttctttaatgaatgtaggctagacatttttatattacattctagttgttgtggctatcttgaaatacttaaatatcctcttgactactctcaaatttatagtagttagtaaaccaaacagtagatcttgttatttaaggtgctaaagaagcacataggttatatcatattttaaaaaaaccaataactatatttcaacatagttagtctttagtaatcctgtgcattttgtttaatttgatgcacttaaatacattattttctgtaattccagctacttgagaggcttacccaggaggatcacttgaccccaggagtttaagaccagcctgggcaacatagcaagaccccatctcaaaaaaaaaaaaactaaactaaaaacattattccgagaagggatccacagttttcaccagatgccaaaagtgtctgcagcacagagctttaagaatctttagctggtttctgacagttagattccctaactgtgataaaatgcagattctgaggcccctcccaaagcctgctatatcagaacctcaaggaatgggatatagacatggatgtttatcagaagctcccccagggagctgggatgcaagcagcccagaccagaggtctgtcattgggaacctgtggcttaggttatctgtatcccaataaccatgatctcaggacataggggttggtagacttggtcatagaaaaacaaagtcttcttacacttcttggggtatatgtggtgggaaagagaacagaggttaagcagacccacgttttgaatgaatttggtcacataacttaataggtgtgtgtcttgggcattgttgaccttcatttcctcatctgtaactcgggaattatagaaggacctacctaatgggctttgtcttagtctgtttgagctgctataacaaaataccgtacactaggtagctgataaacaacagaaattgatttctcacagttctagagattgggaagtccaagatcaaggcagattctgtgtctggtaagggcccactttctggctcctagacagtgccgtcttgcaatgtcctcacgtagtggaaggagtgaggggtggcttgttcctctttcataagggcaccaaccctattcacaagagctccactctgaggacctaatcacctcccaaagacccccatctcctcatcctgtcaccgagagggtcaggatttgaacacatgaattttggggagacatggacattcaatccattccaggcctgttgtaggaatgaaataaaataatgcacaaatgaatatagagcactttgcaaagtgtccaacacacagtaagtgttcaagtcttagctgctgtggatggtgaggatgctgctgctgctgctgatgatgatgatgttcttgatagtaatgagctagtctagttagcatttctgaggctaatgagggaactgtggttatggaatgacagcaagatctggcttccaaagcttggtagagaatttcggctggaggttacaatgcagctgagaggccccattgaagctgatctcagtgtccccagcatcagctgtccccccactatgggacagggctgacatgttactgggaacacgaggctgtctgctgatgctcattcagtgatccagaaagggtaccatcattcctccctctcccaaatcttgcatctcatgaaccaggcatctcattttcccaaagaatccttcccttacagcaggccagaaagctattgtcctagcctatggaaacacctaaaacacactggggagatgtggacactcagcccattgcaggcttgtaaaaatgaaataaaataatgcataaatgaatatagagcactttgcaaagtatctgacacttaaccagtgttttaagtgtttcaatgggcaaggacaatagttttctgagaggggatttttaatggctctccaaaagcaggcccccaaggtaaataacagaatgtgctgcagattcatggacaaccaactccttcacatccttagagatgaaattctttgaagaaagattttcctttaccaaagctcttctagattcttgactgggtgcagtgactcacacctgtaatcccagcactttgggaggtgaggcaggtggatcacttgaggtcaggaattcaggaccaacctgaccaacatggtgaaatcccgtctctactaaaaatacaaaattagctgggtgtggtggtgtgcacctgtaatcccagctactggggaggctgagacacgagaatcacttgaacccagcaggcagaggttgcagtgagctgagattacaccactgcactccagcctgggcaatggagtgagactctgtctcaaaaaaaaaaatgaacctcttctagattctctattccttctatcagccaatgctatccaggttcccttgaggcagtgccctgcctgtcattaaatctacggaaaatgtatgaagaacaggtttttctcttaacccccaggtgttcctcataaaacccaggggtggcaagaaaatacaggagcacatcgcatgttttgggacagtcacacatgatgaacttcgtcgataggatggatggcgcttcaaattttccaggacaaagacctggggtggtctctggagaaaccccaagccaatggttctttaaggtttcaagatcaacgctattcagaactatcaaaacccagccacaggccaggcgaagaggctcacacctgtaatcccagcactttgagaggcaaggcaggtggatcaccagaggtcaggagtttgagaccagcctggccaacatggggaaaccctgtctctactaaaaatacaaaacttaggtgggcgtggtggcgtgtgcctgtaatcccagctactcaggaggttgaggcaggagaatcgcttgaacccaggaggcggaggttgcagtgagctgagattgcaccactacactccaacctgggccacagagcgagactctgtcaaaaaacaaaaacaaaaacccagccacacaccccagcatttttacaaaagggaaaaagggatgcattcaagataatacaatgacattcctatgttttctctgagccagagagcagagaaacattgtggctaaggtggctttctttctgatcaaggtttctgtgaatgggcagtgtccacacatgaattctgcctaaaggctctgtgggagccaggctgcgagctgattgcagcagcagaaggcagcaggtaggagatgacattttagaattgttcaaacagaccccaggcctagaagatatgccagacacggtgttaggagagaaagaacaaagcgacaccagaaacaatcgtttaaaaatttaaaagaccatttccctttatcaactccacagctggctaccattccagtaaatttctaaaacatgaaactggccccagcagggcagagaagtgaatgggatggggcaggccagtgacatttacaatctccaggtgcgatatccagctttcctggaagctgaaaaatgaattgttttctgggagagaaacagaaataaaagtattggttggtcataacctcggggaagcctcttgtttctggatacctaatatttataaaagaatagggttcctgtgtgcattttaaaactctgggctgggagcagtggctcctttctgtaatcccagcactttgagaagccaattcatgaggacagcttgagactggagtttgagaccagcccgggcaacatagtgacataccgattccacagaaaagaaaaatagaggctgggcacggtggctcacacctgtaatcccagcactttggaaggtcaaggtgagcggatcacaaggtcaggagattgagaccagcctggtcaacacggtgaaaccccatctctactaaaaatacaaaaattagcttggtatggtggcatgcgcctggaatccaagctacttgggaggctgaggcaggagaattgctcgggaggccaaggttgcagtgagccaagatctcaccactgcactccagcctggcgacagagcgagactccatctcaaaaaaaaaaaaaaaaaaaaaacaaaagaaaaaaaaaagaagagaaagaaagaaaagaaaaaagaaaagaaaaatcagccaggcatggtggtgcacacctgtagccctagctacttgggaggctgagacaggaggattgcttaagcccaggagttcaaggctgcagtgagctaggattgtgccactgctctccagcctgggtgacagagcagagaccctgtgtctctaaataataataataataaagtaagtaaaattctacacattacaagtcaaaatagcagatgaagagtgctgggggcaagtcactctggctcctggaacaagcaaacctccaaatctcagtggcttagtatggtaaaaatatgttccatggttggcaggtagccttcctggtggtcattcagtgactttagcttctttaacactgtggctcctccatcatcaacaggtggcttccaaggtctccatgcagtgggaaaaaagaggatggagaatgcacactggcttttcaaccatggcagggttgtgctttacttagacccacatttactactgagaacaaatcttacagccacatctgtctgcagaaaaggctggactgggtgtactcaggaggctcctggcctttgcctgtaagaattaggaggcgccaaagctgacaccaactttctccaggtgttatcataagtggattaggtctgtccacagatggtgatatggttcggttctatgttgccactcaaatttcatctcgaattgtaatacccacatgtcatgggagggacctggtgtgaggtgattggatcatggggccagtttcccccatgttgttattgtgatagtgagtgagttctcacaagatctgatggttttataagtgtttgacagttcctcctacacaccctctctctctcctgctgccttgtgaagaagtgcctgcttccctttccgccatgattgtaagtttcctgaggcttccccagccatgcagaactctgagtcacttaaacctctttcctttataaattacccagtcttgggtagtatctttatagcagtgtgaaaatgaactattacagatggttataggcccaagaagagtatcactggctttctgttctggggaacaaaatagaagtttccattcaataaaagggactgagatttgtcatttcttcagtgtataagtacctcctccacttctaggatcctctcctgatcaaagccctaatgtttacatttaaaaacctgaagaggagaaaacctgacttcagttgtgaagtcagctggtggagtaatttaccaattggcaaatatcaagcctgcaggcccaatttcacatagacgggtcatgtcatggttgtgaatgtcattttgtgcctaggcctaagtgaaatgggatctgtatttgtctttccctggctttaaattatctggtatcaccagcagcactgactggcaccatgtcctggaatgtctgatcttttgatgtggcaatatctcctcccctaaggccacctccctccccaggttccatcagtccatgactagacttggcattttgcctccaagttcctaggctctgatacaccatcgtggaacagagaacagcatttctgcccctaaccttactgacgttttaacacccatttcagaaaccccggatttcctgacttccatagcttctaacccagcagctagtcccacacttttaaaaatttaattgattttatttgcagtttatgcaaaaagaaaaggatgggatggagctccaagaagggttctgagaacattctatgttgaagtaagtaagcaaaggataacccagctcagcatggcaggaccagggctgttcctggagcaccagcagccccagccacaggccaccaccttcctctgggactcagcgtgtttctatctcatgagtagaatggagagtggattcactctgtttaaatttaatttatagctattttctcactctctattctctttgccaagcctgagaatggagtgcatgttagtttatcagatgtagttccttgcatgcataagttcacagaggaatcacatgggtcagacccctcatcttggctgtaacaaaagcaagtgagaggctgaaccctcctatgcttggaccatgcttctttatgagttgcctcctgccacagacagtatgtttggtggcttggtcccaaaaggggcatccaagtttcctttttttttttttttttgagatagagtctcgctctgtcacccaggctggagtgcagtggtgctatctcagctcactgcaagttctgcctcccaggttcatgccattctcctgcctcaccctcctgagtagctgggactacaggtgcccgccaccacacccagctaattttttgtatttttagtagagatggggtttcaccgtgttagccaggatggtcttgatctcctgacctcatgatccacccacctcagcctccgaaagtgctgggattacaggcttgagccaccgcccctggcccaattttgctatttttatttattttattttattttttgagacagagtctcgctctgttacccaggctggagtgcagtggtgcgatcttggctgactgcaacctccacctcccaggttcaagtgattctcctgcctcagcctcctaagtactgggattacaggtgcccaccactgtgcccagctatttttttttttgtatttttagtagagatgggatttcaccatgttggccaggctggtctcaaactcctgacttcaagtgatctgcctgcctcggcctcccaaatcactgggacctgaggcataagccaccatgcccagcccaaatctgctatttttaaacaacgacagggatggggagacaagttggaggcctgagagcctgcccagttcctcctgctcctacaggaactggagaggagtgtgagtgacagcttctcctgtcctctgttgataccctccattttcaagccccagtgaccctaactactggcactgagcaggcaggctttcaggcagaggcccctccaggccctggaagcccatggctctgttttctgcaagcctcttacctctaccattgcttctgtgtgctggagtccatgctctgtccactgttcctagggatgtctgtggccatgaacacatccccatggacctctgagcagtgcccagtaatcatacacattctccaagcctctgtgaacccactgacaccacctgacagcagttccactcaaggaaatccttcagcttgctctgcttccagccacttaggccaggctgcagtccaggtgtctggggggccgtctagtgagacaacaagagagtcctcacagccaggcagggcaggaagcggcctggcccaccaacagcccacacccattgcgggctgtgcaacagggaaaaacagaatgtggacagagggacacacagtgagcctgtaacccctatgccaacatcagcagctaccacttcctcacttcctctgggtcctcacagtcattatctccaacctgcccctcccatgggcccacacagaggtggtggcaccgctaccactcaggaaacagttcacttcacagctacacagctattctcttggctagtaaataataactactttggtttttctcagcatttactatcatgttaatgagtgttccatacattatctcatattaccttcacaacaaccctcagatcagctgctgtcatgagctacttttttttttttttttaagagacaaagtctcactctgttgcccaggctggagtacagtggctcaatcacagctcaccgcagcctggaactcctgggatcaaacaattctcccgcgtcagcctcctgagtagctgggactacttgtgcatgccaccatgcccagataacgtttttaaaaagatttttgtagagacggggtcttgttatgttgcccaggctggtcttaaacccctgacctcaagtgatcctcccttggcctcccaaagtactgggatgacaggcatgagccactatgcttggtccactccttttttaagttgaaaataatttttatttatttatttttcagagagatgggatcttgctatgttgcccaggccggtcttgaactctcggtctcaagtgatcctcctgcctcagcctcccaaaacactgggattacaggcataagccaccaagcctggccctcagctgcgttttatggctaaggaaactgaagatcaggcataaaagtagctaggcaaccgtgagacctagcctcaattgtgggcaactcagtagtaattggcaatgactttgatttcaactcaaccaagagccaggatttgaacccagtgctgtgactccaggactatctttctgtaatgtcatgccatacaatgaaataacaaaagggtttgtggaaagcatgaagccttatgggccccacattggtgcccagttctaggtgatgtcttttagggtcctcttcatcctcttcctcccatctgcagggatggttctgcccccattacccagctgtcaccactggatctctctccatttgccagcccacctgccctgaccttgagtcctaatctcaggcccttgggcttggtggcttgctgcaaggtgcttctcaagctctgccgacagttgagagctctgtcctggcccagatctcatgtttgtgcaccagatccaagttttgtgaccttgagtgagggattctcacatctcatgggccattttttaggaccaccagtttcaattttccattgtgccataacacaccaatacaccaaaacagcaggagttgcagcagagaaagatcattggtcagccaaatgaggagatgggaggaaacctaaaatctgcctcctcaaaaggtttgggatggagttttcagggggtttttaagaggatgggtgattggctaaagtgtggggattcctgactggttgagaagcaagaggatgaagtcctgggacaggaagatgaagaaactgtatgcctgtcctgagtcagttccttggtgggggtcttcagattggttagccattctgctggaattcaggattaaacacacacacacacacacacacacacacacacatacacaccttaagcaattattgggttaaaaggtccagtgttagagattttatctataggaacaatgagggagcaggtagtcagtgtgctacgtgacccttgaatagttagcaactgcagggaagtggattaaagtgcacctgtgtaccctgatcaatgtctaaccataattctgcctaaagcctggcttgtaattctcgttaaccctatgagggcaatttcagcctccttctggcatctcctgagtaatagagaagagttcaggaagttgccagtcaagcttctttccaaggggtatctcaggcatgcctggctggctgcatcataaagaacaggaagtccatattagatggtggccaatgtgcagatgtgcagtttagtgtggcagagccatgctggctgagcagtgctgacttctcccaagtcctagccccaaactctagacaacccagtaccactgtcctttctgcagacttatgggaccagtaattgggaatgccttttattttgcctttaccaagttgagttcagttagggaatctgagtgccagagagagtgatcacaagctttgctgggcttttgggccatatgacatcaatcatgctatttatttattttgagatggagtctcactcactctgtcgccgaggctggagcacagtggcatgatctctcttcactgcaacctccaccttctgggttcaagtgattctcctgcttcagccttctgagtagctgggactacaggcatgcaacaccacacccagttaatttttgtattttagtagagacaaggttttgtcatgttgcttaggctggtctcaaactcctagcctcccaaagtgctgggattacaggtgtgagcccaattatgggattacaggtgcctggcccaattatgctctttaaaggatgtggacagacccgtcctcttcagatcactgtatgcagtctgaaagctctggccctttggtgttgaagacacagaattaaatataattcactattcttttatagttaaacatagcttatctataattgtgccctaccaactcctttaatcccaggcaaaatgcaaagaaatgacagtagaaggatggaggacatgcatggataagggagtgaatacagtgttttcaccctccctgctctgccagcttctacaccaaaggttctaaagtcattttcaatactttcctggcattctatttttaagctctgaggaaagaataaaggctatgagcctggcagtgacatccatgtctaaattatctttatacccctggcagcgtttagcttggagctcttagtaaacatgtagatagcactggattgaataactaaggaaggtaaattgttagaagttaaaggcatcaggctgggtgctgggaataccaagaataataaaatgcttaatacttacttagttgaagctgttgtagagagaggactaatggaccagtgtttgaactgtcagagtcgggaggacagaaatagagtgagagctagtagatgtgaagtagtgggtggtagggaagagggaatgcaggagaggagaggaagggatgggagcacaaaaaaaaaaaaaaaaaaaaaggaagggaggtggggagaataggacaaagccaatctagacatgcctgatccaggctactttttaggctttttttttttttgagatggagtcttcctctgtcgccaggctagagtacagtggtgcgatctcggctcactgcaacctctgcctcccaggtttaagcaattctcctgcctcagactcctgggtagctgggactacaggtgtgtgccaccacacccagctaattttttgtatttttagtagacacggggtttcaccatgttggccaggatggtctccatctcttgacctcatgatccacctgcctcggcctcccgaaagtgctgggattataggcgtgagccactgcacccagccttttagccaattttctaacatcaaagccctggtcctctatgacagtcacaagctatctatcaggctgggtcataagactgggatggattttgttttctttttattaattattatttttatttctttagagacaggttgttactctgttgcccaggctggagcgcagtagcaccatcatagctcactgcagcttcagtccccggggttcaagtgatcctcctacctcaaccacctgagttgctgtgactgcaagcatgcgcatccatgcccagctaatttttaaatgttttcttatagatggttgtccaggctggtcttgaactcctggcctcaagcaatcccccccagctcggcctcccaaagcattgggattacaggcattagccaccgtgcccagcctgggttgaattttaaaatggtgaaaataaacccatattattcttttcagtacatagtaacagcaacaaaaatcaaaagaaaagaaaaaagtcctcccagccctacttctgggctctatagatcaagctgctttcaatctgcatttcttgacttctctgaactgctcatcacaaaacacttcatcttaattcctcttgccagtcaatgacttgcattgactggcaagaggatccacgtatttagaagttcttaccaccgcggtacttaaattgagatatgtcttgaggtccatatttgtcaatcccatttctgagaagcagtcataaataaagcagaagattgaaattgaattttttaaaaggactttaggaggaaagccattatgcaaccgtcccgtttagtgaaagagaatgttgatttaaactgggaaaagtcagctcaccatctctagcatggcagagagaaacgctgaggaaaattctccctattttcaggagtagtagcttgctcctctgggaaggaggttaccagaaaggcccgcaaatgattggtaggatgcgagtaacaaattaaaatattctctttgccagaaacctgtgttgttgagaatcagacaaagggctaaaatttgcctgcgcttggattaccagatggtgttatttacgtaatttatgcgttaaatttcctccagtgttgcttttaacaatgtaaatggatttaaatggcttcctaagtgaattccttttggtaaaaagaagaattcctgtcagtaggaaggaagacatcagagacacatgctccagaggtggtggaacatcactctctatgttacagaacccgccatagctcgcccatctggctctgcaaacccaaacactgacattgcaattgcagcgagagaaagtgaggcagttattgcagggcgcccagcaaggagaatcgggcagctcatgcttaagacctgaactccctgatggctggtagggaagggtttttgtttgtttgtttgtgtttgtttttgtttttgttttttttgacagagtcttgctctgttgccaggctggagtgcagtggcacaatctcggctcactgcaacctctgcttcccgggttcaaacaattctcctgcctcagcctcccaagtagctgggactacaggcacctgccaccacacccagctaatttttgtatttttagtagagacggggttttaccatgttggccaggttggtctcaatctcttgacctcgtgatccacctgcctcagcctcccaaagtgctgggattacaggcatgagtcaacgcacccggccctaggtaagggtttttaaaggcagagaggcagaggttacaggcaaagtcagaaattgacacatggaagctgtacattgtttcgacctataaaagtaggactttttttttttttaagactttctctcttgttgcccaggctgcagtgcaatggtgtaatctcagcttattgcagcctctgcctcccaggttcaagcaattctcctgcctcactttcctgagtagctgggactataggcatgtgccaccacacctggctaattttttgtatttttagtagagacagggtttcgccatgttggccaggctggtctcgaactcctgacctcaggtgatccacctgccttggcctcccaaagtgctgggattacagacatgagccaccacgcccagccaaaaagtaggacatcttgaagcagggcccaaaggtctaaggtggagtcaaagattttctgatttgcgattgctccaggatgcaaagctctgtgtaaaaatctgaggtcagcagaaaagaacattagtgctccctcatggacatgacctcctccagaccccttgggaagaaatttagaaacaagcactgtggtcagagttcagtccacagttcccccttatctgagagtctacctgccagcaaatcccttgagtggggtctgagtttctgaaaaacagctcaagaacatatgctaagatgttatcttattttttttattttttatttttgaaatggaatctggctcttcacccaggctggagtgcaatggcacaatctaggctcattgcagcctccacctcctgagttcaagctattctcctgcctcagccttctgattagctgggattacaagcacctgccaccacgcccagctaattttttgtatttttagtagagacggggtttcaccgtgttagccaggatggtctccatctcctgacgtgatccgcccgcctccagccttgtgatcggcaaccgaaagtgctggaattacaggcatgagccactgcgcccggccggctggagggttttatgggagagggatatggggaaactgtgtagaggttggactcaagaagcaactgaggacggcagataatctgggcaccagcaagagtcctaagtgattgggaacttcttcgtccttggttagatcccaatgttcctgtaaacctttaacaaaacatagtggtgtacctacttcccctgtaatcccagagttagtttcaaaactatgtgattgctgctttgcattgtatatcagtgctctcaaattatcctaacttgcatgcaacaatgagtaaattccccttaaacaaaaatggactagttatgttaatttcttgttgtttcactgttacgttaagagacagtggtgaaatctttaacttcaggtatctatgtgcctatgctttcaggaagaaagcttctgaaaatagatcacaggctttcaccgggagggttttattttatattttattttattgcattattttattttgagatggagtcttgcttgtcgcccagactagaaagcagtggcacgatctcggctcactgcaacctccacctcctgggttcgagcgattcgtctgcctcagcctcccgagtagctgggattacaggcacctgccgccacgcccagctagttttttgtatttttagtagagaaggggtttcactatgttggccaggctggtctcaaacttctgacctcaggtgatccgcccacctcagcccccgaaagtgctgctagaattacaggcgtgagacaccatgctcagcctacaaaatattcaaaaattaggcgtagtagtgttcagctgtggtcccagctactcgggaggctggggcaggaggagtgcttgagcccaggagtttgaggttaccatgagctacagtcatgccactgcactcgagcctgggagacagagtgagatcttgtctctcaaaaaaagaatcaaagaaaaagattcaaaaaactttctgctacctggaagggaattttggacagattaaaagaagtattgatatacccagcagtagttcagatctgatcgggtagtgtgtcttccatgatctagaaaacattcctgaattcattacttggggaattcctggcagtctccagatgattcctcaagaaagtcaacaccggggtaggcagcctctgcggtctgctgttttctgttagcagaggccatagttctgcagactgggccatggtatcttgagatgccagagctgaaagaaacctcagagatagccccctgtcatttacagatgagaaaatagtttccgggggaagaatgcatgtgcctgacttctgggagaaatggagccagtggcctttcccactagagagtaaaatgattgatctttcttgggtctatctcagctcttgctagagaacatctccccactgattccaggctaggctgggctggctgatgttgacatactgtagggtagatttgcaccagaaggggtgccagggaacagcattcttagaagcatcagggtggttctgggtttgtgggaagagcgtttgggaagagactcaaatctagctcgtgttgagttctataagggcccttggttgactgactttaactttctctgcctggcatattatatcttctagtctatttccttttcctttctttaatttgttcctcttttcccacctcctaggccccctctccagacaatttcgctgcttactccctccagcccctctccattcattaatgtatgtacacattcactcattgattaagaactcagaactctttgggtacttacttatgttccaggcacagtgctgggcagtagggacacaggatgacacagtctgtcctcattgaggtaacagcctagtaaagaagggagaaagtaattttttttgcacgcccacatgctggcaggatcatgcaattacaaccgtgataagggctatgctagcatgttatagggaactctgtttttatctggggcttccttgagtaagcactgatggagctgaaagccaaagtttgattaggagttaactaggcagatgggggaggagtgtcccgggcaggaatggggcacaggggaggacaaaaggaaacatcatgggattgaggggagctgcagagatgaggctgcagggggaggctttgaagaccacacgaagattgaggatttattttcagagtggtcggtgggagccatcgaagtttgcagggccgtggaatgatcagttccaccctggctgctgagcggaggtcagactgaatggagttggattcggaagtggtggctgtggtccaggtgggagatggtcgtagcttgcaccaaggtgatgagggaggagaaaatgatctggtggtcatagtggatgtgaaaggaagtggatgcagttgagctgtagtgaagaggcatcatctgcaggacttggtgatggattggctggcgcctagggaggaagtggtgaggatggtgcctggctttctttctggtatatgtagcttccttgctcaatttgagtgacggaggtcgtggggagagagaacacactgtctttctgctccgggccacctgctataatagcatgcaagctctttcaagagagagctgccccctgttagtgccttgaagatccctggaaaagtggctttcacataatcagggcacccagggttctcaatttaatggcacaattgaaaactctcaccagaatattttggatccaaacctacttatgcccgaatgatccttcctgctgcttttgagaaactcctggcctctaaaagtcacaggacaagaccagaccttgaatattagaattctatgacaaggtgagaacagctgcctcactgttagggcagtagattccaaagtggggtacacaagatgatgtggaccattagagggacaagaggaatatattagcactcatattctaatgtcatttttggatttctatatatctaaatttttcatgtgtaaaatatattagcatagtagtatgtgcatgtactgaaaaataaataaagtaaatatattggagaaggtatgctttacatttttaaacatcaaaaatgtttggagcccatagcctgtgagcatagtgaatataaatgaaccagtcatgttggctttgatggcttggcctcctctttcctccctggctgcctaggctcctcagtgacaggtgcccaggggagcaggtggcctgggcagtacctggcaccctgcatcctcatttgttgcctgtggctcttccggggtccctgaagctactatccagctgtccaggctgtggcagagcacagcccttgcttaaattctttcagcttctgtaaaattgagtcatcagatcacaaccctggaaatgatattagaagccttctaagctggtggctctcaaatgtggctacacatctcaatcccatggggggcctttttacatacacccaggtgcctcaacttcatccctggggaatgtgatttatagggctggggtgggatccaggtgtttgcaattttatttcattttatggatggatggatggatggatggatggatggatggatggatggatggatggatgggtggatggatggatggattgacagggtcttgctctgtcatccaggctggagtgcggtggcatcatcatagctcaccgcagccttgaattcatgggctcaagtgatcctcctgtctcagcctcctgagtagatgagaccaccgccatgtgccaccacacctggctaattatttaattttcttttgtagaggctggtctcgccatgttgcccaggctggtcttgaactcctggcctcaaggaatcctgctgcctcagcctcccaaattgctgggattccagtcatatgccactgcgctgggcctagtgaaagtgtttagtaaatgatgaagttgaatgtatgaatgaaacatgtatcaaaagatgtaactaaaccaacgtgccactgaagactctccaaaatgatgaaaatcaatccccattgacattcatctcccatagtgtgtcttcttccaggacatcagctgtcaggaagcagaacaatgtgtcctgcctaagacttcccagaccccagagtcttgtgatggtttcttttgcctcatcccttccatattccagaggcctgggtagtttagggcaggctttttgccccaatgaatgaagcttcagtatatccagtggctaggggtcattcataaccctccttctccttccaagccatatccaatctattgttgatgattttgcctattaaaaatccctcggccaggtgcggtggctcacacctgtaatcccagcactttgggaggctgaggcaggtggatcacttaaggtcaggagttcaagaccggtctggccaacatggcaaaaccccatctctactaaaaatacaacaattagccgtccacggtggcacacgcctgtcatcccaactacttgggaggctgaggcaggaaaatagtttgaatctgggaggcggaggttgcggtgagccaagatcatgccactgccctccagcctgggtgacagagcaagactctgtctcaaaaaaaaaaaaatccctcaaatctatctacatctctattttgttgctgtcactaaagctatcagctcttcttccctgcaaaatagcaaagcattcttgttttctccatctcccctcttcatgctgccagtcttttccccacagttcagccagagtgatcttttcaaacccaaattcttcagtggcttctcatttacaacaaagatcaatttctttttaacatgacctccaggtaattgcctggtgtggaccctgcctacctctccaatattttccactattctcctctcttccagccctactttctgaatccattttctacgttccagccacatggctattctttcagctctttgaatatcctctatgtatcacttatgtattgcagtgtaagcccaaatttagtggcctaaataacaattgattggattaagattctgaagtttggaagtctgggctgcggtcagccaggtggttcttctgctccacatggccctggctatgcttatgcacacactggcattccactgatgggttgtcttgggggtgtacagtctcacatggcctcactcccatgccttagtcttcagccatgatatctggaatagctgggcctctattgctccattgtcttttatcctcagcttccttacagcctgacgggctcagaattccaagaggaagaaagtgcaagccgcaaagtctctaaggcctagtcctgggttgtgtgagacatcacttctgcattctgttaatcagtgcaagtcataaaatcagcccagattcaaggagaggggaaataggttcagcctttttataggaagagcaaataagtcacattgccaaggagcatgggtggaattgttgctgccatctttgaatacagtccagcacaccctgctctctccttcacaaggtcattgcaactgtgctggctgcccctgggcttgggactgttgcccacttcctctactcagctcagcctagcccttcagacttcaccttagtatcctttcctgggggatgctttctctgagcccactggccacatcctcgtgttacacgctagatttttagccctgtgttgttttccctcatggaaaagctccctttgtgatggtgcatttctgcctgtgattctttgattaatgcatttcccttgctagattatccacttcatgacagcaaggaccttgtctactagcacctctcatttcatccccctgcccagcccagtaggccctgaatggatcattttttgatgaataaataaatggatgagcgtctgtttctggagtcaccacacctcctggaggcccatatccatttaagcagggccacttccccacttccctagcaaagggtcaccaagaaccctgcggtgggttctttgcctccaggactggtcccagagcttggagcgtgccctcctcctggcccattccaacccatctggaagtcctcctccctccactgtgtgaggagccacagcctggggcgctttccatttgggcacttccctctgctcttggcatcagcgacatgccagtcagagtcttgttcctacctttctgtgcatttctcttcatttcttcagcctgcctaggaactcaccatgtgggctggtaaacactgatgtagagaatagatccgcaggaccctttcttgggaccagctgtacttgggatactcatagctgggtcttatgtgtggtagaaacataaactggatcgttccctttagagggtaccccttttgcttccagacctcttgggtggactcagaggccaaggtggaatatcactccttccgggaatacccctccataggggacttagctggactgttggtttattgctaaggctcaaaagccttcagtccactttcttgcatttctttccatctgctatgtaggcctggttgcttaaccactggcagacttcacatcagctcatcatcacttagagccagcccatgagctgtgctggtgatcacccccagccaacacagagcagagcctgaggcctgaagaatcacttgtctcccaggcatcttccagcctcccttgcacagccatgccgccacttggatccgtgcagcagcaggctttgacctctgaccctaggatgtcattggtgccactgcagatccatggagcttcctctgcatatatctatatgcccagctctgtcctcactgtttcccctgctcactgtggttacaatgcaggtcagaggcaccaaccaggcacccagagtgagggacagggctgtgactgaagagaagtcaaggggtctacagctgtaggtcagctctcccagggcaggaagggccagtgtctgctgctgtcgcatgtggtcgggggtgtggttctgactcctccccttactgactgtggggttatgaaccactttctccacctctttgaccctcagtttcctcatctgtgataagctgatgagggagttggttttggtgctttctgtcattactggactggtcctggagtttggagcaggcagagcaggtatacttgcctctctaaggggaggggcctgtgaaagtggagagtagaggagagatgagcaagaggagccctcgtcttctgtctcacacaagaggtgccgctaatgacagttcatgtttaggatttaaaatccagtctgagtcactggaggtgatgagctaaagtgcagacttaggctgaggcaggcaggataatgaccacagtgcatgcccagtgatggcaatgttgtgggcatccaggccagcagcaggattccagggcaggcactgaccctggcagttcaccctgggcttgctggaccccacagcagggcataccttcaagacatctgctattccaggagcctctgagtcctccccagactctacagggagagctgagggactttgggtcaatgcacacttagtgtgctggctgatatccacaccacagagcccaggacaggaagcccatgtctctgccacacaggacagatgtgctgagcttcctgccacctgtctgttacaccatctccctccccttgtttaaaaggcttggtgtccagcacagggctaacacagccaacatatggctcctccatcctctcacctccactcctaacagctacatccacttgaaccctcttgggagtttggctgcaccccaggcatgaaagccatcctgaccttggtctggatggcttgtggaggacatagtgccaagtcagactggcttgtgggttctgttcccacttggcacctgtgttcttatgactgggtttcaggcttttgctaaggtctcttatgcgcctgtgtctgtcatccctgctaagtccttgaagagttctgctttgcttccatccatcctcctgagcctccccaaactgagattcacgcccgaatctactttcccccatctctctgtttatctatctatctatctgtctgtctgtctgtctgtctatctatcatctatctatttttataatggctttgtagatatattcacataccattataattcgtccatttaaaatgtgccactcaatggttttttcagtatgtttgagctgtgcaaagttcaccacaatcaatattagaatgttttcatcaccctaaaaagaaccaccaaacccattagcagtcactctaccttcctccagccccctgcccaccacctcccaagcaaccatcaatttatttaccagacatttcatataaatggaatcatagaatatgtagtcctttgtgatttgcttattttgcttagcatgctttccaggttcatccatgttgtagcatgtatcaacatttcatttttttcccaaataatatcccatcatatggatatgttacattttatttatgcattaatcaattgttgggacatttgcttaatccaaggtcatgaatttttactcttatgttttcttctaagagttttatagttttagctcttatgtttaggtcgttgatccattttgagttaattttttatatggtgtgaggtaggagccatgtccattcttttacatgttgttccagcacaatttgttgaagatattattccttagcccactgaattgtcttgacacccttgttgaaagttagttgaccataagtgtgagagtttatttctggactttcagttctattccattgatccgtatgtctgtccttatgccagtaccacaccatcttgactatagtagctttgtattaaattttgaaattggggagtgaagtcctcccagtttgctcaaggttgttttagctacttgaggtcccttgtttttccttacgaactttaggatctgcttgttaatttctgcaaggaattcagctgggatttttatagggattgtgttgaatttttagatcaattttgggtgtattaccatcttgacaatgttaattcttccaatccttgaacatggtatatcttttcattcattcactgagtcttgcaacatcattgtgagaccctgattctttatatattgtccgtaccttgaaattcagccgccttgttttactctctaagacaccagtttcctgtctctattcccaggccctttgccaacatttggcctccttgacttccttccatggccagcagctgggtctaacctaacatgcgagggcatctagctgtcctgtcccagatcaaagaagtctggaacatctattctctactaaccacttagcccacaattcctcctggaagaagcaagcaaagtgaggattcttgcttatgggagaattttctatctgtatcgtttccctgtggtataaccgaagttgggaaatagaaacagaacatcatacacgcaaaacaaattttgccaccaaattcagccaacaaaagtcaagaagggggtatgtagacactcaagagtgtcccagtattcttgctttggtggttactgggagactaaaggtggaatggcttgaagtaacccatcttggaatgagcctacctgagtcagctcacctgcaaaaactgtcacttatgcagagcatacagtgtcttcacagcagaacagcctcacaggctcctgaaacttttctgtcattttcctttttttccactggtactaggaacctcatttccataaattaatttttttttttacaataaggttttttttttttttcccacctggaccaagagaagttggatagtccagctttccttttggagcaggtccttacggcctaggtgcctgccatccccatgcagagggatgagaagtcccacatccttgggcttttgcatccctcaaaggcagccatcattgcaactttctttctgaatagttcagtaatagcaagcgacagctgctcataatggcattggagtggatgcttccagaaggcttggcatctgtacctgtaggactccaaagtagagcatattaacagtgtagaactaggctgggagtagtggcacatgcttgtaataccaacactttgggaggccaaggtggaagaatcgcttgagaccaggagtgtgagaccggcctgggcaacatagcgagacctcatctctacaaaaaaatttaaaaattaactgggcatggaggcacgtacctgtagtcccagctacttggaaggctgaggcaggaggatcacttgaagccaggagttcaaagttatagtgagctgtgatcgcaccactgcactccagtctgggtgatagagagagaccctgtctcaaaacaaaataaaacaaaacttaacccagaactagatcattatatacatcttgtgctgatatgaataaagatctgtttcttagtatgaattttccattctacattggcagggcgcagcttcagccagatgggaaaggcagccttcagggatgtcagttgtgcattattgagaacataagaaaactcatgtgttgccatgggcagcttaggtttatgggcctttcttacctagaggtggattttatatcctgagctgttgtttctataagaattctcccaagcctcttttttatatgttttagtcaggttaggttagaccatgctgcagtaacaaaccaaccttgaactctcattggcattatttatttatttatttatttgtttagaaacaaagttttgccctgtcacccaggctggcgtgaagtggcactatctcagctcactgcaacctccacctcccgggttcaactgattcttgtgcctcagcctcctgagtagctggattataggcgtgcgccatcatgcctggctaacttttctatctttagtagagacgaggtttcaccatgttagccaggctggtctccaactcctgacctcaagtgatctgcccacctcagcctcccaaagtgctgggattataggcatgaaccaccgtgcacaacctctcattggctttatatattaaaatgtattttacgtttatgcaaagtcagctgaaccattgcttttgggcttggggagggggcatagcctctgggaatttctttttcaggctgatgaaatctttgtacccctaggtatggctctgtgggggcagcatggaggtccttccttgctcacgggtggcccacattgagcggaagaagaagccatataatagcaacattggcttctacaccaagaggaatgctcttcgcgttgctgaggtctggatggacgattacaagtctcatgtgtacatagcgtggaacctgccgctggaggtagggatcaccagcctttccccaccaccccagtacagtgatccttactgtttgatcactatttatttaataaaccaatcgttcctccccagaaaatgctcatgcttagaaaaattatgaatgcatttcaaagggattcacagatgtctcagctttagaactcctgcctaactccagggctagcacaatggaagtctctttaaatccacttacagagattagaagggtcttagtgtgttaatcccagtcttattatgttaatctggctgccctgctcctgatgatatgctgtgtccaggaagttcttgcccagatacttcacagcagactcttcatcctgccagtgtgtgacttcccatggagctccagctgccccgtatcatatgcctttactctatgccaaatcccctagctcttcagctctcctccacattctgctcagaagatggcccaaggaaatttccatgttactgcagccccacaggagtgtcatgcggtagttgtatattagcgtggtttgaatcccaactctatcatttatgagtcaggagatcttgaccaaatccactcatcttctctgtaccattcatcccttggtatccacaggggatttgttccaggattccctgtggatagcaaaactcacagatgctcaagcccctgatgcaaaatggcatagtgtttgcacataacctaagtataacctcctgtgtgtgtatatatatgtataaaatatatatttatataatatataaaatatataatataaagatttatataaatttttttatggcagcacaaaatttttttaattttatttttctattagttattggggtacaggtggtatttggttacatgagtaagttctttagtggtgatttgtaagatcctggtgcaaccgtcacccgatcagtatacactgcaccatatttgttgtctgttatccctcgcccccctcccactcttcccctgaagtccccaaagtccattgtatcgttcttatacctttgcatcctcatagcttagctcccacatatcaatgaaaacatatgatgtttggttttccattagaataatactctcgaatctcatccaggtcgttgcaaatactgttaatttatttctttttatggctgaatcatctctagattacttatagataatacaatgtaaatgctgtgtaaataattcttatgctttatttgtattttttattgttgtattgttcttactgggcttttaaaaaatattttcagtctgcagttggttgaaccgatggatgcagaaaccatggatataaagggttggctgtaccttattttcctcagctgtaaaatgaggataatagcagattctccttcttggggtgattgtaagaactaaatgaatttatacatgtggcatgctgagagtagcacctggcacagagtgcattgttcgtcctatgctgcacagcagggtaacctgcaccctcagccacagctcagtttatctcctcagccagagcacccataggtgtctgagccatgctggaaagtcacctggagtggtgcccattgagagatggcagcccctatgtatcaggaggctagagcccagaacagaagaaatacagttgaatatgtgccagatatgtgggtcaagaagataaaagtgaatttattcaatgttgttataagttttgaaatacattctcaagaattaaaaaaccccttctggacacttagcactttttagctgttaagtaataagtgcttttagccattattactattatgtaaagataggtaacattcgttgagcacttactatgtcccaggtacctagtaagtcgttatttgtaatatcttatttaattctcataacaacctcatgacataagaactgtctgcctcagtttcctcatctataaacatggattattaaaatttatctgataggactcccgtgaagataaaataaggctgagaacagagcttagcaaatattaagagttccataaatgctagcttgatatgaatgtattatgatgttcattttacagatgaagaaattgaagctatgagaagctaaaaggggctcgttcaaggtcccacacaaagcacatgggcagggaagtcagttcaggtcctcatacaaaacctcaccccagccctgtgaaatagtgaaataggtattattattattcctgttttataaaggggaattttttttttttgagataggatctcactctgtcacccagactggagtgtagtggtacgatcttggttccctgtaacctccgtctcccaggttcaagccatcctcccacctcagcctcctgagtagctgggaccacaggcttgcgccctctacctgtctaacttccgtattttttgtagagacaaggttttgccacgttgcccaggctggtcttgaactctttggctcaagcaatcctcccacctcagcttcccaaagtgctgggattacaggtgtgagccactgcgcctggcctcaagttttgacctggaatggtggtgtgacttagagttacaaataactcaagtcttttgactgtagccaagtgctttgtccatgactgcagacaatctctggtcccaaatgccagtggtaacctaccaggcttttaaaaaatgaccattagctcacgcctgtaatcccagcactttgggaggccgaggcgggcagatcacctgaggttgggagttcgagaccagcctgaccaacatggagaaaccctgtctccactaaaaatgcaaaattagctgggtgaggtggcgcatgcctttaattccagctactcgggaggctgaagcaggagaatcgcttgaacctgggaggcagaggttgcggtgagccaagatcgcaccattgcactccagcctgggcaacaagggccagacaccatctcaaaaaaaaaaaaaaaaaaagaccatttcatggatcatactaaatatattaaaacaaagagttaaaagttactgctcagggttgtctttgaggttgaataagtttgacatttaaagggatttccctttaaagtcattgtttgactgcccaagtgatcttaatgacataatttgaagtcttctcccaggccccccagtgcatcctgtctctgctaattcctggccatcttgcagctgagtctgcagagtcatatttcagatactttattttccctgtcagcacacagcagccattatgggttcatttctgtaaaagcagagtgaattattcattagaacatcattacaagctttgcaatggaaaattattttcacttctgcatgtaatgaacttcgcaaagagccaacaaaaggagaaattttgcaggtataggaaagaaaagacaggaggtggttgtaggcatttattttcttgtcgtaatcaaataattcctctaataattgtctctgatagttactaaggaaatgcgtaagagcagaaactgagaatgtaggtcgtcaacatcagcgtgtcccagaaatccatttgcacagcaatgataaggatggttgacctgtctgggacctttattgctgtaggttcctgattttgcttaggaaggaggattccctggcctgggtctggatgaatcaaataggtctccttaaaccacccttctggccgggtgcagtggctcacacctgtaatcccagctctctgggaggccgaggctggctgatcacttgaggtcaggagtttgagaccaacctgaccaacatgatgaaaccccatctctaaatataaaaattatccaggcatggtgatgcaagcctggaatcccagctactggggaggctgaggcaggagaatcgcttgaacccgggaggccaaggttgcagtgagatgagatcgtgccactgcattccagcctgggtgatagaccaagactgtgactcaaaaaacaaaaacaaacacccttctgaataagcatacgaggcttaagatctttttttttttttttttttgagacaaagtctcgcactgtcacctgggctagagtgtagtggcatgatctcggctcactgcaacctccacctcctgggtttaagtgattctcgtgcctcagcctcctgagtagctgagattacaggtgcccaccaccatgcccagctaattttttgtatttttagtagagacggggtttcgccgtgttggccaggctggtctcaaactcctgacctcgtgattcactcacctctgcctcctaaagtgctgggattacaggcatgagccaccgtgcccagcccaggcttaagatcttctatgtgaaggtttccctgaaagtgactccacctgtgccccactctggccagagctccacagtcactaacaccccttggcttctctctcctttcagaatccgggaattgacatcggtgatgtctccgaaagaagagcattaaggaaaagtttaaagtgtaagaatttccagtggtacctggaccatgtttacccagaaatgagaagatacaataataccgttgcttacggggaggtaattcagaccgtgcatgcttttggcttggaatgctgttcaatatgctgtgggttgcttcgctggggagaaatagagttgctcattcattcattcaatgagtggtttttggaggtgctggccctgatagcaagattctctctagctggggggttggggtagggaacaaatgtgatgaatgttacaatggactatggataaaagactatgatagtctactttgcctgagatatgtagcagataatgaatcctgtttgggaaattttgactttgaggtcctctgggacctgtaaatggagatattgagcaggaagtttggatgtaacgagaggcaggagggttggagtcctccattgctctgtgctgtgggctggaatcacttatcaaagaaaggaggaaacgttctcagattgtctatggtgtgatcatatcacctttctaaacctgaaagcaaagcgatttttctcttattacaaataccatcaatatgcatttgagaacattttggaaataataatactagggatgaatatttgagtgcttttgaagtactgggcactattctaagtgctttttgcatacaaattaatttcaccttcaccttatgagagattagcgttatttctgttttcttgataagaaaactgcaacttagagaaattatctaacttacctaaggtcacagagcgtgtaagtcacaaagccaaggttggacttggggatctggataccagagataacgtgtacactttgatgtgtgggcctccggactgtgtgtgtgtgtgtgtgtgtgcgtgtgtgtgtgtgcatgtgtgtgtatatgtgtgcatgtgtatatacccatgtattttttttactaaaaccattccattcacaatgcctaataatttgaaattttactcaataatatggaggatatataagtgtatcatgaaatattttttgtcagtaattaatggccgcacatggttccactttttgtgtaagctgggctttgcttgagaacatagacactggtgtcttttccaattttaaaatatcacaagtaccattgctgagaacatcttcatatagaaacactcatgcatccacctcattctcccttgtgatgcctgtttgagatggaatcggtgacacacagtcaggccaaggagcagagagccaggtgctctcaatttggctgagacaccccattagctctgcaatcgggttttctttcctgggactccctgtgactaccaggttaaagctaagaagaatccctttgacttaggagtatttacatttttctacaactgtggattttcctattctttgcctgctgccttttatagaaaataaatcaaccacaggttaagtcatcagggtgtagagtggtgaccctcctgagctggaatttggaatgggatgctcacatcttgcaagggcagtctctagggcggttagggatacatgaagactagagccagcctgctgggttcaaatcctagtaggctgttaccagctgtgtgggtctgcttggcagccattccctcatctataaaatgggaggaaggagagtatctcctctacaggattcctgggaggataaaatgagctgtgatgtgtgaagttcttagaacggtacctggcatggccaagcaccgtggctcacgcctgtaatcccagcactttgggaggccaaggcgggtgatcacttgaagtcaggagttcaagaccagcctggccaacatggggaagtcctgtctatatagatatatatattaaaaaactagctgagcgtggtggctggtgcaggtaatcccagctactcggggctgaggcaggagaattgcttgaacccgataggcagaagttgcagtgagctgagatcgcgccactgcactccagcctgggtgatagagtgagactctgtctcaaaaaaaaaaaaaaaaaaaaaatggtacctggcacacaacagtaattattaatagatctgaactgccttgccttttcttctccaaaataaaagcatgaattttttaaaattatcaaagtaagattaaatataaaggaagaatcaaacaatgggcagtgaatggattattcctaagacaataagacaattggctcaattgcctagctttttggaaaataaatcaatttagattcttacagctcaccatttaccaaagtagatttcagatgaactgtagcattacatgaaagaaataataaaagaaccatgaggaaatagtgatgaatctgatctctgaatgaggaagggctttctaagaatgaaatccacgcaagaaatgcaaaggaaatgtgtcatggatccaagctcataaatattaaaataatctgtacatcaactgagtagagaaataatacaccaaactgaaaatacatataccacaaatgctatagatgaacaaataccattaatatataataagctttgcaagttaagttaatttttttcttttttttgaaacagtcacccaggctagggtgcagaggcacaatcttggcttactgcaacctccatctcctgggttttagcaattctcctgtctcagcctcccgagtagctgggattacaggcacacgccaccacgcccagctaatttttgtgtttttgtagcaacgaggttttgccatgttggccaggctgctcttgaactcctgacctcaagtgatccactcgcctcagcctcccaaagtactggggttacaggcgtgattttaaaaatttgatttaaacaacaaaataaaacatcctcaaagaaaaataaacaaagtacaaggtcagttacacaagaaaaaatacacatggatgaaaaacacatgacaattttaaatttatttcatagtcaaagaaaataaaaaattaaatacacagaggtgtttttttttccccctatccgcaaatgaacaaagattcattttttgtgttgatactttacaggcaaggccttagtaatatgaaaaaaatcatatcttctgtgagtgcaaattgaaacaagccttttaaaaagcaatttgagccacatgtattaaaaagcttgataatgacagtcatagtttcttctccactcatatcccaagcaaataatctgaaataaggacaaagatttgagagtaaaattgttcagctcagacatgttatttttgaggaaatttttttttaatttaacttggagattagttgaatgtaatgcattcatggttggggatattttatagctgttataaatggtgcgtacaaaagtttaatgacatgagaaaaatattgataccataatgcttaagaggaaaaaactcaggatgataaaactgaaatcgctgctattttagattggaagcaagtgtgataatagcattgggaaatggagaagatacttataattaccttgggtagtaagtaggactttgggcagttttgcaagtgggtactttgtcatgcttttccagctttcactaatgtcaggtgatactttcatcattagaagaaaaatagttactaaaaaggaaataataaacatgatgaccagcctgtgccccccaggctggagtgcagtggcacaatcttggctcactgtagccttgaactcctggactcaagctattctcccacctcagccttccaagtagctgggactacaggtacatatcatcacatctggctaattttgtgtttttgtttttgtttttatagaggtctcactgttttgccaggctggccttgaagtcctgggctcaagcaattctcccacttccgcctcccgagtatctggggctataggcataaaccacttaggctagaaggctgccagagctgctgtgtacagctccaagtctgtgcactgcacaactccaggagctgcctttgacatcaaccacagtataaatgatgtcccttgagccgtacagtgggggtggcattgggggtgacattgtgatcatagtctgattatttggaagagagaagccttttgtttttacaaactttctttttaaaataataaaatcaatacatacattctatcggaaatataaagatgaaaactaaacttactccaaatcccaattcccagatataatcaatgttaacattttaaggcatctggttctattactccttttctacctgctgagtatcaccatttacagatatatatatttcagatggactatagtgttaaatgaaagaaaccaaattagtcaaaaaccaatttttaaatagctcttcctttttaaaaaaaaaaaaaagagatagggtcttgctctgttgcccaggctacagtacagtagcatgatcatgacatactatagccaagaactcctctgctcaagcaatcctcccacctcagcctccctagtagctgctaccacaggtgtgagccactgctgttggctctagacaactttttcttttttttgagacacagccttgctctgtcacccaagatggaatccagtggcgcaatctcagctcactgtagccttaaactcctagactgaagccaccctcccacctcagactcctgagtagctgggactacaaacacatgccaccatgcctagctaattttgtttattttttgtgaaggtggggtctcactatgttgcccaggcttgtctcacactcctgaccttaagcaatcttccagcctcagcctcccaaagcactgggattacaggcgtgagccaccgcacccagcccacatatgcttttaacgcttagggaaggagtcatctcctcttagcagttatctctgaatcctcggaaggggtaaagaagttctccttggccagttgcagtggttcacgcctgtatttccagcactttgggaggccgaggcaggtggatcacgaggtcaggagatggagaccatcctggccaatatggtgaaaccctgtctctactaaaaatacaaaaattagctgggtgtggtggcgcgtgcctgtaatcccagctactcagaaggctgaggcacgagaatcacttgaacccaggaggtggaggttgcagtgagccgagattgcgccactgcattccagcctggtgacagagcaagactccgtctcaaaaataaaaaataaaaaagaagctctccttgttggccctagcatatttcaaacattgcagtagaccgtggactactttagggcagggactatgttatttatcttttgctcattaaatttagcacagtgccaggcacttaccaggccttcaataaatatttattaaattactgaatgatagatttgattgcagaaacattagaacaaagtttaaaagcctggcagcctcaaatcatgacgtaaagcaaatattctgttaaaacattcatgtccttaatatgtaaagagctcttggccaggcacagtggttcacacctataatcccagcagtttgggaggctgaggtgggaggattgcttgaggccaggagatggaggctgcagtgagctatgattgcacccctgcactccagcctggagtacagagcaagaccctgtcactcaaagaaaaagaaagaatttaaaaatctgctcgagttgtctgagcctaaacacaatttgggtacataaagaacaaaatgccagccaggcgcagtggttcacacctataatcccagcactttgggaggccaaggcaggtggatcacctgaagtcaggagttcgagatcagcctggccaacgtggtgaaacgccatctctgctaaaaatacaaaaaattaactgggcgtggtagcgggcgactgtaatcccagctactcgggaggctgaagcaggagtatcgcttgaacccaggaggtggaggttgcagtgagtcgagatcgcgccattgcatttcagcctgggcaacaagagcgaaactctgtcccaaaaaaagaaaagaaaagaaaaagaacaaaatgccttttcctctctttgtttccatggagaatataacctggaggggaatgaatatagatggaaaggaccagcaacatgacctttttcccactcattgagaccctagggtggtggtgggatggatacccatatagatcacagtgcacccagagatccaaattagatcagttctcacatgctcccaaagacccatgcctagtttcacgggtgttgctttggggacttttgtctatttcctccgtgggtgcattccaaacaccaaacacctacaatggtgcttagtacagcataggtatcagtaaatgtttttgaatatataaatagatactgctagagcattttatgatagtaagcttttaggttttttttttcttttttttttagaaataggtcttgctctgtcgcccaggctggagtgaagtggtgcaatcatagctcactgcagcctggaactcctgggctcaagcgatcctcccgtctcagcctcctgaatagctgggactacaagtgtttgctaccatggctggttaatttgttttaatgtttttttaggatggggcctcgctatgttgcccatattggtcttgaactcctgggatcaagcgatcctcctgcctcccaaagtgctgggattacaggcgtgagccaccgcatccagcctaatttgcttttaggctcttcatgcctttatgcaaataatgacctgagaagctaacctctgattacccagtttattaaaaccaatgtcggtgctgaggcccacttacaagcctaaccatctggataactggattttacaagccacttagaagacttagaagccactgagaagcttagaagccacttagaagcttcaaagctgtttagaagtctaagatcggggtaaccagtgctcctgtatgcagaagttccctgagattgcctttcatgttaggaatggaggtgctgtgagggtgggggggcaagctgcccaggacacagtcagagacctagcatccatgccatccaccttaagacttgatctttcttgttaaggtgatcaccgcaaagatttgagccctggtcctcacttagaggctcgtgttgtcttcccatcatgaagttggaaccaagccatggtagaacagtgactcggcatccacacctccactagctgagctctcatgggtcgtgttttgtctattcttgcagcttcgcaacaacaaggcaaaagacgtctgcttggaccaggggccgctggagaaccacacagcaatattgtatccgtgccatggctggggaccacaggtaggagctcgtctctgaccaggaaggaagtaatatcaccatctccgacccacagaggccttgcaggccttctggataaactttgttgctgtctaccttggtagttatttattctgagaaaaatttttaagaagaaggtaggagtctttctggttatttctgtaaagaagctagggaaaaaattcataagtggttgttgcagcatgcagattttttttttttttttgagatggcgtctcactctgtcctccaggctggagtgcagtggtatgatctcggctcactgcaacctccgcctcccaggctcatgtgattctcctgcctcagcctccagagtagctgggactacatgcgcccgccactgcgcccagctaatttttttgtatttttagtagagacggggtttcaccgtgtcagccaggatggtcttcatctcctgaccttgtgatccgcccgcctcggcctcccaaagtgctgggattacaggcgtgagccaccgtgcccggccaaggctcacaggtttttctctgtgtgtagtggttttgcattcccccgaggtcagctgtgtaccctctgccacatcactgccggtagttctcaatgtccagatggatactcacccttcctcctaaggtgggtgagcaatgccagacaggttactgttcaaatcctcagccctttgaccttgcagcaactctgggaagtaggcaggcagcatgaggaaactgaggcacagaggggcaagtgcctgtgagcaaagcaacctagaacccaggctttccagcacagccaagcattttatactatttatttatttatttatctgtttatttttttagactgagtctttctctgtcacccaaactggaatgcagtgccacaatctcagctcagtgcaacctccgccttctgggttcaagcgattctcctgcctcagcctcctgagtagctgagattacaggcttgcaccaccctgccccagctaatttttgtattttcagtagagacggggtttcaccatgttggccagactggtctcaaactcctgacatcaagtgatccaccacctcggcctcccaaagtgctgggattacaggtgtgagcttccgccctgggccaagcacagccaagcattttaaagtcaaattatcacctgaggtcaggagttcgagaccagcctggacaacatggcaaaaccccgtctctgttggccaggtgcggtggctcacgcctgtaatcccagtgctatgggaggctgaggtgggcagatcatgaggtcaggagatcgagaccatcctggctaacacggtgaaaccgtctctactaaaaatacaaaaaattagctgggcgtggtggtgggcgcctgtagtcccagctactcgggaggctgaggcaggagaatagcatgaacccaggaggtggagcttgcagtgagccaagatcgcaacactgcactccagcctgtgcgacagagtgagactctgtctcaaaaaaaaaaaaaattagccaggcatagtggcgggtgcctgtaatcccagctactggagaggctgaggcaggagaatcacttgaacctgggaggtggagtttcagtgagctgagatcgtgccaccgcactagagcctgggcgacagagcgagactccatctcaaaaaaaaaaaaaaaaaagtcaaatgcgatccatttaaatccaagttatttatggagcaccatcaccatctacgattggtgaaaagtgcctgtggggagtaggagattggctgggaagcctagaccttctcctctccctgaaggttctctgtagggaaatggggatgcacatggaaagcaatatgagctacagaatctaatgcaggtggctgtgatggctgaggcgggaggattgcttgaggccaggagattgagaccagcctgggtaacataacaagacccccgcctctacaaaaaatacataaaatgagttgggcgtggtggcacacgactcaggaagctgaggtgaggggatcacttgaacccaggacttcaaggctgcagtgagccatgatcatgccactgcactcctgggtgacagagtgagaccttgtctcttaaaaaaagaaaaaaataagtgcacgtcttcattcattcattcactcaactaatatgtcttgattacctattctaaaatgctaggcaccactgtaacacaggcagctggtatgatgcagtctttgctcccaaatcgtttacccttgaaggggagggactagaaaagaggcaagaaatctacagtagaataagcgtaacccacggtgctggggcctgggaggtgggaggtagcccagtttggccggaactttgaatgcaagagggaagggagtgctgagagagaaggcagcagagaggtggagagcagatggtgagagacctaaggaggcctgcaccaagactccagcctgcacgctgcagtgggcagcagaatcgtccccaaggctgcgacaacaccagctcctgggccccatccccagagtttttgggtcagatctccggtggggtctgagagtttgcttttgttttctccttccttcctttttttctttttccctccctccctccctccctccctccttctctcccttcctcctccctctctcccttcctccctccctctcttcctccctcccgctctctcttcctccctccctctctcccttcctccctccctctctcccttcctccctccctctctcccttcctccctccctccctcccttcctccctccctctctcccttcctcctccctctctcccttcctccctccctctcttcctccctccctctctcccttcctccctccctctctcccttcctccctccctctctcccttcctccctcccgctctctcttcctccctcccgctctcccttcctccctccctctctcccttcctccctccctctctcccttcctccctccctcccttcctccctccctctctcccttcctccctccctctctcccttcctccctctatcccttcctccctccctctctctcttcctccctccctctctcccttcctccctcgcgctctctcttcctccctcccgctctctcttcctccctccctctctcccttcctccctccctctctcccttcctccctccctctctctcttcctccctccctctctcccttcctccctccctctctcccttcctccctccctctctcccttcctccctccctcccttcctccctccctctctcccttcctccctccctctctcccttcctccctccctctctctcttcctccctccctctctccctccttcctttccttccttcctccctctctccctccttccttcctttcttcctttccttttgtttcctttcctttcctttcttttccttccttccttcctccctctctccctccctccttcctttcttcctttccttttgtttcctttcccttcctttctttcttttcccttccttccttccttcctttcttccttccttccttccccccttcctttcttcctttcctttccttttttctttccttccttccttccttccttttcttccttccttcattttcttctttctttttttaagagatagggtcttgctgtgttacccaggctggagtgcaatggtgtgatcacagctcactgcagcctcagcctcctgggcttaagtgctcctcctgcctcagcctccttagtagctgggactaaaggcagatgccaccatgttccactcaattttccatttttttgtagacatagagtcttgctgtgttgcctgggcttgtcttggactcctggcctcaagggatcctcccaccttggcctcccagagtgctgggattacaggcgtgagcctcagcacccagccccagttttgcatttccagctgatttctaggtgatgctgatgccgctggtttgaggaaatgggacttgatccagaggatgtcagggagccactggaaggctcacctgggggtgggagaggtgatatgtttagactgcctacagcagttccagcagggactaagaagctatgtcttggaatagaccaaatgaaaagccctagctagtctcgggctgagatggccaagagttggatatagcaacttgtggtactgagcctagaggacttgaagaaaggggacatagagggtgggaggcagggcccagcacactccccacaccaccttcctaggatacccacagcctctggcccaggcagcaagatcccagaggctgagcctagggcagtcccactcctgggccccatggctgtgccggatcatccttttaggcaattactccaagagtagctgtgaaaagagcacttaactcccagacttctttgttcaatcttctgaataagtcacatttgaatggcgcacttattaacggtgacatagtagaggctatcccagttagatactggcataatcaaaaactgctccaaggacgtccacttgtcctatgaatgtggaacaaagtaaagatggtctgatcccatagcttccccatgtggctctaagcagttacattttgctttgggtgtttcaggggaaggttttgtttttgtttttgttttgtttttgtttgtttgtttgttttgttttcagacagagtctcgctctgtcacccaggctggagtgcaatggcgcgatctcgggtcactgcaacctccgcctcctgggttcaggcgattctcctgcctcagccttatgagtagttgggattacaggcgcccaccaccatgcccagctaatttttgtattttcagtagtgatggtgtttcgccacgttggtcaggctggtctcaaactcccgacctcaggtgatccacccaccttggcctcgcaaagtgctgggattacaggcaagagccactgcgcccggcctcaggggaaggtttttaaagccactcaggaagcacgtgggtgaacctgagggctgggatgtgaaggcggcagtgtctgccttctgtggccctgtggccccccaccctccccagcatctttaacacctttgtgatgcctacacctccagacatagtctggggcagactgctgtgaacttgaccttccttacctttctgtctggagcctttattcctctatagcccctccctcaagcttctgcccagtgggaacctgatagaccagcaggaatgcctggatggcataatttcaggacaacatggtcagaacttttctttcttttcttttctctttttagagacaaggtcttgctctgtcacccaagctcgagtccagtggtgcaatcatagctcactgcagccttgacctcctaggctcaagaaatcctcccatctcggcctctcaagtagctgggattacaggcatgaatcaccttgcccagctaattttttttaaaaagttttttgtagaaataggggtctccctatgcttcccaggctggtgtagaagtcctgacctctggaactcctgatctcaggcaattttctcacctccgcctcccaaagtgctgaggctacaggtgtgagcccctgtgcttgagcctgtggttaaaatttaatgagggctttcactctgaaggtgaccaccttctgactccctccccaggcaggaggcagacatcaagtctcctttcctgctgggagcttagtggcactcccagcacagtgtggcccctttgttaggaaatggctgggtttcatctttcccagttccacctgcgtgcggaacttttccaagtgaaagctcctgccatggagctgattagattgagttgatttagaacggcaaaccggattaggctgctcatggctcccccggctctgggatggacgcttgttaagtgggccccggctgctttccgtcagctgctttttaaaaagtcaatctcatgttgctttctgttcagccacgtgtcctgaattagagaacgcttggtgtggctctccagctgccaggcggtccctctactcactcatcaaagctcccccacttcccaaacccactccttctgtgcaaggagtcctgtcacccaactggaatccttctaaactgcttcccaaaatgccatgggtgcaaacagtggcagaatcagagctcctgtaaccaggcggctctcagcagaaggaattggtgctccacggacatcgctagcttaattaatggactctatgttgtaatttattatcaaacagcaattaaacagagataaaataggcactgaggagggtaatttcctgtcttgcagcatgtgtttgtcaacaagatgttccgggccactcagagagccttgcttgctcggaaatgtctgtcgccttggttttggctgattactaattagaattagacaaacatccgcttctttttggaagcctgagttttatttaaaaatagaatgtcaaggctgggcgcactggctcacgcttgtaatcccagcactttgggaggccaaggcgggtggatcacttccagtcaggagtttgagaccagcctggccaacatgatgaaacctcgtctctactaaaaatacaaaaattagccaggtgtggtggtgggcgcctgtaatcccagctactccgggaggctgaggcaggagaatcacttgaactcaggaggcggaggttgcagtgagctgagaccatgccactgcactccagcctgggcaacagagcaacactctgtctcaaaaaaaaaaaaaaaaaacaaaagaaaccatcaaggatgcagtagcagccttagtgttggcttgaacctatttggaacagaagttcttgtctaaggagacccacagacccccagttctaccaggctgttgccctcctgcacccaggcccagggtgggtccccaagctagagcaaccacagtgaaaccagaacactttggctaccctgcacggagagcaccctcctctgccaggcccttcttgctacaccgctccagacagctggtcaaccttctccagccacagcttctgatttctccagaaaggcaaaggtgctatcaggaagaaagagggggctaggggtagtgctgaccccagggacccactgtggcatctttctcagccctgaacgcccccgatggctctgcatctgctctctcaggtccctacagctgacccgcagcccagggtttgaacagtgcggcatacaatggactctggccccatagccgcgtgttccagcccctgcctagggacagctctgaacactctgggtcagggctgggctgtgttaaagaacaaaaatgctgacaataagacccatatctgtttttggtgacatgtttaatccttccaactactctgtctggtaaatagtaacctcctcccatccccccgactttattttttatttgagatagggtcttgttctgtcatctaggctggagtacagtggtgcaatcatagctcgctgcagcctcaaactcctgggttcaagcaaccctcctgcttcagcttccagagtaactgggactactggttatgaaccaccacacccagctaatttttcagtttttttgtaaagatggggtctcactatgttgcccaagttggtctggaactcccaacctcaagctgtcctcccaccttggcctcccagagtgctagtattttggatgtgagccaccttgcctggcaccacctgctttttttttattattattattaatgagaacatggagattcagatagggcaatgccagctgtcaaacgaatgtcccatatcatttggtcttgggtactctgatctgcatctggtgaattctggagagcacctcatatccttgagtccttcggtgttctccaggccacagcaaaacacagtggaaagactcataggaagcagagaggaatggaacatgaaagcccaggtgcagaggctggaatcacgaggcacatttcaggaaataatcacacagttggcagaagcaggtggttcagggtggcccaaaagggacagagtatggagatcctccggtgctaggatcaagggctagggcttccactcagcatctcaggtgtggtccactgacccagtgaaccctctggggacttattgtaaccgcctcttccaaagtccaacccccgacctagtggaggtggggcctaggattccacatcgtaacaagcattggcaggtgcttttctttgtcaatccacaactatttattgagcatctattttgagaacttgtttgggggttctagcaggggagtgcagatactcgtatacccttgaccaaagactggtcttcctctattggggatggtcatcctctttgaccaagcatgcagtttcaggagggatgcacgtggaggggtgagggagaaaggggacacccgtctagccagccagatcagctgaatcaaccctggcgatcaatgggatgacagaagttgcagccagatcaccctcacatccaagtgagcatctatttaggataatgctgtgaattaggccatataggtggtgatcatatgtccctatctgcccaggacagacgctgtttaggcctagtgtcccagcttgattttttgtttttaatttataacactatcttagttttttatataattgaggttcttgggtttttttttttttttcttttcaaggcaattactattttttttttttttttttttttttgagacagagtctcactctgtcacccaggctggagtgcagtggtgcgatcttggctcactgcaacctccgcctcctgcgttcaagcgattctcctgcctcagcctcccgagtagctgggattacaggcacctgccaccacacctggttaatttttatatttttagtagagatggggtttcaccatgttagccaggctggtcttcaacttctgacctcaggtgatccgcctgcctaggcctcccaaagttctggaattacaggcgtaagccacggcgcccagcctgtttactctttataatgtataattttgcaggttttagcaagcacatgtgatcaagtaatcacaccataatcaagatacagagcagttcaatattcccctgaacctctgcccacatatactttttaaaaagatttattttgttagagacagcatctcactctgtcacccaggctggagcacagtggtgccaccagagctcactgtgaccttgaactcctgggctcaagcaatcctgctgccttagcctcctgagtagctgggattacagtcacacaccaccataccaggcttttttattttttttttaaatttttgtagagatagggatctcactatgttgcccaggctggtcccaaactcctgggctcaagtgatccgcccaccgctgcctcccaaagtgctgggatgataggtataagccagtgcgcccagccttccacatacttttatacacatcacaatcacttttgaggaccatagttgagagagtgttcatagaagttgcctgtacacctgcacatgttcaaacctaacacgttcctgcaaattctgatgcagctttgtccccgagctgagactcactgcccctccacagcccataccatggacgaggtgtgactaacagggtctgcaagaaatggccctggagatttcgacgggcactctttgaaacagctactggctgtaatgagatgttcgtaagatgaggtgtgcactgtgggaaggaattgagggtgggagtccctcttggaaggtgtcaagctctgttcccaggacctttctgattcagtaggctcaggggaggacattagcgcccaggacctttctgattcagtaggctcaggggaggacattagcgacgtctcctctgtgtgtcctccctgttaatacattttcctcctcttctccgtcctttccgagagactcaacgtttcttctctcagttaattcatcaccaaaatgacagatgagattcttttatcctgtaattaaattcaatctgatcttggactcattctctgatggcttcatcttttaagcgatacatcatccaaacaccttgtcattatgatgcattgtgccaataaggcacccgtgccctgctggcgtgacggggctctggcgagctattagcatgtaggaggcacccctggtcgtcgtcggaaaacacagaagtgagtgacacccagcagcctcttggcttccagatgctatcatgtaagtgtcggagctcaggcaacgcagcctttgagaacacattgaagtttcgcccaagaaaagatggctttggtccagaaaacaggcctgaggttctgggaatatgcctctcccatttgataagaagcaaacttgatcatccctttccatccacgaaaacccaattcctagaaatcaccatgggggtcaaatcaggggatctgtagaccttctggaaaacagagttgggggactgaaggcagatactttttaaaaatttttttattaattaactatatatttcatgacaaggtcttgctctgtcacccaggctggagtgcggtggtgcagtcagctcactgcaacctcaatctcccagactacaggtgcacaccaccatgcctagctaatttttttgtgttatttgtacagatggggtcttgctgtgttgcccaagctggtctcaaactcctaggctcgagtgattctcccccctcagcctcccaaagtgctgggattacaagtatgagccactgcacctgacccagatacttttgatgctgagaaaacctgctgcacacacaaatgggagatgaaacagaaaataggagaggaaatgctgatggtgttctatgtatctgaaattcgacaccacagaggttctgaaccacttattttcattttccattttcaatctcttatgccatattttttaaaacctctccttttgcattccaatgcaacacttataaattcgtcttacctcgttgcatgcagatagtgagaatattaacagccttttttgttgttgctgttgctcttctgactcgtcttctctcaaaatattcaaaatgtttctgattttattactttgggttgttcgttcctgcctcctgggccctgcgtccatcagcctgtgtgtacactccttgcagccactctctttgcagacctccatgcaatgcagttttacatgctttctgcttgctgagattttccccgaggctttgggggacccaggcctctttctctgccatctgctttgcttctcttttctatttccaactcccaattccgtttttctaattatccctgagaagtggctctcgtgatccacgtgcagagcacaggaaggcttgagttcctaaatatttcctgctgatgtatcacctaagtttatgaaatattccaaatattctgttgtgtcctttcaacaatattcacaacatcttcatcaggagtagattcctcctcaagagaccactgtctttgcttatccattaagaaacaactctatatctgttcctgtttgatcataagattgtagcaattccatgccatcagtgtgcagaagtaaagacacatgtacaggcatacctcatttcatagcgtttcactttatggtactttgtagatgttgcattttttcacagatcgaagggttgtggcaacgtgacatcgagcaagtctatgggtgccgtttttccaacagcacctgctcacttcctgtcgctgtgtcacattttggtaattcttgcaatatttcaaactttttcattagtattgtatctgttatggtggtttgtgatcagtatctttgatgttactattgtaattattcggggcactatgagctgcacctagacaggaccgcgaacgtaaatcataaatgttgtgtgtgtttgacggctccactgttgggccattctcctatctctctcccaattctcgggcctttctattccccgagacacagcaatattgaaattcagccaattaacagccctataatggcctctaaaagctttagtgaggaagacaagtcacaagccaaataaggctgaaagctaggcctcttgtgccaaataatttgccaagttatgaatgcaaaggaaaagttattgaaggaaattaaacatgctactccagtgaacacacgaatgctaagaaagcaaaacagcctcattgttcatagggagtcagttttagtggtatggttagaagaccagtccagccacaacattcccttaagccaaaagcctaatccagaacaagggcctagttctcttcaattctatgaaggctgaaagaagtgaggaagctacagaagaaaagtttgaaggtagcagaggttggcttgaggtttaaggaaagaagctgtctctgcaacataatggtgcagggtgaagcagcaagtgctgatggagaagctgcagcaagttctccagaagatctagctaaactcattgctgaaggtgtctacactcaacaacagattttcaacgtagacagaacagccttctattagaagaaggtgctatctaggactttcccacatagagaggagaagtccatgcctggcttcaaagcctcaaaggacagcctgactctcctgtgagaggcgaatgcagctggtgactttaagttgaagctaaagctcatttaccattttgaagatcctagggcccttaagaatgatgctaaatctactctgcatgtgcccgagaaatggaacaacagagcttggatatcagtgcatctgtttacagcatggtttactgaatatctttttttttttttttcttttttttgagacggagtctcactctgtcaccaggctggagtgcagtggcgcaatctcggctcactgcaatctccgactcctgggttcaggcgagtctcccgcctcagcctcccgagtagctgggactacaggtgcgcaccatcacgcccagctaatttttctatttttagtagagacagggtttccaccatgttggccaggatggtctcgatctcttgacttcaagatccacccttcttggcctcccaaagtgttgggattacaggcgtgagccacaacgcctggccggtttgctgattatattaagcccactgtccagtcccacttctcagaaaaaaaaaaaaaagattcctttcacaatatcactgctcattgataatggtcacctaggagctctgatggatacgtaccaaaagatgaatgttgttctcatgcctgataacacatcatccattctgcagcccacggatcaaggagtaattttgaccttcaagtcttatttaagaaattcattttgtaagactgtagctgccatagatagtgattcttctcatgggtctggccaaagtccatggaaagctttttgggaagaatgtaccattttagataccagtaagcatgtttgtgattcatggaagaccaaaatagcaacatgaacaggagtgtggaagaagtggattccaaccctcatggatgactttgagggtttcaaggcttcagtggaggaaggaactccagatgtggtggaaacagcaagagaactagaaccaaaatggagcccgtagatgggactgaattgctgcaatctcatgatcaaacatgaacaaagagttgtttcttcacggataagcaaagacagtggtctcttgagatggaatctactcctgatggggatgttgtgaatattgttgaaatgacacaagagaatatttagaatattccataaacttaggtggtgtatcagcagcaggatttgagaggattggctccaattttgaaagaaattctactgtgggtaaaatgctactaaccagcattggatgctacagcgaaatatttcatggaagggagagagtcaattaatgcagcaaactttgttattctcttattttaagaaattgccacagccgccccaacattcagcaaccaccaccccgccaccctgatcagtcagcagccataacatcaagccgtgaccctccattagcaaaaagattacagcttactgaaggctcagatgatcactagtatttttagccatgaagtatttttaaattaagctatgcacatttttaaaaggcatgctattgcacacttaatagtctacagtatagtgtaaacataactttttatgcactgggaaaccaatatatttgtgtgacttgcctttttattgcaatattcgctatattgcagtggtctgcaactgaacctgcaatatctcaagatatgcctgtatttgattttgcctaaggaagactcagggttaaggaggaattactgtactatttctttcctgccagaatggattgatgagctattctttccaggaaatcacaatgacagacataaattgttttccagtggagattgtgagttgagacttttgtgtcttccgggaagtttagctgacttttctccaggcacaaaaagtcattcaggcaggttttgtgctcatgttaggcttggaataaggaactcagattgaacaatagagtggtagccatgtcaccagctgagcctttctcccttgcccagggatattaaattccacagccaaataagtgaaagtcacttctgctcctctttttttaatcttttctttctttctttcctttctttccttcctttcttccttcctttctctctttctctctttctttttttctttttttgaaagagtctgtttctgtcacccatgctggagtgcagtgccataatcagagctcactgtagccgcgacctcctggattcaagcaatcctcccacctctgcctcccaagtagctggaccacagccacacaccaccatgcttggctaatttttaagttttttatagagatggggtctcgctatgttgccttgctgtgttgaccaagctggtctcaaactcctggcctcccgcaatcttcctgcctcagcttcccaaagtgctgggatttataggtgtgagtcagtgtgcctggcccttcttttttactgaaggcacaatagcatttcagagagtttgaaaaacacaaatttaaatcatccatggtcctgccaccctacaacaactattattattactgaaggttactttcagcttttctttttttcaaagaaatatattgatttgttaggctgtctttatatcactgaattaaaaaggaaacaacgtcactgtttctgaaggacaaggagggggacgtaaagcctcctggtggaatgtatttagtgccttactctttactctttagctaggaggctcagcagagcgatgcagaacttcacagtagcctcatccctgactgcttgattcacagagctttgatttctccttgggacagtagtatctgttgaatgattattttcagtaagttcatagtgagatatgtacacacacatacacatacacataaaacaagctacataaacaattttattatacatacacaatgtatgtatataagtactttttaatttttttatttttattctatttttttttttttatttttgagaaggaatctcactctggcacccaggctggagtgcagtggcgtgatctcagctcactgcaacctccacctcccaggttcaagtgattcttctgcctcagcctccagagtaactgggattacaggtgcccgccaccacactcagctaatttttgaatttttagtagagatggggtttcatcatcttggccaggctggtctcaaactcctgacctcaagtgatccgcccacctcggcctcccaaagtgcatgagccaccgcacccagccataagtacatatttgttatagtatatacttagatagataactatatactagtgttagtattcagtgaaagtggatcatcataaagttcttcatccttgttgtcttcacatactataagtatataagtatatatttaagtatatactataatataaatagtgtgtgtgtatatagtgtgtgtatatatatctacaatacatgtatacatatatacacatatatatacacacacacacatacacacacacacacacacacacacacacacacacacacacacacacatatatatatatggagacaagaccaaaacaatgcaatgtgagatcctgggttggatcctgggaagaaaatccatgtttgtggttttgatttgcatgtcccttcaatgatagactggattaaaaaaatgtggtgcatatacatcatggaatactttatagacataaaaaagaatggaatcttgtcctttgcagggacatggatggagcttgaggccattatccttagcaaagtaacacagaaacagaaaaccaaataacttctctcttataagtaggatctgaattatgagaacacgtggacacatagaagggaataacaaacactggggcctattggagggtagggggtggagggtggtaggagggaggggatcaggaaaaatattaaatagctaatgggtactaggcttaatacctgggtgatgaaataagctgtacaacaaacccccatgacacaagtttacctgtgtaacaaacctgcatatgtacccctgcactttaaaaaaagttaaaaaaaaaaaaaagaatctataggaaagaaaacaagttctttgtaaagctggagcaagaccccagttattcaatggtgggtgaggtcggggaagctaatatccacatttgcttctcattattttatttaatccgttattttattagtctgttttcatgctgctgataaagtcgtacctgagactgggcaatttacaaaacaaggaggtttaatggactcacagttccacgtggctggggaggcctcacaatcacggtggaaggtgaaagtgatgtcttccctggtggcagacaagagaagagaacttgtgcagggaaactcccctttataaaaccatcagatcttgtgagacttattcactatctcaagaatagcacaggaaagacccacctccatgtttcaattacctcccacttggtccctcccacaaaacattagaattgtgggagctacaattccagatgagatttgggtggggacagagtcaaaccgtatcaatctccataaatgcactatgatgtaatctataattatcccaattttttttttttttttgagatggagtctcactctgtcactcaggctgaagtgcagttgcacaatctcggctcactgcaacctctgccactcaggtttaagcaattctcctgctgcagcctctgccacccagattcaagcaattctcctgcctcagcctcccaagtagctgtgattacagatgtgcaccaccacgttcagttaatgttcgtatttttagtagagacggggtttcaccatgttggccaggctggtctcaaacttctgacctcaagtgattcgcccgcctcggcctcctaaagtgctgggattacaggcgtgagccacggtgcccagccattatccccattttaaaaaataaggaagcagagtcccatagggctaaagtaattggcccagggccataaaatcattaagtagcagagcctggatttcttaagcaggccccagagtccaagtccttaaccattatactcctgtctctctaatgacacagcaaggtcagaaatgctgctgtagttggcaagcgaagaaagtgagctggttgagccgtggtacagaaagccagtgcttgctagcacgtccacactgaaccaggatacagccctcccttcccatttcacatatagagacaaaaaagaaattcatgtcatcagcggtctgtcctactgagaaataaagtctttacttccttaaccaattcagcagtcaaaggtgtgctttgaagatgtgcttaggaatattctcctgattccctagaagtcggagtggactacgcattccctctctcacccagctcttccagctctcatcctggtgccccacaccaagagaggccccaggtctctccacaggtcatgtgggccagaccctgcctccatcagaactgccccaatctatccgctcctagaactgtctctgcaagaaaatcagcctgaggtttttgtggcacaaagatgtatccccattcattccaagtagcaaatgcattttctggaaacatagtgcttgaatccagcatgatgagtcatatggcagaagggagaagccagcagaggaagggcccttgggaccatcccagcccccaggagctggccctctctgcaggaaccatctggttccatagcatgctttctaagctcccatatatatttttaaatcaactatatggaagcgtaaggtaaataaatacactgcatctatttaaagtgtgcaatctgatgagttttgccaggtgtgtgcacctgtgaaggggctcttgaaatcaagattcagaacatttccatctccctcaaggatttctcatgctccttttctaaccccagctctcaggcagccaccacttgcccactgtgagacatttattttctatattcagtttgggattgggcatttggaattttccaaaggcagcatcctctgtagatgtctacaggcccctggagacagagcatcttctcaggcctgtatcctccatgcctgggactgggtccttgctctcaggacagcctagaggggctcctgtcccctgctgggctgcctctttctttgcttggcccagcttcccaaacacccaggataataaaggagaaactctgtcaatttcaataatatacacatgtacttgccagtcataagaaaccattcttctgggctttaaccaagcaataaataaatgtactccaaagcagatctgaattaatggaatatatctctctgtctcttgagtagaagctgggaaacctgaacttttcttttttggtgtttgttttagagataggatcttgctctgtcacctaggctggaatgcagtggtgcagtcatagttcactgcagccttaagttcctgggctcaattgatcctcctgcctcagcctcccgagtagctgggactacaagcatgtgccaccatgcccagctagtttattttatttttatagagacggtgtttcactatgttacccaggctggtcttgaactcctagcctcaagtgatcctcctgcctcaccctcccaaagtgctgggattacaggtgtgagcccctgtgcccagccaagaaacctacattttgcatttagccattgttttctacactgactgctggattttaaaatcaagagaaaggcctctaataggaaagcaattgcaagccatgtttttattgataatctgatggattttgctgtgttctggagtcattctgcaattatttatctggtttttgtttatctggctataacctgcgtattctagttttccttcaaggctgttaaatttgggttaatagttgtatgtgtctcttagatcatctcaaatggaaaattctttccccctaaatgagaattaattgtatttgagctcagagggttttttcccaatgcattagggtgtggataatgacgttcatttctcctcatgagcccaggagccaaatagagtaatcccattcacttccaaagacatttatagagcatttgatttttgcaagatacttttgttggtccttaatgctggataaaaatgggtataatgctgctaaaaataacactaagaaaaacctatagcaaagaaagacacatttataaaatacgagattatgtaagttggaagaatcatatctgggtgggggctatatggagccagtggagacagggtggggctagggagagaatatcctgcacatacagggaaggcaggctggacggtcagctgttgttgagaaacctcatatcatctatcagactaagccagaaaagcaagagttacacctgaaaaggtaagtgggaccatagagtaaaaagtcatggtagaaagtttattcttaaattggtggaccatgagagcaatggaagattgaggcaaggaatggtatggttataacctgcaggactgggtagggtagatgggaactgtgagggtctggaggcaagagaaccagtgataaagatctgtctttatctgcatctgtctcagaatagtaagaatattcgggtctcagaatagtctggaattttgggaggaaatatttagaggcaggaatcggaggacatgcaaatttgtggatgaaaggatgagggaggggaagggtgcaaagttgattcaagtgcgcaagtctagaactaggggactctgggtgcgtaacagggagctaattgtctgttggctccacactgcaggaatgagagtcacaagtttcaggcagtcgtaaactcagagaataatgcattacccatccttctcctcccactagcaggattaccttggcaacagtgagcatcatcataccaaaatgatagatttcacagatagtggcttggccataatttggtgaatgagcatcacagtaatgaaatagctttcagtagtagagtacattagatactttgaagggtctccctgctctcatatagacagattttagataaactataacaaatattatttagattttttttctaggctcataagaaagtggttgtatcagccgggagtggtggctcatgcctataatcccagcactttgggaggcctagtcaggcagatcacctgaggtcaggagttcaagaccagcctggccaacatggcaaaaccctgtctctactaaaagtacaaacattagccaggcatggtggtgggcgcctgtaatcccagctactcaggaggctgaggcaggagaattgcttgaatctgggaggcagaggttacagcgagccatgatcacgccactgcactccagcctgcgcgacaagagcaagactctgtctcaaaaaaaaaaaaaaaaaagaaaagaaaagaaagaaagtggttgtatcagtgagcttttgctgcataacaaattatccccagacattttcagataaactaaatctgacagtgtgtctgtcctatgacagacagtcaccaaaggaacttctaaagaatgtactgtaggaaaaaggaaaatgactgcagaaggatgtcttgaggcaagaatgaattataagcaaagaaatttataaacacataaatctatgcaaacatttattgcataaaatcataagaataatgtctaatttggggaacaagggagatataaccaaaatactgaactattagaaggaagtgatcagatttggtatcctaatgtctttgaattttattgaggggaagcagatgttaagatattttataaaattagattttgcaaagttgtcactggttaaatttgaagagtaaacaataaaataatagaaatggagtgtgatttttaaatctgtagaggggaacaatgaaatctgataacatgtcaacaaatcaaccaaacgcaactaatccaagcaaaggcaagtagaggagaaagaaggaaacagaggagcctggacaaacagaaagcacaaagagagatggtagaaataagtacaaatatatcattaattacaatgaatatgaatggatttaactcttcagttaaaagacagagattgccaccttaaatttttaaaactccagctgtattccattttcaagagacacataaaaaacctcaggagagcgccgggcccagtggctcacgcctgtaatcccagcactttgagaggccgaggggggcagattgccagaactcaggagttcgagaccagcctgggcaacatggtgaaaccctgtctctactaaaatacaaaaaattagctgggcatggcagcgtgtgcctgtaatcccacctactcgggaggctgaggcaggagaattgcttgaaccagggaggtggaggttgtagtgagccaagatcatgccactgcacgccagcctaggcaacagagcaagactccatctcaaaaaaaaaaaaaaaaaaaaaaaaatgaccaggtgcagtggctcacacctgtaatcccagcacttcttgaggccgaggccggtggatcacgaggtcaagatatcgataccattctggccaacatggtgaaaccccgtctctactacaagtacaaaaattagcctggcatggtggtgcacctgtagtcccagctactccggagtctgaggcaggagaatcgcttgaacctgggaggcagaggttgcagtgagccgagattgcgccactgcgctccagcctgggtgacagagtgagactctgtctcaaaaaaaaaaaaaacccaaaaaacaaaaaaaaaaccctcaggagagtgaaatgttgaattaaaaagatggaaagggttatgtcaggcaaattctaaagagcagaaagctggggtaacctcgttaatatcaaacaaactagcctgtagatcaaaatgcgttattaaagatgaatgcggcctggacacagtggctcatgcctgtaatcccaacactttgagatgctgaaatgggagaatcatttgagcctaggagtttgaggccagcctgggcaaaatagtgagaccctgtctctatgatttttttttaaataaccaggtgttatggcatgcacctgtagtcccagctacttgggaggctgaggcaggaggatcacgtatgcgcaggagttggaggctgcaattaactatgatcactttactgcactgcagcctgagtgatggagtgagacccctgtctcagaaaaaaaataaggtgaagtgtgtcagtgtatgatgataaaatattccgttttccagtaagatagaataattattggccaggcacagtggctcacacctgtaatcacagcagtttgggaggccaaggcgggcagatcacttgaggctaggagttcaagaccagcctggccaacatagcgaaagcccatgtctactaaaaatacaacaacaacaacaacaaaaaactagccaggcacagtgatgcacacctgtagtcccagatactcaggaggctaaggcccaagaatcacttgagcccaggtggcggaggttgcagtgagccgagatcacgccactgcactacagtttgggtgacatagtgagactttctcaaaaaaaaaaaaaaagaagaattcttaactacttaacttgtatgcattctcaaatctgtcttcttctaaccttcactgtcacacttgagttcagaccttcatccgcccctctacttccatcctcattgcagttcattctccactcaacagacagtgtggtcagcctaaaattcagatggctcttgatgagaaagccccgattcctgagcttgatggactccatctagtggagtctcacctgcactagacccagctcccccacctctatactccatcatggtgaaagctatgcttgggttctccaaaacaccacatttcctctggtctccaggcctttaaacagctgctccatattcctggtctgatctgtttttctcttacttgcctagttggctgactccatcagggcttgacttcaatgccttctcctctgggaatccttctttgaccttcctcttttggatggggactcatcctattctgcttttatgaaccaccgtgtatttcctagcaatatttcacattttatcattgcctttttacttgcctgactccagtgagtaagctgtgaacacctcgaaagcaagcactgtgtcattcattcatgatgtcaacaaatatttatcaagcacctactatatgccaggcattcttctaagagctagagatagagcagtgaacaaaaaagttaagcaaacacacccctgccttcatgccactctcattctagccaagggagccaaacaacaaactgggtaggtaaggaaaatagatggtttaatagaagatgataggtgtttgcagagaagtaaagcaaggagaaagatagggagtaaggggtggatgtgaaattttaaataagatgatcaagggaaagtctcagaaagaatatgacatttggccggtcacgatggctcacgcctgtaatcccagcactttgggaggccgaggtaggcagatcacctgaggtcagaagttcaagaccagcctggccaacctggtgaaaccttgtctctactaaaagtataaaaattagctgggcatggtggcaggtgcctgtaatcctggctactctggaggctaaggcaggagaatcacttgaactcaggaggtggaggttgcagtgagccaagatcacgccattgtactccagcctggataacagagtgagactctatctcaaaaaagaaaaaaaaaagaatatgacatttaagcagaaacttgaaagaggtgagagagtgagccattcaaacatctggaggaggcactcctgggtatctacccaaagaaaaaggagtcatcctatcaaaaagatgcctgcacttgtatgttcatcacagcactatccacaataacaaattcatggaattaacctaagtgcgcatcaagagtggatgggataaagaaaatgtggtgtatgtatatatatatatatgtgtatatatatgtatatatatgtgtatatatatgtgtgtgtgtatatatatgtgtgtgtgtgtatatatatatacacatatatatacacatatatatatgtgtatatatatatacacatatatatatacatatatatatgtatatatatatatacacatatatatatatacatatatatatgtatatatatacatgtcatggaacactatgcaaccataaaaaagaataaaatcatatcctttgcagcaacatagatgtagctggaggccattatcctaagtgaattaacaaaggaacagaaaacctaataccacatgttctcacttataagtgggagctaaacattggacatagaaatggaaacaatagacactgtggactaccagagtagagagagagggaggagggtaagggttgaaaagtgcctactgggtactatgtttactatttgggtgatgggttcagtagaagcccaaacctcagcattatgcaatatatccatgtaacaaatatgtacactaccccctgaatctaaaacttttaaaaatagaaaaacagaaagatacctaaaggaagagtattcaagagagaaggaacagccagtgcaaaggctctgagcaggagcaggcatggacggttcacagatcagcagggaggcgcatgtggctggattaaataagatgatcaaggaaaagtctcagcaaacaatatgacatgtggctggaagttctggaagctcagaaagccattattggattgcaagacccatcgcaaggatcttggacttttattttgggtgagattggaagcttccagaagattttcagcagagagatggcacaccctgactccaatttaaagtaacatgattttaaataatatagtattttaaaagcagtcactctggatggtgtgttgataaaaagctgagggaggcaaggagggggaactggggaaccagttaggaggccattgcactaaccttatcaagaaaggaagttggcttagaacagggaggtagctgtggaggtggaatctggatatgatttgctaatggattgaatatggtggatcagagaaaggggtaagtaaggtgtttggcctaagcaactgtaaggatggagttatcattaccaagaaggaatagatgctggatgagtgtatgggtgatggtggttacacaagaggatcagttcagttgggtcatctaaatttaaaatgcttattagacatccaagtggtatgtcaagtagggagctggatatacaaagttggaattgagagaaatttttggtttggagatagaagtttcaaacagccaaattagcatgtaaatgctattgaaagcgctgaggatggaaaactctccaagaaagtgactacatataggagaagttatatcaactgtactcagcacagcgcctgggggcaattgaagtttataatttatagatcctggtttattaggctgttcttgccttgttttaaagaaatactggagactgggtaatttataaagaaaagaggtttaattggcttttggctgtacaacatctgctcagcttctggtgaggcctcagggagcttttgcccatgacggaaggtgaagcaggagcaggcacatcaatgggcaagagtgggaaaaagagagtgaggtgagaaggtcctagacttctaaacaaccagatcttgcattaactaactaagcaagaactcatttatcaccaaggggatggtgcttaaaccattcataagggatatggccccatgatacagttacctcccatcagaccccatctccaacaccgtcaatcacatttcaacatgatatttggaggagacaaacactcaaaccgcatcacctgataacctttaaaagagcaatttcaataaagtaacaatggcagaagttaggtttcaaggcattaaaggtataagagagaggaaattcaaattaagagataagtagagctgtggctagagtcataaagatccggttatatttgtagcttgattgaagaaatgaaagaaaggagtgaataatggcttagggtacctacagtgtgggaagagggtcagagaccgaaggaaatgagagtgaaggaagacaggtttttgagaagtaagggagacaacttttcaacaaaatggaaagtaatattctctgaaggcagtaagggcccaggacaccaggataggagattgaggaggaagaacacatttttaaaaatctagactctggcagggatggaaggcagtgttggttgacagagagtcacatgaggcaaatgaaaagatgagaagggcccaggcacagttggaacacaggtctccagtgggtgtggtcagttggcacctgtccctggctgtgtgaaagcaaagaccaaggagacccgtaaaacctgtagttcagagtgaccatgaggtacctgggtggttggtgtgatcacagaggtgtattaaacacactacttgcactggcaatgaacattctgaaaagggaattaagagaacaaaaccatttacaatagcatcaaaaaggattaaatgcttaggaataaatttagccaaaaaaatgcaagacatgtacactgaaaatgagaaaacattattgaaagaaattaaagatctaagtaaaaaagatatcctgtgttcatggattagaggacttaagagtgttaagatggcatttcttcctaaattgatctagagattcaatgcaatccctatcaaaatgccaactgcctttttttttttttttgcagaaatggaaaagctaatcctaaaatacatatgaaattcaagggacacaaaatagccagaacagtattgaaaaagaacaaagttgcaagactcacacttcccagttctaagacttgctacaaagctataataatcaaagcagtatagtgtggcacaaagatagacgtggagatcaaaggaatcacatttagagtctagaaacaaaccctcacatttatagtccattgatttttgacaagagtgacaagacaattcaataaggaaagaatagtcttttcagcaatggtgccgggacacagatatccacatgaaaaagagtgaatttggacctcaaccttatactatacagaaaaaaaattcaaagggcatcaaagacctaaatataagagatgaaactataaaattcttagaaaacacaggggtaaatcttcatggccttggattttgcaatggtttcttagatatgacttcaaaaccacaaataaccaaagaaaaaaatagctactttgtattttaccaaaaagaaaaactttgatgcttcaaaggacattatcaagcaagtgaaaaacaacccacagaatgggagaaaatatttgtacatcatatgtcagaaaaatgtcttagtatccagaatatgtaaagaactcttaaaactcaaaaataagaagacaaataaccctttttttgatggtcaaaagagttgaatagacttttttttcaaagaagatataaaacggtcaataagcaaatgaaaagatgctcaacatctttagtcattagagaaatgcaaattaaaaccacagtggccacttcacactcctactaggatgactagaatcaaaaaaagcagacaataacatgagttggccaggatgtggagaaattgaaaccccggttcattgctggtgggagtgtaaaatggtacagctgctttggaaaatagtttggcagttccgtagaaagttaaacatagagttaccatatggcccaaggatgagtaattctactcctaggtgtatacctcagagaattgaaaacatatgttcatatgaaaattgtacatgaatatccacagcagcatcattcataatagccaaagaatggaaacaaccccaatgtccatcagcttgaaaatgaataaacaaaatggtcaaaatgaggagaccacaccttgaagagacacattaaagcagcacatacatccagttgctccaaagacctgaaaggagaggtctgggggctggaagacattgtgcaggagagagaatcacactgaagcctaggaaagttgaagccagaacattctagaggaaggccaatcagtagcatctccaggcagagaaatacacctagacaaagacttagaggcaggaaagcctactgaacgtgcagaggacaggaagaagagacgctcaaggaaggagcatgagggatgaggagtcatggtaggtggacaataccccaaaggctcctggttcaggactggggcaaactttggacatttggttgacagcagatccaagggttcgctacccacctgcctcatggtagaaaagcggatgtgagatctgtttgcctaactttagccccatcattcttcagaccacagtactggcttctaactttctcagaaaaggaggcaagtattggtcccttggccagaccagcagaacctatgcacatgacccagtattttcagtgagataaacaccttcccctggaaaggaaatcccactcaggggccctcctcacctgccccagcctaccctgcatggctgcatggcttaggactgccatgtggcctctgcaggtcctggcattctaggtctcattgtttcactccctaacagacctcagaaaggagaacctctaactcccagtggcatttagcttccctctttaaacatctgggtcacagatatgctcagttaattaatgttcttagtgctgctcatctgcctgctggataatagattgattcataatttcagtaagcagctgtgtatatctttccctgaacataaaggcagcttgctgtcattcatcactttgcatttggagaatttaaatatattcaggcagacattgtttagggacggggagggagggcttctgattttcttaccattttgcttctaacaatgactttgatttggaactaattggggtttaaagcacacgttaaccacatctctctcaagggcacttaataaactccctgtcccttgttcaaggagaccagccaggccctccttttgggataagagccaagagcttctgagtacctttcaccaagaaatgagaaccccatgcagagaatcttatctgccagaaaagagccactcctgtccctgagcagagctacttatttcattcctgggcagaatatgctcaagctttctggaggaggtggggttctcctggcaatctgggagggggctcttctgctgctcagctgctgggccatggcagccaaccatgaggtattcggtgaccaaaagaaagcggccagcacccagccaggtgaccagatgtcttcatgcctcagtttcctcatctataaaatgtaaagaataataaaacatatcttgcagagttgttgggaaaattgcattatttattctctttacaatggttagaaatgatgcagagtatttttttttaatttattaggcaacagctgtgtagatgtggctgccttttcaaatgatgccattcaccacagttatgtgctcaaccccaaacacgttttgagcacttggtctgtgatttgctcctagtaaggaaggaaattaattaggcacagcccctccctctcaggagtgtgaaagatggatgaatgaatgcattttttttattttggaatatgattcttaaacaatataattttccttccccaggaaagtaaaggcagcagaggcgaggctactagcctagtacaggccctgttgtgggaaggttgccgggcaacaccttccctgtatcagtcaggaattgctgcataacaactaccccaaaacgtagtggcttaaaacaatatgcattttttattgctcacgagtctacaggtcagctggatggttctctgatctggactaggcttggctgatctaggctggactcattcgtgcatctcctatcagcagctggcaggttggctgagggctccctgatccaggttggcctcatccatttggttaactggtggttaactagcaattggttgggccacatgactctcatcctcaaacaggccagcctgggcttactgttccaagagactgaaaggattcatacaaggctaaaagtctagtctaggaacaggcacagcctcacttctgctccattccattggccaaagcaagtcacagggccaaccaacattcaagggatgggggaacagactccatttcttgatggaaattgcttcaaagccatcttgccatgggtgtatagaaggaatagcggaggatgtggtcagttttgcaacctaccacaatcatccagcatttgttgttgtacatagagcataaagcaagtactaggattatgttgcccacttgcagtatttttgctctgctctttcattattataaattctgttgcaataaataccctacccatgaattttttgtttgcaattctgattatttccttctgatagagtgtattagtccagtcttatgctgttaataaaaacatacccaagactgggtaatttataaagaaaaagaggttttaatggactcatagttctacatggctgaggaggcctcgcaatcatgttggaaggcgagggaggagcaaagggatgccttatggggtggcagggaagagagcatgtgcaggggaactgtcctttataaaaccagcagatctcatgagacttattcattatcatgagaacagcatgggaaaaacctcccttcatgaatcaattacctcccaccggtccctcccacaacacatgaggattatgggagctacaattcaagatgagatttgggtggggacagagccaaaccatatcatggagttctacaaatggattctttttaatttctattttgattcagaggagtacatatataggtttttaacaagggtgtattgcatgatgctgaggtttggggtatgcttgaaatcgtcacccaggtagtaagcataatacccaataggtagtttttcaactcttgccttcctttctccctccctccttttggcattcccagtgtctgtaatttccatctttatgtccatgagtacccaatatttagctcccactcacaagtgagaacatacagtgtttggtcttctgattctgcattaattctcttagaataatggcctccagctgcatccatgttgctacaaaagacatgatgctgttctttttcatggctgtattgtattccatggtgtataggtaccacattttcttcatcaaattcaccatttatgggcacgtgggttgattgcatacctttgctattgtgaatagtgctgcaatgaacgtgtaagtgcatgtgtctttttggtagaatgatgtcttttcctttgggtagatacccagtaataggattgcaggtcaaacagtagttctacttttagttctttgataagtctccaaacttctttccacagtggatgaactaatttaccttcccaccaacagtgtataagcatgccttcttctctgcagcctcatcaacctctgttattttttgactttttaatgatagccattcttgctggtgtgagatggtatctcattgtggttttgatttgcatgtgtctgatgattagtgatgatgagcattttttcacatgtttgttggccacttgtatgtcttctagtgagagtgtctgttcatgtcctttgcgcataaaagtggattaattgaatcaaaggccatgaacattttaaaagaacgaagtatatatttagaaatctcctttttgaaaggttgtagtaatctaccctccctccagcccaatagtgagagggcccatcttagacttaggtcaccaaaatgtggtgaataatctctgattttagtttcagtttttgggtttttttttttgtttttttggtttttgtttgttttttgagacagagcctcactctgttgcccaggctggagtgcagtggcacaatctctgctcactgcaacctccgcacccccaggttcaagcaattctcctgcctcagcctcctgaatagcttggattatagttgctcaccaccacacccagctgatttttgtagttttagaagagacggagtttggccatgttggtcaggctggtctcgaactcctggcttcaagtgatctgcctgcctcagcctcccaaagtgctgggatcacgggcatgagccactgagcctggcctaatctcttttgtaaaatgtggtatcttattattttagatttttgtttcttttcatacctatgaggttgagtactgtttaatgtctgtttcttcagtgaatggcttctttgagccttttgcagcagggtagatttagtcaatccccctttgtaagtggggaggaaatggagactcaggttacttgttcaaggtggcccagccagctgaaagtagagccatttagaaattagacatccagcttcttcatctattccttctccccgatgttgctgaacagaagactaggtcctaaaacattgactgaggatatgcttagataaaagatcagggccgggcgccgtggctcatgcctgtaatcccagcactttgagaagccgaggtgggcagatcacgaggtcaggagttcgagaccagcctgaccaacatgatgaaactccatctctactaaaaatacaaaaattagccgtgtgtggtggtgcgcgcctgtaatcccacgtactcaggaggctgaggcaagagaattgcttgaacctgggaagcggaggttgcagtgagctgagatcgtgccattgcactccagacaggacaacagagtgagactccatctcaaagaaaaaaggaaaaaagatcagagagttgccctggggactctgtatccaggctcagaagcctgggtggctttctggaacagggctgtcctgtgaggtgagcatatggcctgagtgacaggctgggatggtggccaggactgcagtattgacaaacagcaggagtaaagccgagagacctgagccctgcttcctcccatgtctcactcctgcctcccacttccattcccctgctgctctggtctctcgacagcttgcccgctacaccaaggaaggcttcctgcacttgggtgccctggggaccaccacactcctccctgacacccgctgcctggtggacaactccaagagtcggctgccccagctcctggactgcgacaaggtcaagagcagcctgtacaagcgctggaacttcatccaggtgagtgctgtatggacagagccagcacccagagtagctgcaagaggctgcagaccacagaggggaatcctgcttccccaggggtccccagcaaagagcgaccccgaacccaggtctccctgccccgggctgggcttgtggacccaaagcacttcctgggggcagctgtggagtttctgcatggagtagcatttctgattcctatgtcagtgctaggctggttgagctctgatcaatcctgagataggagtgaggggggacttccttgaaatccactaagtacccacagccagtggggttgagaccatcagaccaagaatatcccaggaaactcaacatcctgaccccctcctgaccccatcccccaccccccaccaacgctcctcacctgattcagatactccaactgggtgaagcttatttaggttctgacttcagagtccccagaggaggtcctcatgcttccctgccccagtctcatgcaaagaattttggtggaattgattctctgcaagaagctatgtgccaggcgccatgatagttaagcctctctctctctttctttctcctattgcactctctctctctccctctctctccctctctccctctgtctccctctctctgcctctctctccctttctctctttctcttctctgtcttgtctctcctctatctcctgtcttctctctgttcctctcctctcttctcttttttctctctcccctttatctttctctttttctctctctcctctctatcttctctcttctctcttctctctcttccctctttttctacccctcctccctttctttgtcttctctttgtctctttgtctcgttctctctcctgtctctttctcttctgtctctatcttctctctttctcctctcttccctctttttctctctctcctctttctgtcttctctttgcctctttctctgtctctctctttctcttctctttttctttttctctttgtcattttctctctcctgtctctctttctcctctctctatatctctcgctgtctctctctcctctctctcttctcctctcttctcgattttgccccctcccagaatggagccatcatgaacaagggcacgggacgctgcctggaggtggagaaccggggcctggctggcatcgacctcatcctccgcagctgcacaggtcagaggtggaccattaagaactccatcaagtagagggagggagctggggcactggagcctggcccccaggacatggctgctccccccaacatctggaccagctgccctggcggagagacagcaaggggccggcaggtgctcgatgggccccccagggcttctccagggcagcacagggaccccggatgaagactctgtcccccctcaggcattcagctgcccacaagtttcctgcaccctggaaaagccccccacccttcctctgggaaactgacagctgtcttccacagcctctgatgtggacctggtactgaggagcaagactgtccagttctcctccacatctcccatcccagaatcaggatctgggactggcagggtcccctcctgtgtctcatctcttgcagcagcagctgctgaactccagccatcaacacggtgggaggcagcgggggcttcagccatgtcctagctccccgccctaaaaggaggcagtgaggaccaggcactatttcctccgaggttacttctacccagatgacacctgcctgttcacgccccaaggcagctactgcccctaacccttcccaccagggtagctttgggcactgcagctctggacttttctggcccctcctgagatgacctgatggagctgatgctttctctcctaatccctgggcactaggctcttatcagtgtgcttgggccagctctcctgcctgtgtctagaggaagccagagacagaaataggctaagcctgcagtaggatctcagccacaagggccccgcaggatggagctgggtcaaggaccagggagccctgactcccagaggctgccaccggggagaagcagcggtcctccatccagaacctaagggctgaagcaaaggctgccaggacccttgaagatgcttttggctcacctcatttcaccccacgctctgctggctggcagaggagaaggcagtcgtttcctctctgaagagtatttttttcgattgccctctggttagggtgcacatataaatcagagttaatatatgaacgcgtgtgcatgcacaagtgtgtgtgtgcctgcgtgctgtgcgtggcagggtgtgtgtgtgtgtgtctggctgtgcgttccggagtgtgtgacgatgctgacctagctgtgtggccttgggcttgctgcttcattactcacctggatggggacgagggatgagaagggtgtgggtttggccccatgtcactggccggaaggatgtgtctcagccctgccctgtggggtgcccccgatgggaggctgtcccatctcccagtccccatctctttttccccacactgtccctggccaagccctgcccagagctgaaccctgtagctgcccccttgccctgtgtgggattcgcagtgtctcatttggtgacgtcttactggtgatcatctcctcaccccatctcccaccttgtggaataaatacatgttagcacttccca

SEQ ID NO: 2462 - DNA, 370701 bp, Homo sapiens
atttccttctcgacccacttgtttgtatacaaccacgcccggcaggatgaccaccagatgaccggccgcagcaatgcctccactcagtcccagttgggcaaagtttcactccactgcggcgacgtgaacaagaatcacggcttccttatcgtgagttatgaatgatttaagccaagtttacaggacacacaaagcgagggacgagtgagtgacgggaggtgctaagtgacagcgttttaaagttagctttaattgatatgccctaattaaaatgaaaaacagaattcaccctgccccacgggataactgtcggggcaataattaaaaaaaaaaaaatcacccaagactaagcctcaacctcccccttaccacttgcaaatacagtctgcagaaaagcagcctcgggtccccactcgggggtccctcgcggggtgcgtcatatgggctctcccctctgcgacccgctatttccctgctagacccccagcgcccagcggattccaaggctgcgctcccgccggctggtcccgggaggtagaaagtaggcagaggggcgtggcgtccctgtcgcccccacatgccagccctcctccaacgcctgacaccaccacaagccacggctgggaacactgggggcctcccaacccggcgcggggcgcacggccgcaggctggcgaggaggcaagcgagctcaaggggagacctttccttccacccccagccctagccccagccacagccgtgggggcggcttcccgcaacctcgggcggccgcccgtcgagggcgcgcgcgccgtttctgcctctgggtctcggtgtcccttggccccttcctccccctccccccggtctccggcgcccagcgcccagaccagtccccgccctccagcaggacactcttccctccttccttccttcctccgctccctccctccatctcgcttcccagcacccgggactcggaggcggcccccgaactcgctggccgacgccccgcgccgcgccccgaccccgcggggacccgactcaccacccgcgcccgccgcttggtactcacccgcctgccggtgcgctgccccgccgtcgccgccgggactcggtctctaagggctcctggagacggctccgacctctcctcctcctcctcctcttgctcctccgggcgccggctccgcctcgctggggtgggcggggcggcggcggccccgggctccttcctccgcgccgggccctgcctcccgcccggacgccctggctgtgctgtcccgggccggggagcccgcgttgtggccccgcaggaggaggggcgaggcctggcctgtggaagctcggtggacgtctggtcgtctttggccatcccccttcctctaattctcatggaggacctgaagttctaggacttgagggcccccactctacgacccgcccccgcgcggggccgccctgactcctcgcaagtttccttcgcgtgcgaacgcctcgcttgcccctgtgccagcggtccccagggctgtgaggatgagcgctgccaaacccctacacgaaagtttggttctgttccagaaactatggaggaaaacacgcatagtaacatttaaagggccctggggccacggagagaagtttcccagaaagtggaggtataactgcggattatagaatttgtagtacatccacccaccatgagcttcccgtccatctgccccgaccccctgaaatttgtttccgaatgtccagtacctggcagagttctgcctaatgaattaatgggatttggttggtcttttctggaagggttcaaggtcgggtaaatggaggagccatttccgcttccacagattttgtactattcctttggccattcgacagacattaccaagcacccgctgtgtaccaactgcgatgctaaaggtgatgggagaggtacaaagatgaatcagacaaggggcttgccttcttggagtccagaaagagtaaagaagctggatgttcagaaaaccactcagcggacttctagagtattcctaggtagccgctttcttgtttgacagggtggagagaaaagaggtgaggccaaagtaggtcacttagaaccagtgtgggcagagtccacacttgaaatggagtctgaaagcattggtgagggatgtctgtgtattgagtttcaccaactgaggacaagtgggccctggggaatctgggaactagggactgcagtcagggcattatattccctcttgctttccttctgacccctaagcaagtttcaggtttagtgaaatcatttgcacatgtagaagaggtgtcacaggtagagtaggtgtatgaatgcatgccttgccccaggagtgtggtcttagcaagctgcggatggcggtggtttgtgggatgcaagccacagactgccagaggggtctttatttcctgttctgttcagcattaggaaatgcttgactgattcacaagtactaacagttcaaatgatacacctgaaacagaacagcttgacaccacagggactgagagggtggcatactggagtttgtattttttggccacagaccacagaatagactcctctaagctatgctactaattttccttcctgggacactttatagtttaataagtgctttcatgtacttactcttacttttctctcattagtctcttgaaaaaacctggaagctggaacaccacatattgccaccagtaacttaagcggcttgtcgaaggtttttctagttgagtgctgttcaaagtgtggttcatggaatagtgacagtctgcaaaccgttacccatctacaaagggatgagcatagaaattgaagatgagcatgtagaaacttacagcaatttgacagagtaattttatgtctgttaaatcgtttaaaatgcagctttgtattttatgtctatttcatttttcttttatgtggaaaggcatcagcctgcaacagattgaaaataaaatatcacagatagtttgagaagcactgatcgagatagtattaggttagtacagaagttattaccgcaattacttttgcatcaacctaatagcaaggcaggaatgataagagctaatacttaaccagcactttctgcgtagcagatgttgctttaagtgctttacatatattaaaccttttaatcctcctaacaacctaaggacgtagtcacaggaaggttaggtcttacagagcaaaactggcagagccaggattcaaaccttggctggctgacccaatactttgtgcttttatcgatgcccttgatccagtgtcctttctactctgctgatgtttcccaaacttaaaggattcacattccattttcatacaactgtaattcctattttttatttatatttcttattgactcacttttgttattttgtacatatattaccctggcagttagtaactccaagcatgtaatcatgggtttgaaaagcaagcatcaatcttctactctagtttatattaaagtacatgcctaattccagcacttgctgccagtgcttggccataccccctccagtccttttccagtttcgtgcacactggttccaggcgtgctttcattccctcctgccagcacccacatcatattctcagagtaccagctccagctgcaggatttgctttgcctgggcacagggcagctggaaatgtgtagaattaatgtcctccacctccatccctagcctttagccagtgtggaggaataaatatttcagctcctttgctcatatttgtgataactgggtggatctacattgtctacagagttccctatgctgttgggccaaattccatgagcctgtttggtttcttatttttttttttctttctctagccttcttttaacttttttttttccttttttttatgttcttgctataaaatagttaatgaactattttctaccccctcacccagtggcattcaaaacaaataaatcagtttcctatgaaagagtgtcagtggagtggagtgaaatttatgctttatgagataaggtctttgggattaagtcctggctttgccgttaacaagctgtgtaaatttgagacagtcacttaactttgctgggtctctgcttgtctttaaaataaagggattgtaagagaatggctctaaagtcccaattctatggaaattagattttagttttaaaaagtggctttcttggccatttaatccctcacgagacaagcaagagaagtggttttataattcaggacagttgtttttttttaacgaattgcaattcatatgtcaatctactgtgaatttctatttaatattcaataacaacactgtagctaaaggatgagtcagaaagagatggtgaagaaatgaaaaagtgaggcaaatcagtcagtctctcggtgatcaggtctccacagacttcagaacaattttttattttatttttttagagatggagatctcacttcagaacaacatttttgggatatcagctttgctccctgtggattttattggtcctattgcacatggcttcactctttgtctggacctgccctggaaggcagggagagctccctccttttgagtaggtcacctgggaataagtgtcttccaaactggtttttctgctcagtcggagactgccatatttccatgtagaagttaggtcagggagaagcacccacagtcttggaaatccccaagtaacctgttgaaacgtgtattgccataggcaggagctatgaccaaaactgtggctacagatcagaaggcaatttagcatagttccacacttacatgggtggaaaccttcagaggcctgggtgggagtgacccaaaatggaggcacccatgcaagttagttgattactaactcaatatgagctctctggcttattactgcaataggccctctagctctagggagtggaagtccccagatactgttgtctagaaataaaacatatgggctcaagagttaatgaatttcctgtcattggaggagttcaagcagtggtctcttagaaagtagagatttagaggatatcagcgatgcaacccaaatgcccatcacaagagataagatacctccctctaaagcactctgaaaaaaagatatagatctaaatatgttcacatgaaaagatgccctcaatgcattcttgaacatagatagcagattataaaccatcatgtggagacgcttccattcatgtataaaaaagcatacatacacacgaatctcttctgtaagtgtatctgcaatgatgtttgtcaaaatagtaacagtgactttctcagggtggtgagatttcaggtaacctaccttttttatactgcatgaattttttcacagtgaatgtgtagcttttctataaatcatgtctttttgcatattgtaaatgtatctttctttcataatataaaaagacaaaaggcattgtgcagaccaggagttggcaaattatggccagaggaccaaaggaccacatcttttgtaaataaagtttaattggaacacaaccacactcattcatttccctgttgtctacggttgcttttgtttttacaaaggttaagagctgaatagctgtaacagagcttatggcttgcaaagcctaaagtgttttatctgcccctttaggaaagaagtgtagcaacctctggtgtagacaattggactggaaaacgttttcagcatggcaaattgcaacctagattttactttttcagatttcaatttatctgaatttctattaaaaatatgtataggctgtatattttaaagtatatcccagttctgagtagtgattataacagagcaaagtgacagtattagtatttgggtagctaaggtctgtatattctccttcttcttcctcttccttattcttttcctcctcctcttcctcttccttctcattctcctgataagatcatcatcttattctacagtttgccctcagatgctgttccacttgagaaagtaccaggaggagaactgaggtttctctttcctggcttggatctctccaagacagaataattgaggaagtccttgacaaaataaattgtcctggcagaagagaggcaaagttctaaagaatagacgtagacctggaggagaaaaaacagggacgctgaaggagcccagctgaggaggaggggagggtgtccagctccagaggaaaggctgggaattagatggagtaaatctctctcttttccccttccctcatcacacccttcccacacgatccatctagcctccagatatacagaggaggtttggggatttttctccttcacagtcagcagtatccagcatcaaagctcccatttgcagaactcacatgagcaaggctaactaatggcagtctgagcaatgccaggcccttgctcatttccagaactcagccagaaaagctggatattggccttgatatggaatgtactcagataccaagtaattaaatgattcagcagaaacacgctctttgtcagccactcaccttagaccttccctgaagaaaacataggcccctgcggtgtcagaaagaaaagcagcctgtgatatgattagattattggttcacctatagcctatgctattgggttttgactcctacacaggcaactctgtggacctgtaagctaagttaaaaagggcatggaaagtatttactctggcatgttgataacaaacctgttaatttcatctagctttagatactggtgagaatggaaagtgccaagcctgcaacctcagtgactccaatttacacggttcccaaaataaataaaatattttttcagaatatgggggaatctcagaaaatgtaataaaaatgctattttctttcagtgttccagtattacatattttagagtactgaaatcctggcattattgttggtattattcatttatctcagtattttttgagaataaaaatatgaacgatttctgtcttgagactacccagagaattacataccacattaaaattttaaaggtaatagaagtgcattagtttaaagagtgttctgaccacattccttgcctgtttaaatcctccacaggtgtcttattgttattttatttcctatttcctggattactagggaggttgagcacattttcttctatttattagtcatctgcagtcccaataccaatttgggcatggatctacttgcagaggtctttgatagattgtgctggatatttctgtattcctataaatatccttgagctttattctggaatatagttaagttatttggaaacagatttgtcctttcagttctgcttttaagatttgtttagcaggattggagcagttaccactctaggttttttgcctctattgaagcaaaaggggattgtgtgtctattcaatgctccatagatcttgagatttttttcaacctggatggtggaaggagggactcttcttggccctgtatgagcatcaggtactgttccctctaataccttgcacatggttcttctctcagccttgggtagttacttcacctgcaagagcccatcatcactcaccatactcatgctagtttctggattttctttctgtacactctcttctctctggttctctgtcttaggaattctagttgccttaatctcttcttgtctccatcaccttaactcaaggagtccaccagattcttcctgaattccccctctctgctgtggcctggaaactccctcaggggagggtgctgggggagtggtaggatacacctcatctgtttcccatctctcagggatcactgtcctcttgtcacctgatgcacagtgttttgcaaactgtggtttcatttattttacctgtttttaggttgctacgggtaggacggcaaaactagttctttactccatcttgactaaaagtagaagttgcccctgtcactctaaaacatgtgttattcttctttttaacttagtgttatctaatattattgcctgcccccctcatcatgctgtaagctccatgagggaaagtactatgtctgttttgttttctgttgcctccccagcacctataacattgcctgacacatagtagtactcattaaatattgaatgactgcatgaaagctagaccaggatggagatcatgagaaaacttgaatgatgaacaggaaaattgaacagattttgctgagagtggaggctcctattctgaaaccagaagaatgtaggccaagttctattcaattgcaaagtgaggatcttgagcactgcaatgctggtgactttactcaagctagtctgtctgtaaatctgccaaagctcttggcagattaggtcacatttttggaatctgcttggaattcaggaacatggcggtcataatgaatcatgattttgacccttcctcttaatctgattggctctaagcccttaacaaatattaattatgtctcacaatggaattgccaccctgacctcttttcttagactgctaacactggatactgcagtgttcagccctcctatcccataataacgtgcctactcctccttcccaaaaaaggaaaggatagggtactgtttctatcaacatccttaaattatttagtcagtatcctaaagatggacttgacaattgaacaattttcttaaaaacctcacttggtaattgcaaaagcctgtctactgttttttctgactctagtctccaagacagtcctctgaggtacaggaaaaaattttagaaatcacagctacatttaatttttgtcttttccttttgttattatggtaagtcaggtatataatttacaaagacacatatattaggactacatgctcgaagtccttaccgatgaagtatacaataaaaaatgtttggacatcacagatctcatctctgaattccctgtagttaaggctggcttactcttcctgtgaggcacctctaattgtgcctctttcttctgcaaaacaaacaaaacctcaacacctctgaggcttaagtataagaaaacttttgcagcaagctgaagttgaaaagaagggagtttttctatgtagattcaaaatccagtctgcaattgtttgttagtccccacatttatgtagcacattgtaattgtgtactgcactgaatatggctacagggcttccgatttcagaagaacatgagtctgctctcagccaagatttgtatatatttagttctctgtgaagcctctcaggtccactaaattatggacccagaacaagtacgaggccatgaatatttcctaggtgccatgttagcagactgaattgctaaagagattatagaaataacaaactttaaatatatgaagttatttaccatcaaagtagtttacagaagtagcaatagagtaaaaatgaatctacaatacactgtgtggggtgtgtctgtgtgtaggggttggggcagggaacaccaaagtgccagacacatgaatgaagaagatattttggaagaggaacctttggccctggcctccccatctgacaccaagtagactagaaatgaactgctcagttgagcctttactgaattcctaacacacacacacacatgcacatgcaacacacactcatgaacaaagtaaaaaggttattttacttctgtaagttttgggatagcagacctgagagttgtacacattatctgaatacctggctccaactctacctgcagcaggactacccctgggtttttcagtaagccagtccattgctttcagtgtgctcaggctagcacaagtggagtttctgtcctttgcatccaaaagaattgggaataatgcaatagcactctctcttttaactcaggtgcaaaagcttcagctaatcatttttctcagttggtgacttatgctcatttttgatctgtgcaatggccatctcttatttgattgattgattgatggttttcttttttttttttttttttcaaggcttagatctgctatttctctcccaaggatgtttatgctgatggttttcattcatatcctttttatgctgttcctaccccattcctttcctgctcatagacattctaagtctaatgtatatctaatttttatatacatctttttatttgcatgtgtccttacaaaacatataaaatttatttttgtgttattttaatggtactgtatactctatgtaggaagaatacttatgaattcttcaaattaaatgtcatggtggtctacaattttcttcctaagttatagatttcttctctaagaaatatacatcctaatagtgtctatttttcttgacaattgttttgtcttcttggcattttaaaaaagaacttttattctctgaatacctacttcttcagccccactgattgattccacatatatactttattttttaatagtaaatattctggttatatgggtatggtatcttctcatctctttgaaagtattaattatatattggacttttttcctgttctttctattgtctttattgtttcttttgcatttcctttcttctgtgtgttttaaaaccttctttttatctgtgtctttcatgttagcagctttgcttaaatgttgactgattcttggctgattctaattggaacccctttgtgtgtccagatcttacggagtggtgacaataggtaatagagcagagatttggctattttgtcttcagaactctattggtttctacagatttcttctctagggctagtcagatacccccaaaaggagatcagataccccacttggggttaaggggaggatttaagcctggctgccagccttccaggagtctggatgtctcatcatggtttttgcttgtttttaaggcagatattcacttaatcttcttgttttcagtacagtactctgtattctactgtttgatcattcacttattcattaaatatgtattgagtgtccccttaatactttgtgccaggaacagttctaggtgcttggggatacactagcaatcaaaacagatgaaactccctgtcctcatggagcttacattctaataggatacatgtccagtgttctgccagggttaagagagggatgagtggctggctgcaaaaggaagtagcagaaatctggagttccaaggggccctcataaagactttcaaccagtcttcctgctatggtttggatatttgatccttccaaacctcatgttgaaattggatcctcaatgttggaggtggggtctaatgggaggtgtttggatcatgggggtggattcctcatgaatagattaataccctccttgggaatgagtaagttccctccctattagttcccatgagacctggttgttaaaaagagcctggcacctcccccaacttctcttgcctcctctctcgttatggggtctctgtattcagcctgaggccctcaccagaagcagatccccaatcttgaaccttccagtcatcagaattgtgagcaactaaaccttttttctttataaattacccagccccaggtattcctttatagcaacataaaacagactaagacacctcctgttttcagcttcagcctacattcctattttcaaaagtgcctgatgcttctaatctctgagcctttctgggttttagtggaataagctagcttgcttttgttggcattccccctaacagactgaattactaaagagacatttagtaattcagattactaaatattctagatatttggatttcagttttccttgttctgctaagccagttgccttgccacttggatgttcatctactttccatctcttgtctgctctggtcctctctcattttcctccttctatagacttatacctttttgtttttcatttaatgttattttaatgggatttttttttaaaaggaggaatagagataatcctgtgtttggtcaactgtgtttaaccatgtgccagcaactttctatataggcacaaagttatttgcttgacgggtaaaaagcgggggcagcctgggtaatggtagtatcagattctgatttcttatagtcacatctttgtcaagatgtattgtctgaatttaggatgagatcacagaaaggtacataagcatcaatgtttctaggcctcccagtattatggctcattttcttcctttctctctctcattgacttgctttctctttgttcttagaacatgttttatttaactttcttctccctcaaattacatttttattttctcttctattactgactttcacgttatctcttattttaaatcaatgtagagagaatgtttttgactaaatttctagtcattgcatgcatgtattgtgatttacagaataaaagagtgttttttaaagaattgaaatgataggaacactagcggcaaacattaaacgcttactgtgtgcaaggcactatcctaagagctttatacgcattgccttatgaaatctctattatcaccttatgaggtatcatttccactttatggatgagatatcaagtcttactaccttattttataaaatctaagctaagagagagtaaaaacttgctaaaattcttatagcaaatgagtgaaattataaaaatattcatgaaatgaacatgttttatttattattagaattatatgtattcctcattaggagtttgaagtggggtttggtaccccaaacctttaaggctccctgctgagggagccacttatctaaagatcaatagctaattacaagacaaaaaaccagatgtatttgatagaatggcagagattgtcttgttagctgtgctggagggttgagtccggaagccaacatggagttttctgctcccttgagtggggactggctgagtctagaatggttaggcctgcacagcaggttctaatccactgacctaaccagctgtgcagtagagaaaggctggcttgcctcacccacaccactgcagaccagaaagctgggcagagagcacaagtattgctaggcctccctcaaggagacagcttgtgtctaggtgagattctcataggggaacaggatggggaaatgggcccactgcacatgggtgcatgtagtaggagaggacacaggacacagacaaggcaggcatcaggaagtgatccagtgtgagccaggtgccatccactgggattggcatcctcttgcttcctccttggggatctgtgagttggtctctagaagtatgggcagaaatgttctttctcctagaagctgggtggaagcgttcttttttctatgggttaaggtggaagtgtgagaagagaaaataggttcccttcttaacatttctatttagataaaaatttaaacattgcttatggctagttctgtattctaaattcaaaacaactttttttttttttactattgaattatctgaattattttttctgtttatttatatgtttatttattttttgagatggaatcttgctccgtcaccaggctggagtgcagtggcgtgatcttggctcactgcgaccttggctaactgcaacctctgcctcctgggttcaagcagttcccctgcctcagcctcccgagcagctggaattacaggcacgcaccaccacgcctggctaattttttgtattttagtagagacagggtttcaccgtgtttgccaggatggtttcaatctcctgaccttgttatccacctgcctcagcctcccaaagtgctgggattacaggcgtgagccaatgcgcacagcctatttttttctgtttataatgcattcagatgtttttttcttctattttatcttttaaatcgatgctgattgcaacccactcagggttacttgacccactaatgagtcaggacccttaatttgaaaacactcatctaggagacttgttgacataattttggagcaaaaagctgttcttatttgtaaaacatataagtggccctttgttattacatagagcaagaattagggcctagattagacaggactggtggagacaagatgcacagtttagtaaaactgcaaaggatgataaaatttaaaagatactcttcttgggtagagagattattttgaagttaactgagtcttattttcctgtgagtggtatgaaggtagtgccaaagatgcgatgttagggaaagacaaagactctgaggagaattgaagggaacactttgatcttaatggaagcaggtccagtactgaggttcaaatcagtgacagctaaggaggctttgactgttaccagggattggtctatggataccaggagcagcaatgtccaacattgggttttgagtagtactcttgcagtgcatcataattaccccaagatatcctcaagtctttagtgaggctggttaatcactacagcccagcatcaggctagtgactaagggaaggaaaggaaaagttgagtctgtagttgagataccaatacagtgtaccagtacaagacaagacaagacagtgcaagtcaagacagtagctaatagcctatagcagcagttatgagatggtaagaagagacaagcaaacctggatggggaagctatcttgaatgcaaggtggcaagtgctaacaaaagatgtgtatctttatcaggaagcctacgtcttcttcaggaatccttttttggaaggcagtacttttttagaagggtggttggatttcttgctgtcacagaggtttagggacttgatttatttatttaattatttctagattttaaagaaattgactgtgccctaaatcttgttttccccactagatcctgctctgtgccccagcagcctgaccagcgtggactgcaccaatgggctcccttgtcctctagcttctggcagggtttggccaatgggaggaaatcaaagaataagagattgggatatttattgccctaatttcttcccagctgggtgtcagtgggttcactgcatctccccagtgaaagccatagctcctatcagatggccgtctccacacagctaaactccccctcttctggtaacccttacctcttcaggcctagggtggtaatggttccccttcttgctagcttctagatactacgttattatttgctggtttccctgaacactgtccaatctttgtaagtagccactattaaactttcatcaaattaatgatctgtttcctgccagatagtactgagattagactcaggaaagagaggtctcctctatcatggctctttagcgtggaccccatgccttacagagcccactaatcaagatgaatgagtggagaaacctttggaaatgtcttaaggaatgcacaaggacctctttcacttgaatctgatgctcagtcctggcttagtacaacctgcattcataaacatgtgctttcatgactaacactgctcacgctttaggggaaatgtttttccacatctctttcctgtgtcctcaatacaaaaggccagtatgtctggatgttgtgagggtgtatggctcatgctactgccaatgttggagatgggcactgttttagcatgtggagatttgagtgatagaagcacttaggatgagaaaaaagacagtttgtcaaatcgtttctctcattaatatagtgaacttctgtaggaagtgcaaataacttaagctcttttgatacaacaaagagggccagaaggtgggaaataaactccacaaaacttcaggagcctgccattgtagtgaaatttctaggaactggagtgtgctggggtacccctcacagacaggacaagttgccacaaatggcaccttataccgctaagacaggggcaccacgtatggaagcctctttggatttttttttttttttttaatggcgataagttctcactatgttgcccgggctgatcttgaactcctggcttcaagcgatcctcccaccttggcctcccaaagtgctggaattacaggcatgagccactcggccttttttattttattttttttgtcaccagcaaagcattaaaatattttttaattgaaatttttattgagttaaaaattttttatcttatagcacacaattgtgagaaataatataaaaagatctcatgtgctcttttcctggttttccccagtggtgacttttgcaaagctgtagtataatattatgaccaggacattgatgctaatatagtcaagatataaaacatttacatcatcacaagtattcgtaatgtttctttttataatcacactcccttccaccatgtcctgaaaccctggcaatcagtaatctgttcttcatttctaaaattttgtcacttcaaaagttgttatgaaaaaggaataatacattatgtaacctttgggaaacaggctttttttttcactctacacaattctctggagatttatccaagttgttgtgtttatcaacagttgattccttttttattgttgagtagtattccatgggatggatgcactaaagtttgtttaaccattcactcactgaatgatatatggactatttctgttttttgactgttatcaacagagctgccataaacatctgtgtacaggtttttgtatgaacgtaagtcttaatttctctgggacaaatgtatctgagtacgttactgggtatggtagttgcatgttgagtttaaaagaaattgccaactgtttttcagcattgctgaaacattttacattcccatcagtaatttgtggatgatatagtttctctgcatcctcatcagcatgtgttgttgtcattattttttattttagccattttgatagaagtgtaatagtatctcatcatgttttaaatttgcaattccctaacaatgttgaacatcttcttatgtgcattttctatctgtgtacctctggtgaaatgccaacaaggatttttaataaaccatgtgttaaaagaatgtagggggtagtagtagtagtattcataatagtagtaatattgttcatagcatgatttctatctctctaccttaaaaaaaaaaaaaacccctgtatataacactctgtgctaggcaccaggggtacaaaggtaaattgaacagatgtggctgttttcctcatggaacttataatcttgaagtgggtgaggagttagaaaacttagaaaaaataaacacacaaaagtatataaaacaaacacaaaaagtatgtgccctgaaagaaaaaaacaaccaaacaaaaaaaccaaatgtcataaaaaaaagaataatggagactcaatttatattgagagtcaagaattttcaaattttacctgaaaaatggggaggtaatattcaagtgcagtgggagcaagaggaactcagcccaagagagcagcacgtgtgaagatcctgaggcaggaaagagctgaggatgttgtagaaacccaaagaagggtagtgtagctggaatgtagagtagcagtggaggagtgagatgaggtgagtttagcagtatgggtagggcccagaccagaaacagagaaattgtattagtccaagcaagagatggtaccaggggatggacagagaagtggatagttctgaggtgtattttggagatagagttgacaagacatgatgagaagctgtgcaggagaggagggagaggaagatggaagtatcaagaatgactcccaggttccttgattgaaaaacctggttgatggaggtgactttagcaagatggtggaaacaagaggaggacttggtttgtatggagaggtcggcagtggataacagtcctatttttaggtgaacataaattctgaagcctgatgcatgtctacgaaacgaataaaccctatttaattgcatagtacaaacaagagtcctacagctgaggctgaaatagctgaggctgaaagagacaactcaagttcaacatacatcacccttccctttgtttttaaaattgctcatgaatattttttaaaagtattggctgggtgtccaccaggtggcaacatttctttaaaaaaaagcccagatttagaagccataccttcttagctacatcaaagtggattcttgagggccacacaaccagagtctagtcaaaatcactgaaagtgcagcccaccctgctgagttcttctcttaatatgcataggtggaggcagttttatgagcaagatccttctgtggcctcttacaagaaggctcatgtgtgtcagtgtgtacctatgtgcatgtactatctaggacttatatcatatcatgaaaagccctttaatcctaaaggtacttagtgcaagcaactgagtaacattggaagccttagataacctctctgagcctctttcttcatctgtagaatgttgtatacgtattagtaccaacttctttggggtgtgagtgtgaacttagataatgcatgcctataatgtatctagcacagtcctgggacaaagtaagcacttaatacatggtagctcttattattatttccacagtgacccttatccccactttccctgctccaagactctattctttgccagccttagttgtgggcagcctgccaggcatgatctaatcagtgaagcacatgagtcatgagaggatgactgactccctttcaggttctcttagtacttggctcctggaaggtgctcctccttgataatccttcctcccaactgcattgacatagatggagtctttctgctattgactggtctgattggacaggcaagccatgaagatggagagggaggaagctcctgaatggaatgtggctgccggaaaatcagccccctcctaatacactgcaatgaattaaattactctctatttagtagcttttcctcatctattggaacatgtacaattgctatctgctatgatcatgtattcccagcctttcaggtgggataggtccaagcactcattttgtttggagcttcacacagtatgaatatagcacagatttacctagggaagaagttgacttgatgctagtgcctgtgattcagccacagggaatatttatacagcaaagccagccagctgtccccactgtatttatcttcttccccctttcctactagctcaggccaccagatacttcactttcttttatcaaagtctaaaatatttgggtgctttaaaaataggttttcagaaatgttaccaattaacactatatatatatatatatatatatatattttgtgacagggtctgctctgtcacccaggctcaagtgcagtggcacaatcatggctcactggtgccttgacctccctgggctgaagtgatcctcccgtctcagtctctcgagtagctgggaccacaggtgcatgccaccacacctggaaaatttttttttttttttgtagagacaagatctccctgtgttgcccaggctggtgtcaaactcctgggcacaaggatcctcttgccttggcctcccaatgtgctgggattacaggcatgagccaccgtgtctgacctaattaatactattattatctaatcacattgattttcagtgggggctttctatttcatgtgggggcttgcgaggggagggtaataagggtatggtgagaaatggataggaaatgtacctttatcgtagagggaaggaaacagtttttttggtctttcacctgtattgcgagtagcaaaacatgttcatgttttcagtctatgtgagagattgctaagcgagcagggtgttaaaatgtggtcatgtggaaagcaggttgtcattcttcctcacacgtgcacagcgtagctcagtttataaggcacactatttcattggccttttatgtaaattttatattgtaggcagggttgtttcctacatttttcttcaactgatgctcagaaatatcaggcaacttggctcattcaacaaatttctactgagagcatactattaatatgtgcaaggcagtgttgtaagttgtgaaggaaatccctgccctcatgcattttctgttttagtggggcgcacacacatagataaaatatataatataccagatagtgatgagtggcatggagaaaataaaacgggaactggaaaggggattatgtgtgagtgtgtgtttggaggtggtattgttgctaatttaaatatagtggtgagggagtgcctgattgagatgatggtattttggtaaagacctgaagaaggtgagagaggaagctctgtggatagcttgatgaaagagaattctgggaacaggcaaggacagctgcaaaaacctagaggaagaaacatgctagagcagagcaaatgaatgagacagccaggaaataagatggagaggttaggaggaagattgaggtcttcggggccatcatgagattttgaggaggggtacatgatctgatctagatatctaagcatcactcaaggcattgtgttgaagttagaatatagagggcaagggtagaagcagggagatcaattaggaggctatgacactagtccgggagagatgaggatggcttggatcagcgggacagtggtggaggtgtgagaggtgattatatctcgagccaacagggattgctagtggattagctgagagaggtgagagaaagacaggagcgaaagataacaccaaggtttctggaaggatggagttgctgtttcctgaatgagaagactatgggtcaggcaggtttggcagaggtaagtggaggaagagatttagacataagtttgaactttaagttagacatctccatggagatgttgagacttcagttggatacacgagtctggggttcagtgtaggggttctggctggataaataaagttggccatcttcagtatgccgatatttaaaaccttgagattggaggcactcaccaagggagcaagtacagataaagtgggagtctgaggcctgagccctggggccctccaggacttaagggtggggaaatgaaggcaggatgcatcaaagagaaggaacaactggcgaaggaggagaaaccatgaggacatgatttccccagagctgcatgaagagagtgtttcacagagagggagtgatcaactgtgtcaaaagctgttgatgttttatgtaaaatgaggactgaaaatgagcaactggatttagccaagtagccccagttattctatcccgtagcagtcttttcttcattgacagtatctggatttttccctccctccctccctctctcttttcttccttcccttcccttcccttcccttccttctctctttctctctttatctctctttttgtttctcatttgcctctttcactggatagtaacagtaacccctataagaacggggaccatgactgttgggggtatagtggctggcacatattaggagtatgttatgcaatttatctcttttggtttctgttttgaccacatattgtccatttccctttctcaccttcctaatgttccaaatcactttggggaatttcctctcttctgttgtgtgtggtcttgatgggatggcaaattctgtgtttgcctcctactgtggaagccaaagcaagcagatgctgccccagacccctacaccagggggcaggctgcgtccatcagaggctcctgagttatccatggacaagagaatgagttgaatcccagcatctctgtcctcaccagagagccctcctggtgagagctgttgccatggtttccatttcccaggccttggtgctcccctgcttcctgccatcaccaagcctgctgctccagcccctgtttctctgagctcccagtatccttccagtaaatcctctttcgcttatgttaaccagagccagttactattcctttcaacttaaaaagttcccaacacctaagcactcaatacacaatactcaatacacatttgctgaatgaatgaaaaagtatggttttcatttcatgaatggcgagtctgaagttcagagaggcttaccacatgtctaagaccacataccttccatcaattcttctatgctcccttttcacattctcagatctctgaaatcaggatgctttttacaattggcagtgtcttacaatcaagtggaagtatttttctgtttttagtggtatataaaataatgtatcttatattagcttagattcaatgaaatatggtagtcagtattgaagtcaaaattgaaacatatttcaaaagtctgtacatcttcgcttttcaaggagtttattatctagttggagaaaaaaataagtaggaaaactccacaaatctttctcaaatacagagtagggtttcatgaacactgagtggaggccctcactaaagctgcaggggtacatgactctgaagggctgagtggaggagccacagcgtgggcatttatgttgatctcagcaagaaagatttggatggatggaaatatgagaagaatggagaggagggaggactaggttctagacgatggcaaccctgccgactcttaaatgcaggtctgagccacaaggctgagtttggtggagatggttgcttggtgtctcccctctgactctttcccttctccttctccatggtaaattattcttccaattctccctgtgttcaccattataactgttttctgctgcaatctttttctggaaagttccccccttcctacctcctgcccattcctcccaatcagttcagctcttgtgtgtgctggacagaaatccctcttggcagcctaggcaacatagcaagacccccaactctatatatttttttaaattagccagcatgataatgcacacctatagtcttatctactctggaggctgaggtgggaggatcacttgagcccagaagttaaaggctgcagtgagctatgatggcaccactgcattctagcctgggtgacggagcaagaccctgtctcaaaacaagcaaacaaataaaaaagaaattactctgggatccagaaataagggaaaatgtatttcagggggaggaacagcaataagcatggaggtgcaatgcatgatgtatgtgaggaagagtgcctgaataccatgaaagggtaggctgggaagaggggtttactcattcattcagggaatgtttgagtatacaccaggtactgctctaggcactggggatagagtagtgaaataaaaattatgtttctaccttacaaggcttacattctaataagaggagataagccataagcaaataaatgtttaaatacatatgtatatacacctatggaaaaaatgtcagatggtataaaagcaaagaagaaaaatgtgaaaagggttaaagaagcaagagagttggggtgcgagctgctcattcaaatagaagggccaggaaagtcttttttgttaagataacatgtcaacagggaactgaaaaagtgagtcagagtcttttgaatcttccggtggaaagtgttccagggcgagggcacaggagatgcaagggtctggatggggggttgtgtttggcaggtttaaggaatagtatgtctaccgtggagtgagtggggacaacagagtggcaaatgcatatgtggtggggaggttagccaggccagaacaggtaggccttgttagcattgcaaggatttaaattttattccaagaggatgcaaagcctgtggagaaatttgagtgaaagaaaaggaatgagagatagatggggcctaatccttgtgaagctgcaatgctgtcccaaatagtttgaatccgattctcctatgttcccagaattttcatttctgaatcatttaaattgagcaggaaatctgttctaatgaataaatatgttttgttttttttttttttgaacacggagaggcctccgcttagaacagatgtaatgaagtcatagtttgttttgacagaaagaggctatggaaggttacacttcctccactctgcctttggttgtcaaggagatacccctggaagcctcttcttttgtagctaaatgtcactgtatagcacttagatttttcatgttctccttttattatgttattgtaaagttctctgtgtaattttgctcaggagttaacaatttcatcactgatgagtctgttcattgcaaactaccttttctggcattctgattgtctttctccatccagaggctggcttccgggaggggcatgcacctgaaaactcatcaaacctgtctttagaaaggtcctgagggtcagacaggctgaaaaaggcagattaattctgagaagctgatgggaaaatgtgaactgatggatcaaactacagaaagatacatggtgctgggttgctttttgtggagagcattatttcagctgctgaccaatcagggtggatgttgctatattcagtttacagaggggaaaactgagatgcggtggtaggagacttactcatgtagttacggtagccctggaacaagcatcttctagtttttagtgtgctttctacaacactgtgttttttcaaagatataagctggagatgataggttagttaattaattcattcaacatgcctttttattgagtgccttctgtgggctgggcactgttcaagacactgggaatactgaggcaaagagatgagctcctcatcctgttcacactcctcccgtgcccaagtagacattacttttgactgtcagctggatatagatgtagaatttattatagatcaaggttggccctttagatgaaaatctgctatccccggcttaggcatacatggttcagagatcaaaaaagctaaatctgaatcagttctctctgaaaggaagttaaggtttttcaataagctccagactaaaagacccgggaagaccgatatacacgttaagttggccatggatattgttggccagggatcagcctctttccaaagtgtttcacaactgattaaacaattctgatgagtgaaatgtgtttctcccaggttttgaaatcatgtgctttaaattattacatctctatgctgttgtgtgcaattaagagtaaacaatgcatcctgctatcacctcttttcagcacaagggaggaaacaggttgatttctttggactttgtggattgcttgcccacagtagcaatactcccttcttttgatgggagatctttagggtttccatctgctagcaatgtgcattaataaacatttttaactgaggagagggtgatggagtttttatatctaaatgtctttctgaaagctctgtcggtaaccaccacatttaaagagagttatactatttgtattcctgtctgcacatcttaattattcaagtcttccagggcttacctaaattagacaaagaggaaattagtaagatgtattataatgtttagacagatcaaatgaaaatgtgtcagatacaaatagctcacactgcattatctgattttgtccacagcctttgctttttagttaggaatgtctggatatatgtgttatcaagagaagcttgtctcctctctgctgtgctgtttctttagtggtccctttagtcatttaatacagggctataggcactcattattctggctttgggacatgtctgacttttgtcgattgcgattgcgggaacttgggaaactgatctgcaggaagatggcagttgatttgcataagacccccaggcattttgacacaagggaccaatattccaaactattccctgaggtctggttaggtaaagcttctgagaaaggttgaagggctccgtttaaaaccagggcaaggaaggcctatgaggttcctaaaataaaaatcaacctcaaggtagccatatctaggctgatgatatgggatcaaaaccttaaaatgtgtgaggtagggctggttctgacacaatgcatcattcatatcactatcccttctggacacagtgaaaagaatgaagggaagaatttctgagaatgagagtatcatctgaaagacttgcaacctcagagtccaggtgaagaggtgagcgggtagaactagtcccttacaatgacaccaggcaaaagacatgcagccctggatccattgaagcacttctctttcagcttggtgttgaaggacaggtctgaatattgttgccttgtgtaagctccagggagatggttggactcgttagagatgaagataacccaagatgccacttttgctaatagggcatgtggatatttaagtacttaagtaaaaaataaaagagatatggccatatctgtgctctgaattcatacaacagtacctactggttacgatgtgtgtgcatgtatgtgtatgcatgtgtgtgtgtgtaagaaaagggttcagctgcaattttacaactcattgggtaccagatatctgcctcatagactcatcaccccctagaattgtagccccttagtgatcgagataagggccaccatccttcttcctcttagtgagccttctctgattgccttgtttaaacttgacatttactcttcccctcccctgattgatttctctccatagcccttattaccctctttattgttcactgtctgtttctctaccaggatccaaaagggattttcatctgtctctttttcaccgcggcattcacaggtcatatgaaaacacattgaacagttctattgcacaggtgctacagatgcaggcagtagcactggggcaggcttcctgagagcccctgctgaaccaggcacgctgcctttggttgctagattgtgggaagtccagagttctggggcaaaggttggggcagacgtgaagtaaggggtgaggatgaggagtttcttaacaaccagtgatgttgtacttgtgagtcctggctgaatccccagtgcttagaatgatactcccacatagtaagtgctcagtaactattggttgcatgaattaactcccattttgtggatgaggagtctgagtcacagagaaattaggtagtgtgtgcaaagacacagctagtaggtgacagagccaagcatgagtccattccctgcaccagtctggctccagagcctgccctctgaaccattaggctctgcggttgcaagacagtccagatgaaaagaaagaaagaagaggaagctgttattcctgtaccagacatatcattcttatcaaattcttaaggacctttaagggttcttaaaatttttctaggacaaggtggaggtctacacaaatgaactaaaatacctttctgaaaaattggaaatgaaattgatcaagtcaggattttcacttggctcttcctctcacgtgggtagctactagagaatccagctgtatgacacaggatcaggcaacaatgaaaaaattacttcttatagacaaaacaataatatatgataccaaatgtggcaggcagaataatggccttccaaagatgttcttgccccagtgaccagaagctatgaatgtgttaccttatgtgggaaaagggaatttgccagtgttattaagttagaaaatttgagatgggggattaacctggattctctgggtgggtccaatctaattataattataagggtcctccaaagttgctggctctgaagatggaggaaggggccaggagccatggaatgtaggtgacctctagaagctggaaaaagccaggagatgaattctcccctagagcttctaacaaggaaagcagtcctgcctacaccttggtgctagcccagaagacttgggctagacgtctcacctgcagaactgtgtttaagctgctaagtttgcggcaatgttacagccgcaatagaaaatgaacacaccacaccaaggaaaggtaaagtgaaaaattcagtcaagttatcaaagtgttaaaagaattaaaaaagaccaaactgttgtttttcattgaattcattcaaaataattgtattcttatagtacatggatataattacttaaatatttttaagtgatatgtttattgatatcaaataaatcttcccagtcttttaaaagaatgtacgattttcataagtattatataaggaaaataaagaggaacatactgctatctcagttaatgaatctgtattcctttattaaatcactcagagtgtcatttataggaagcagacttcatataagtaggagaagatcattgccagattttgagctcccagagctccttcactcttgtggctcccccggcaaatctaatcagcctccaatgctgttatttctttcatcacaatgatccttgcatctgttccttcattttcctgccactaattcaggcttcatcactttccacctggatagataaaacaggaatctaactgaccactttggctgttgcttgtccccctttgatctattctgcacacaccctctagattcacctctgtcaaagcccttctccatcatgctgctctcctgggagaaaacactcacacctcttgtcattgggcataggagaggttcttagccatcagtaggaccttactagtgatgagggggctgcacatgacttatgtgcattcactaataatggttaaggtttgaagattattattttttttaaaacaaattgaggcatatttattcatttatataatttcacaaatacttattaaatatttatttgtgcctggcactattctaggtactggggacacaagggcaaatgagagagacaagagcacattccagtgtgggagagagatcatgctcaatgaaataaacaggaaatatctggggagtgttaaatgttatccaaaaacatcagaccaggcaaagtgatagaatgatggggcagctactttggactgggtgatcagagagacctgtgggaggaggtgacatttgatctggtgtctgtgaagatccggaggaagagcatgccaggaagatagaagaacaaatgcagagagtccccggcagctgtgatcttggcatattcaaggaacagagaggagagtgtggctggatggaggaggacataagcatccaggaaagcagttgttggatcttacaggtctcagaaacagaatactgcatcttgatttcccttttaagatggtagaaagctcctagagctttaaatcagggaattgacatatacaatgtttgtctctaaaagctcactttggtttttgcaaggtgaatggattattgaggaggccagctaggaggccattgctgtgatctaggcaagtgactacagtggcttgggctatgacagtgatggtggcgagaagtgtacagacagatccagagcatattttagctttatgatcatcaagacttgctgatggattagatatgtaggataaggcaaagatagtgacttctggatgtttggcttgaccgctggtgatcgttgatactatttattaagatgagaagactcaaaattatcattatgaacatctagtattataatgtgctttcttggcttgtgaggcatccaaggcaatttgcccttgcatgcaatggcacaagaccactatgctttataagacttgtttctattttttaataattttacagtgcttgcctttttgacaggattcctgccactagaagtttctcatttctccctaaatctgtcctgggctaggaaaccagatacaaatgctcattgaaattgtatgtaaaatgccagtaaacaggagctgaatgaagagatgaaaaattacttttgagtagaagatgtgtgttttgtttcgtgggctttatgacaaagattgctcagaaaccctttttgtttacttgctctgtgagagagactactgaataaatgacctctgcatacataaggagttattgtgccttttctgtgcttatgagttgcctgtctgcctttcccagagttctctaccaacagctgagccatcttgatctctatgtcagcaagtttagcccaattgcatcatgccatacttgatgctagttaaaacctgattatgtgtcccagttttagttgctgtgtttctaccctgctattatcacttggtctcccacaggtaccttgtttctgtatctgtatcttggccttgttgtcctcagtggctgcctggataacccagtctatatagaatgataactcttattttcctttttaatccttaatcatgtggagacacacattttattcctgagccaaagcctggaaactccactactattatcaatactgctagtactactagtaataggattactagctagcattggctgagcatttatgtgccatgcattgagataaacacacaacacacatggccacacttgattcagctatccagtgagatagacttttttatgcaacctttaaaaatgatgaaactgaagcaaagagaggataggtaccttttcttagatcacaaagctagttagtgggtgatggagtgaggatgagaacccagagcgactgaaaagtttcttctcttcatcatggtcctataactgcctgtatagactgatacacaaacttgaggcctgtgacttgctcagtgatttccctttctatgcctccctgcctctaagttgatgtccctctgtggtggacccagatccatgcccctttactgtcatacactcatttcattagctatgctacatggccaggaggctatgctaaggggacaattagtatttttaatttgctccaaactttataaatagtaagacagtagttaattgaagagtgcactggttagccagcctctaaagtaggtgtcattgttcttattttagaaataagataacagaagagagcttgtaatttgctcaagatcacgtagttactttaggatgggtcctggatttcaacccatgtctggttgatttcagtgtatcctcttaattaatttctgggaactctttcccaaatggctctagctttggggctaacaggctacctattttacatgcagcattctgttattttacttcctataaataaatgtctctctatgagttttatggtaatagaaatttttaaatgcatttttatgctcctgtccaatcacttggaacagtaaaattgataaattgtttgtattcctctcattttggaacacagttcacctttttcttattttgtaattgtgcttttttgaatgcttgttttgtctgatccatgccttgaaatattttgtaaatctgaatatattactatcttaggaaaagggagatttttcttaataaaattgagtagtgcaatttctatgataaaattgctcaattatactgaaagaaacacaatatatcataagttatgcatcattgaacaacttaaccacacaaatgctcaaaacccagagaaaaaattgtaaaggccaatttagtggaaaaccggaaaggatttaattttcctaaaagtgttttttgggaaactcattagtctctttaaatgctctgtcgaaaaatggtttcttggtaatataattgagacatgctctatattttatctcctatgaaggattcagaaaataagatttgctaattgaaggctctgagaagtcctactcctacagtaaagatatctgatccctaattaattttttgtgttggccatctgttgttattgcctgctcagtatgtgttcacttttctgggaatagcaccataattttgtcctgggaaactgtgcctcttgatttgacgcagtgcgaagtgggtgttaatcaggggaccttgccatgccctggccaaagtataggcatgtgacccaagatggaccaatcaaatgctttctctctggaatttatatcttgaatggaacaatgcagtgattcaatatagttgaaattcatttatcctggtgatggtgctctgcttcctggatctttggagctactcttcttcttgggcttttaacattctggttttccagccttcctttgtgtaattatacaggctgcgcactgcttaagggcaccatgtctaaaaagaaagaaaacattcatgctgtagatctatattaactcctgtgagaatgggggttgggaggggcggtggataatggagagtctgggatttctggctgcatctggaagtagtagaggagagttcctgatgaagttaggctgcaccagcattcaggaatatacattcactttggagacctacacgcacacttgttgatgcccatgtactcacaacctggttttgttcctgtgcaaccccaagaattccatgaggttttttctgtcatccttccactgctcttagataccctcagaaacctatctagacacagtccctttgcctagggaataggactgggggcatggagtgtgtctctgccaacagtgtgtatgttccagtataggacatggacaagcagccaggaatgtgggcacgagtgtgtatagcaagaccccatctctacagagcacctgtagctctgcctgtcagggcccttgcagtctttctttgtatggcctggaaaaccaagggtgtgtgtccaagcaagaggctttagttttactttcttatgagtgggacacatatatttgggttgccaattttaaagatacattcaatttatgaaataacagccatcattctcttgcccctcgttttatccattaatttattttccctccccttctcttcatttgcaggtaaggtagctacctgcctggtgtctacttttcccgggtggcctgaatatggtgcttggttgtgcaataatatactaatggaaccatctttcatttgagggaggagcatccttttaaatttgtgctagtggcagtcttgtctctgagctgccttgtatccttccaatatgcttcagctaattagagtcaggttaggttgtactttcccaaagcttaggtaatacattcctatcatcttttaatactcctcaagttcctcaaaacatttggaaaccctgatccagtggaaatagcacaggactagggaggaagaaacctaattttattgatgagaaacccaaagccctttaaagtgaatttcaggcagggctttcagtaatgcagagtggagaagataacaaatcctctttcccaaaaacaactggagaaaactgtccaaaccaacaattttagtcttctgggaatggacagaggtcaacaacaaactgggaaacatttattcatggaaccttgctgaactttgggtaagaacaaagttcctatctctgggtaagaacaatgggagtctgtgatgttcttgcttggggatgcctcataaccatagatctgttgtcacaatagtgttgccagggtagatctgcttgtgccagaaggcactgacttgatttagagtgaagggcatcgtcagtaaaatcagaaaattagaaacacacaagaagagcctacagttttgctagcctcagattgtggccagaaattcaacaggaagaccttgggaattaaatcagctctccacacatcactggttgactgagaggatatgcatgcacaagaagtccatgtggggcctaatggaaagtaaaagctggggccaacctgatgcccacctgaaacttgtatgcacaaagtttgacccacactcaggtccatcaacaatagctaggagtcttactggctgaaggcatttgagcattttctgaccaattactgactactaagctatgcagacacaggagcaacttctagaaaactagactaaaaagtaaaagtaaggattgaaaaatgcttccagtgctttgggaggccgaggcagtaggattgcttgaggccaggagttccagaccgacctgggcaacatagcaagatcctatctctacaaaaataaaataaaacaattatgtgggcataatatcattcatctgtggtcctagctatctggtagactttttttttttctttaaagacagaatttcattcttgtcacccaggctggagtgcaatggcatgattttgactacaacctctgcctcctgggttcaagcgattctcctgcctcagtctcctgagtagctgggattacaggcatatgccaccatgcctggctaatttttgtattttttagtggagacagggtttcgccatgttggccaggctgttcttgaactcctgacctcaggtgatccacccgcctcaggctcccaaagtgctgggattacaggtgtgagccaccgtgcccggcccccccagctacttgggaggctaaaatgggaggatagcttgagcccaggagttcaaggctgcagtgagctatgatcatgctactgcactccagcctggatggcagagtgagaccctatctctgaaaaaaaaaaaaaaaaaagctaagcagagacaactatgactgcatactgcagaggagacagattctacagattacatatgggtaagttactaaataaataatgaaaacaaaaatcaacaataagagtttagagaaataaaccagaaaacaaagttactacaatatattttgataatttttgattaatgtccagttgaaaaaataattgtgagatgtgcaaataccagaaagtgcggcccttacttaggaaaaacacagccaatatgcataatctctaagtgaacccagatgatagattcagcagacgaagacttcaaaatagctattataaacatgtccaaggaattaaaggaaactacctgtaaaggatttaaggaaattgtgatgaaaatgattcaaaaaatggggaatctcaataaatacataaatagatactataaaactggaaatctagagttataaaacacaataatgtaaacaaaaaatttactagatgggataaataacgaatttggtatcatggaataaggaatccggtaacttgaaggcagatagaaattatcccatctggaaaacatagagaagaaatattgaagaaaaatgtctctcaaagatctgtggggcaacactaactgtcaatatgcatgtaatgaaaatcccagaggtcaaggagagagaaggaaggcagtaaaattatttgaagacataatggctgacaaatttgcaaatttgataataaaaacattaatctggccggccacagtggctcacgcctgtaaacccagcattttgggaggcggaggtggaggcgggtggatcgcgaggtcaggagatcgagaccatactggctaacacggtgaaatcctgtctctattaaaaatacaaaaaattagctgggcgtggtggcgggcgcctgtagtcccagctgcttgggaggctgaggcaggagaatggcatgaacctgggaggcggagattgcagtgagctgagattgtgccaccgcactctagcctgggtaatggagcgagactctgtctcaaaaaaaaaaaaaaaagttaatctagagattcaagaaatgcaaccatcaccaagtagggtgaatacaaagacatttacacttagatacatcaaagagaaactgttgaaaacccaagaaaaccttgaaaacaagaaaaatgacttatgtacagggagacaattatatggttaactaacagacttctcaaaaacaatggagtcaggaggtcatggaatacacattcaaagcgctgaaataagaaaaaggtcaaccaaaaatctatattcatcaaaactatcttggagaaataaaggtgaaataaagacattcccaaataaagacggagaatttgatgctagcagacctgccttgcaggaagtattaaggaagtccttcaggctaaaaggtaatgataccagacagtaactggaatccacagaaagaaatgaaggacattagaagtggcaaatataaatgacagtataaacatataatttttaaataaaaatttgcttagaagacatagattgttcaaagcaatgattgtgatactgtatggctgggtttataaactatgtaagatgccatatagatgacaataatagcacaaaggaagaacacggaaatagagctatattgcagcaaagttggctatgttttaacaggattaagtcactgttaacctgaaataaattgtaataaaatggatattgtaatctctagagcagccactaagaaaataactaaaaatatatagttaacaggtgagttgatttgcatagggtcactacaccaagctagtgcaagtaagacactttatctacctgcctcaatttctccatatgtcatttcaggacattaataccagccacacatcctcactgttaggctctgtcctcccatactagatttttcttaaatttttgaagtaagcacccagcatactgcagactgcttggtctctggccaaagtttaaaaaatctgacatggctcatcagtgaactctcagttctttccttctccaagcaggacatgggcttggctgtgcctgctgaagttgaagggctcatcagtgatatcagggaagttaggtttctctggagacaatgtgagtatcctgggttttccatcctctttcagagcaatgaaacctagtagagaccttgcattatacttcaatcagctgatcgtagccacttgaatttcctgtgggttctagttactcatgaaatgaattttagtactatcccatctaccccatacacatacacactgtcccctgtccccacagacttcaccctctacctccaaatcttattctctgtagtccaacatatcaaaatctgttcctcagtgtcttagacttctccactagcaagatactacttgcggtttattactctgtttagactaagagtctgatgccagaagtcaaggcttctggactagcctacttctcactcattattatctagaatataggccagtgtttctgagactttaatgtgtatatcaatcacctgggaacttgttaactacggatcctgattcagtaggtatagggaaaagcctgagattctgcatttctaacatggtcttaggagatggggatgctctgctggaccatactttgtgtagctagtttctagactagagcataactatgttctaacacccttcttggagctaatattaacacagcattagtttgagggtacaaaagataagaatggaaaagaggattctaaactataaaaagcaaaacatttaagtagggttcatttaacttcaaaatgtaaagttttaaaaaactttaatattaattcgttttgttctgttgtgtctgagttttactataaccatgtttactcctgtctctctttcagcagaattaaatattatacagattcatcttgaagcccttccaaaggagtgtgttgattgagataacaaaaataacatatttatccatccaaccatctgtgcagccatctgtttaaccatccatttcaccatctctccattcatctacatttctagggtccactatgttacaactatgctgtgaaggatgtaggtgttaatgagacagttcttgcccccaaggaatttcatctcttatagaaatgacacaattcttggaatatattctcaaggacagtattaatgtaaggccctaaatgttgtcagagtgctagttaagtacttggctgtaaacttgagtccataagatcattcaacaatgcaaacagtaccatcaataaggtaaacaaaacagaattttatttcctggataatgaacttactcctgtctattttaatacagggtcaacttgattttttttaaaaaagttggaagtgtagcttcttcactttcagcaagacatattcttttctttagtgcaggcaaaaataaagagaatatgcagagatgtcttaaggaggtaggtattaccagcgtagaggctggtgttgatttgtttgggtcaggaagctctttagagatggcaaaaactctgagatgtttccagagtacagagtagactcagaacattttaaagttcatgtcacttattttcttccagagaggttaagtcaaataatctattgaaagcacattcaggatttctgctctcagtctcttcctcccagaaaaatctgtgtagtttagtagcgtttctagtagtattttttttttattttgttccctttctttgctttacatctgctatgattacatttattttatatgaaaacattcttttattttgttttattattattatactttaaattttagggtacatgtgcacaatgtgcaggttagttacatatgtatacatgtgccatgctggtgtgctgcacccgttaactcgtcatttagcattaggtatatctcctaatgctatccctccccccctccccccacccgtatttttttttttaagattagtcaagtgcagtagtgagaagggggtctactagtattttcattaaggccaattaatcctaaaaactcacaccatagcaaggatatggaatcaacctaagtgtgcatcaatggataaataaataaaatgtggtatatatacacaatggaatactatttggccacaaaaaagaatgaaatcttgtcatttgaagcaacatggatggaactggagaccactgtgttagtgaaataaaccagaaacagaaagactagtatcacatgttctcactcatatgcaggagctaaaaaagtggatctcgtggaggtagagagtagaatgatagttaaaagaggctgtaaagtgtgtggatatgtgtgggggcataaagagagattggttaatgggtgaaaacatacagttagctagaaggaataagttctaatgtttaatagcagagtagggtgactatagttagcaataattcaaaatagctggaagcaaggacttgaaatgttcctaacacatagatatgataaatactcaagatgatggagatgctaaacactctgatcattacacattctgtgcatgtaaataaaatatcacatgtacctcgtgatatggtttggctgtgtccccacccaaatctcatattgaactgtagtttgtataatccccacatgtcatgagagggacccagtgggaggtaattaaatcatgggggtggttacctccatgctgttctcatgatagtgagtgagttcttacaagatctgatggttttatgaggggcttttcctccacttcactctgcacttctccttgctgccaccatatgaagaagtatgtgtttgcttccccttccaccatgattgtaagtttcctgaggcctcccaagcccaacggaactgtgagtcaattaaacctctttcctttataaattacccagtcttgggtatgtctttattagcagcatgagaatggactaatataccccataaatatgtaccaatgtgtattaataaaaaaatgaaaagttaatacacatttgatgatattgatcaacaccttctgacttatcaatactgctcccacaggtcagcttccccatcaccattccttccttttccttcacacacacacactttcacctgttacaggcttgtacaaattggaaagtcttagctctgcaagtaacttcaaagggacagacaaaactgtaaataaatatacacttcatcaaaacacccatgatggggcagaagaagagactaacacatactggaggatattcaatagttcttacctctctgctctgcctggccagccccttctcatataccctgtgacttctttccatgctcaacccccttctctcaactccttgtttgttcccaccatggggagagaagttagtttgagtggtcagagtttgggactgtagattgagccatgtggactagtgagcaaggttactgtaccttaaaatgcatagacttctttttccctcctccttctcacagttggatgaattagcagattctagatgactctgttgtcttaccttctcttcaactgcctataccagttcttcctgcctatcccagccaaagcaataagatgttcagatggacatttggggtcaaagggcccattgtaacctttaccaggcattgcatttggtgttaacctgcgtaaaactagtaataagtggtattttgatttttatttattattcctttcatggacagctcccccaggaactccagtggaagggaagataagcagaacaggatttgggcattcctgggtctctggccatgaaaatgattcatatcctattctaaccttgctaatgctggggatagaaaatagaatagtgtatcagttagggttcagtgcaggaaaaagagccactttaggtattttatgcaagatgtgatttaatgcaggaaattagctgctagtaaaagtcattggaaaggtgggaggagaaaaatccttactccaagaataacacagcaactcctaacccctatggaagttaccatctctgaagctacccctggaaattttgagtagaagtagaagaactcaccaccccatagtcaagacctgcattgcacaatctgaatgacaccttcaaggatcagaaagccagattaagaaactacaatccccactgcctctattgccactactttctacacaacgaagctggataatagacactgcaaccttgctatagaaatagctcctgtctccaagataatgttggccagaagaaaaccagtctaaaaggggcagggaaaaggcctctacctcatttctgccttctgtattttgcacaagtgcatctatttggtgggacaaaatttgtatctacaccctaggtgcaaaaacatctggaaatgcagcttttaagttttccagattctgcggtgcggacaggcaatctgaaggagagaaaaaaaggaagtaaatgcaggataatgtggatatgttattttatacttaaaaatatgtgctttatttgtttcatgctcaagaacaacctagaaaataatcaacagtataaagaatgtgataaatatcagatgatttttgtaagtaatataaatcttctaaagcaacctgaagtcaaaaaggagtacttacgagaagggcatgggaatatctcctggaataatgagaaaatttagaaggagacaagggcagctacctgggttcttaatggtcttccaattcttgtttcaggctgctgtgaggttctgccattcatcttgtcctcttcctgggactgagtggatacttgtgccatttttcaagatcaagaatatggaaaaaatgactccttagctcttcctatccctgagattcctcgactttgtaatctatcaattacacaattctccaatgtttaataattttgagcctcaagaaagacatacattttgtaacttcaaaaatcatgcttacataaagctcaatgttttaaaaccagccaaacaaaaaataatatagcagaagtctgggatgggtgaggaggacagtcagatggtcagctgaaaatataataattcaggaccagagagatgggcctgggagcagttggcacagatgtggttgttggggcccactggggcttaagggagtattagaccatatttctctttctctctctgagttaaggaccaagacagaaataaatacaaataccaatagatggagatcaatatatctgtttcaatagtaacaaggctggcttagatctgttgccacagtggggtttcctaaagctctcttcagatttaaaattactaaagttattcctgttattcctcagacctacagttcagtgtagtatatagagaagagcagaatttgtgatttccacaggcaggctggtacaaaaagagagaggacaggccacatgggaaccatggactttaacatttcaacctctcccctataagggactatgtaaaaataggagtcagataaattacttctcccatgggagaaaggaggggttcattcagtagggttctttcaatactattctttcttgggaatggaagttctttatcctgaaacatgaagacaggagcataacatttcctctaatagaactgtaatcattgatgtgaatatctgggaaaccaagaatagaagaggacaaaataaagagtctggagaagtctccaaaatacactaatacaaaacattgacagaacaaatgtggtcaaagaagcaggtggagaaccagaaaggaaaacaaaaacaaacaaacaaacaaacaaaaaacaatgttcaagaaatgaagggaagaaagaattgaaggaatggagggagtagatggtggaaagtgtgagtttctatggaaaacagatggtaaaggattaagaagcttatgagtttaaaatctttaaattttaaaaagagctgtattgatgtatacttgacatataataaactgcacatgttaatagcacaagttttagccttgagcaggagtagggacaattcttcctctgacacagaaatggaggaaatgagggctagttctataaacaagtaagttgaaagtcaaaaggagcaatattagaagatttgagacttgatggtttctttcctagtgaaaaggttgaatcatcagattgaaatgagaagcattaagtgtgggattagaggggctaaggatatgtggtagagactttttgaggcttaacccaaatacgttatcttcttcatcccttgtaagagccttgattttgtttaggttggcaacaagcatggttaaaagactgcatttcccagcttttcttacaacaaaatgtcatgtgattaagttacagccagtgggatgtcaacagaagtgctgtatgggacttgcgagaaggcttcttaagtggagataactcagctttcagtgtgccctacttgctctgttattatttcaccttcttgctgtctagaatgtgaaaatgatgactggtgcactggcagccattttggatcatgagatcatcttgaggatagaagccatctgctgagaatgacagagcaaaaatatactaggttctgatgattttgtggtacctgtatagcacacttggattgtcagcctctgaatttctttcaacctgattgagaaataaacttttagcatatctggaccactgttatttgggtttcagtgatatgtactcaaatacaatcctagctgaaatatgaccatgttaaagttatggtgagtggaaaagggaacttactagggtccagtgaagggattcatgagctgaggcttcagctgacaaagtcatgaatctgcaaggtatgtgcttttctctactcttggcagtcagggatcagaggcagaggcacaggcttgctggattcccgaagggttcagagccattcaagcagatggagcagagtgatagttgagagaggaactgcagaaacagttgtcaatgggtttgaagaatttgatcttgggatccaggttggacaggaaagaaagtgaagccagatgaggagtgaggtcctgagaatactgaatccttgaaggtttggggacggttttatggtctacaggtaaaatttcatgacattgtggtgaggctgggagattttgaagtctaatatttttgtggtgaaatcaaggcaacggtaatgctgaggcctgggtgtggccatgggagtcaggagatggctgcagtggaatggagatgaagctattggcataaagcagggccagaagatgcgggccttgtctgaatggaggatgactgttcataaaaatgacacagtgggatatcaatttgaaatccgttaaagtaactgacaccaagaggaacaacagcttcagctctaatctcaaagcaggcaggtctcatggaaagattttgggaagaagttcaaaatagactgatgggtgatttaaacagggcagctagagggcatggtaagcggaaggcattaaccaccccctcaacaaaaatccaatgactgaatctccaattaagcaaacggagccgaaagatgtctagccaaacatccctaaggtggacagcgactttgcgaaaggcaccagcaaattacatttcacattttctgttcagccattttctgaaacacaaacaatatttcaattagtgtcacaaagaaaggttcattcctgttaaaataagtgattcttctatagctttcagggatatgatgctgaagaagaaaagtacagacctggaacagtaatgctgtgtgtgtttttggagaaatcatcattggttttgtattgatttgtgcaaaagaaagtgtaatttaatgaaatacataatgttctcagccaggataacacatcagcctggaaatggggaaaaaatagctagtagattaaattctacagatgatggctaaataagtgagctgtgcttctagagtggtggccattaacctttccatcatgaggacaccatgtctcagtgtaacatggggataacagtgagttctattatcagactacctgactttgaatccctgcccttttggatattaactaggggtccctgggcaagttatctaatctctacatgtctcagtttccttatctatagaagaagaataataagtcagtcaccttagtgaattgtagagagtaagtgctcagctacacatcacctatatctatatatctatatctacgtaaacattttatagattctaagatgagaatagttgtatattaggatctctagactgagaaaatatgtataatatctacttctggttagatgtaaaaataggaaccttctatacccatggtaactccaggatcaaacaaagatcataggtatgaacgggactaccaaagagtaaatgtaaggaagccttgatgaactgacttcaacagagaagcgttcttcaccggcaagcagggagctacaggggtttccaggtggcgaactctggatctgggtatgagtgggaagaaagaaagttgacaaagatcaaaagactttgctggggagaagagacatccatcaagctactggtgatggtggggcaagtatgacactggactctgaaagtgccctgaatgatcagccggatgcttctcctcaacccctacctgaattgctactaatacggcactggcagaactgaaaaccagaaggaattcatggattatttccatggttcctggaaccaggagactgcagtcattgaatccaaggatggaactgaaacccagccaccctggctcaaatgctaataaaagcaaagaagttaggtagctgctgctgcagctacagcacaactagggactgggctaactaaggtaagctcaatcttaataaagctgaggcctatcccagtgaaacgtgatgctgagtgaatactggatgctcacttcctcaccttagctaccagacataggaaagagcttgcacgcactagaaaaaaaatcaaatcttacaatctccactatatttttatatacaataaaaaataagacatgtggagaaaaaaaccaaaatggtcagtagcagacccatagatgatccacatgttagaactagcagagaagaatttcaaacaacctttatgaatatgtttaatgaactataggaaaaagaaggaaagaatgggtgaacagatgagtagtctcagcagaaagtggacactgtgaagaaagccaaatgaaaattctagaactagagatacactctttgagagaaaaaataaatcggatttgtttaacagcagaatgggaactgcaaaagaaaggatcggtgaacttaaggaaagtaagtagaaattattcaaaatgaataatggccaaaactttttccaacttttattatggaaaacattaatcatcaaatccacgaatctcaccccctgcaggataaatacagagaaagtcatacttacgtgcaccatagtcagattgttaaaatataagcataaagagaaaattccaaatgaattcagagaacattccagggaacaataagaattatagcagacttattaaaaatgatgtctaccagaatgatgtatttaaagcactacaaatacaataaagtaaggaaaacagtcaaaagattggaaaagaaaaaataaaactatattcacaaatgacatgattgtgtacatagaatatacaaaggaatctacaaaaagctctcactattgaatctattaagtgaattcagcaaggtagcagaatacaaggttaatatataaaattaaatgaatctcacacaattagaaataaaatatgccatttgtaatatcaatatatttataataatactaaatattaaaagaaacatgtataaaactaaatactaaatcctaaataatactaaatattaaaagaaacgtgtgcaaaacctgtataatagaaactataaaacattaccgagggaaattaaagaagacctaaataaatggcagtaaaatagtagatgggaaatcaaagagggagattctgggtgaaggaattttccaattagagtcagcatctatcctagggacatttcagaaattcttcaggaattgtgaagttttcaatagagtgcttcagagctggggaacacagacagggaccctcaatgactcataagaccacgaattctgttatacttctagcctcagtcccatattctcatttcagagtaaagactagaactaatggattttgaatttataagccgttgagagtggatgatccatccattcatccaaccaactattgaacatgtacttcctgtttcctttggagtcatttgaagaagggagctgaaaagagcttagcttatgtctaccccagcatcatcactggccatgacttctagtagtgtaaaacttaaggtttcctgaagggctgtgaccaaaaatttgtctcttctgctctatgtcatttctttttctttttcttttttttttttttttgagacggagtctcgctgttgcccaggctggagtgcagtggcgcgatctcggctcactgcaggctccgcctcctgggttcatgccattctcctgcctcagcctcccgaatagctgggactacaggcgcccgccacctcgcccggctaattttttgtgtttttagtagagacggattttcaccgtgttaggcaggatggtctcgatctcctgacctcgtgatctgcccgcctcggcctcccaaagtcctgggattacaggcgtgagccaccgcgcccggcctctgtgtcatttctgaaagctgacactgtaccattgagatttgactctgttgggtcaaggtattgttccctgctagtaaataagttttcctatcatgattaatatactgattttacattaataactaaagtctacttatataattttgcagtatactgagagcactgatcttcacaggaaaactcagcatattaggaatacttgttttaatatttaaatctatttaaaactgaatattatttttgaatagttaatgacttcctatggttcataatttggaagttcaaaatgatatatagtaaaaattctctctcattattatagacactgtagcttttctcagggattagcaatgtgttactggttttttgtgtttacctccaaacatattctatgcatttaacagtacgtagatgttcctttctttctttttttcttttttccttccttccttccttccttccttccttccttccttccttccttccttccttccttcctctctctccctttccctttctctctttctctttctttctttcttctcccttccttctttctttcttctttctttccttcttctctttctttctttctttcttgccttccttccttcctttctccctttcttccttccttctctcttctgtctttctccttccttccttctttttccctcccttccttcctttttttcttgctttcttcctttctctatctttttttttttttttttacaaaaattgagcattttttctgtacccctttctaaaaaaattaacaatactttcttggagatcatttcacagtattacacaaataacctcctcaactttactaaaacagctttcacatgcattatctcactgaaaatggctggacatggattaggcatgatttcctcttttttcccttgtgtgacaaacttaacctgctgatgcacagtgaagaagtgccagagctaggactaggacacaggccttccaattccatgtccattgttcatgtcttatctgtgatatcagcctgtctgtgaaattgatgtgaggattcaatgctttctctataatgagccacctggatgtttacatttagtggcaccgttgccctagcccagtgtctaactaaatataattgctctgtaaatgtttgttgtgtggaataggattggctaattcataaccctgggtgatgattcactttttatcatcaatctctcgtgtttcctaggagatatatccttatcatatgtggtgacagaaatgctgggcacggatgcaaatacaaaatgttctggtcccagccaagtgcaaattggaaaaatttaaacagtcctccagctagcacactggtgagtcagatagcacctttctgccctgcaaggcctccagtctgtaaatctgagaagcagaaatagcatctttagtctcctgatttttccctcttgtgattcccatatttattggacagaaaagcatgaactgggtaaactgtgctttgtttataaaccctcatttttaggaatctgcaaaacgtgcttgtttccttggaaagtgattatagaaattcacgccctagttgtgagcttgtgcaaatatgtgtagtaagaggagtgactctcatgtttagtgtgaacatatgcttctacatgattaaagaagcccaagcaatgattgtaagtatcctatttcactcagttttctgcatgtgatgggtaagggagccttctcactcagattatacttgattaggttccctacttgggcaactttttttttcccttcagcagtttttactgataattgaggggtacaagtgcatattagaaaaccaagtggggggccagcccagtggctcacgcttataatcccagcactttgggaggctgaggagggcagatcacttgaggtcaggggttcgagaccagcctgcccaatatgacaaaaccctgtctctactaaaaatataaaaattagctgagcatggtggcacgcacctgtcatccaggctactggggaggctgaggcatgagaatcacttaaacccgggaggtggaggttgcagtgagctgagatttgcaccactgtactccagcctgggtgacagagtgagacactatctcaaaaaacaaaaaacaaaaaacagaaaaaaaacaagtggggaaaacttgagcaccctatttgagccatgggttacctaatttccaagcaagtaattttacattattaatttttaacttaattccagaggacacactttgaataattcattacttcaaaattatttgaggcttggtttatgatccagtttacaaacaattttgatcatcctcaaaacaacattatgagatatatgttattaaagacccattttaagcataaggaaactagcactagaggggtaagaaacttgttcaaggttgagttgaaatttgaattcaggcattctggatcttaagtccatcctcttgaacactgtgccgtaatgcctccacccacgagaggggaaaacgggcagattcttaaaaaggcactgtgtctaaaatcttacgaaatctgctttgaataaaggcctttacttagcacagttgaaacataatgaacccattttcagcgttgtataatgggagggaggtatacacatacattggtgcttgttcgtatattgagaaggataggtccatgtggggtatgtccacttgtccagggatcttcatgtgaaggaacttaatttaagaaaagaggccattgaaagaggcaggcttggatatggacaaatgatccctattgggggatacttacaatagggcgtatcttacttactcttctgtgggttcttgcttttgctccaggaatttttgcccaagacctggaaaggggagtggaaacaagaatagagttgccttggaggtaaggagtatttttccacctggcttgaagtggccacatttcagaaggatagaatcatggaagactagtcagtgagctggacctgggttacctcccaggagctgcaacatagatcctagtgatccttggagtcaccagcaggtgtgtaagagatacacccatttggacttcagttgtgtactccaggaggagaagggtgccaagccagcaatggcagaaaagcacagtgatccagagacctaggatctgagcagaagggagtatctgcttaagtcccctaaaagtcctctaagcttggaaatcacaggtagagccagagaactactgcttggttacatgtccctacttcctctctaggctgataaggcctgggagatatgacatgcatgttgttctttctatggtaagcaaagcatcaaactcttgccaaggaggaaggagaaaagcaatacagtgtaaaacacaatttatgcttttcaacacaaatttgtggtgtaagatgttgtaatctatttgtaatataagataacaatattgtaaactcacctaattctcaaaattcattcttacttgctactgggagtacaatttatgagggtggtttatggtaatgtacttaattgtctttatattttcagtcttcagcttaaagattgtgagtatttaacacaatgcttaggatcatggtgttcttatgatggtaccagaacattcattcagtgttgtgtaataggagggaagtatacacatacaaattaagaaataatctagatgcctttaaataccttacatacaattcatgtggaaaggttgcaaatcaccacttgattccttgtatttttcttaagattctttatagttcacaaattgcctgatttgatcttcagaacaaccttaggtatggcagctctcaatattttcatttttcttatggagaaattgaaatccaaagaggtaaaatggcatatccaaggtcatatagaggggagtagaactggatctgaactccgttcttctgaatttaattccaaagttttttcattttgcctcacgttccctgaccatctatccatccatccatccatccatccatccatccatccatccatccatcttttcattatcaattcattcaacgaaaatttttgagtgcctattatgagccaggcattgtactaggtactgactcatagaaatatgagtcagtcatagatcctgttcccagggactttttaatataatagggatatcagctatggggctgagtaattctaaatggagacagaaagtagtaagtactatgagtgaatcagaatgccccacaggaattctggtgccagagggataacttagaactggagacaaatgagtaagggctggaacaggagggatttatgtgggagggggccatcttatagggatgctatgtgtagagacaaatcctttgaaattaataggctgggagaatggcccaagcttaacctgaaatgactcttaagcacaagtaaagaagaaaagagagtgaacatatctaagatggaacagaaaaggaagagttttagccagtgacatgaccttttaaaagaatatgcacagactttaaagttctgaaccaaagggagagaaactgaaaagtggaggaagagacttaaaagtaggaggatccagaggcacagtttttctagacgcagtgggtattttctgctcaacctgaatacttggagcatcttgtgggtaagagcaacataaaatcttgatatagctgcttctacaacaggttgaagagaatcaaaatcaacacatatacagcagaggtagaacagctaagaaacttggaaaccccagcttttggaagtgggtccaactgttatgagtgttagggtagcagttgtgagcagagtgagtgagttttagaaacagatcacccagggattctcagtgtttagatgtggtttgcatatttaatgtgaaatatatatcttataaaacattttctgttaagctgtattttagtatgatgttgtgatggttgtttgctctgtatgtgtgatttttttttttttttttttgagacatggtcttgctctgtcacccaggctgaagtgcagtgatgagatcatagctcactgcagcctcaaccttctgggctcaagtgatcctcccacctcggcctcctgagtagctgggaccacaggcacgtgccaccacccccagctgctttttaaattttttgtagagacgaggtctcactttgttgctcacactggtccttcagcttctgggctcaagcaatccttcggcctcggcctcccaaagggttacagtcatgagctaccattcccagttgatattttttattgtggtaagaaaagaaagtagggaatatttccatgaggaattatcccatgaaactaattgtctcaaggaattaatctaaaaactgccctgacttaaggtaacatgtaccttatcaaaggtcccaagtcacacctactagttcaggaattaggtgagatcaaccccaaaaggaccaaatgataatatttccacccttcgattcaaccagggggtttgtgtacagagagaaaatgtggctaaatttgtgtattccttcctagattataaaagcctacaaaaggagggaccatttcttgatcatctttgcattgtctatgcctagcattgcacctagaaggtagagatgtttgtctgatcacgtgcatacagccttgtctgcgagcatctctgatagtcatgacagttcttcacagactacagagatggtgggccatttaagtgatacagacattaagtgccacaggaattcacagtaggggaaatcacttctggctcgggaggtcccaaaagccttcttaggaaaggtaggactgaattagacctggtgagatttgtactagcaaagggagatggggagaatggtatgttccctcacccttcagtgtccacagggtagctggcacttcagagggtgcccacagaggagatggagctggagaaagagagctttgcaagccacagctacctgccagaattgtggagtctgcaacataatctctaagaccgtgcacctccaaatagaaatgaaaatttgagcatggggaaaatttgagctgaattgttgtcccttaagcctaagaaattgtctgaagcaagaatgtgatgccccttcagctcttttcttctcctcttccacatccccatcccaaagaagtgatctggcggggaaagaagaaagggaggaaaagaggaccagatctctggattaaacctcttgaaagagttggatagagagaagtcaactcagtcaaattcagaaagagacgaaagaggataaaagtcccatccaggccagaagcagtgctctgggtgaaagacgttttcagtgagatggtgtcagggaggaaaagctaatagggtttacttagaatgtattgtcttcttagtcccaaggctaaagtaaaaaaagacaaaagagagcatgttagaggaagcaactagagagagagaaaaaaagtcagaagacctccagtaaggcactgcacacgtccttgagtctgtgtctctgtgcttcttccacgtttccctgagcaatgattctccactggggcattcagtggaattcccttctttaggtggcaccaattcaccaagctctaaaataagcccttctgccaccctttaccattgcctcatcagtgctgtggggaaaaattattctattaaaatgcattttctttttggttgtctgttaaattcttgcagggctaaatgtacatgtattttaaaggagaagctgaattgttgtcccttaagcctaagaaattgtctgaagcaagaatgtgatgccccttcagctcttttcttctcctcttccacatccccatcccaaatccaatagggcctgaggttttccctgaagaaggggaaaacaggttttctttgagaagtgatctggccgtcagcaagcaccattactaagcatgatgaccagtgattgcttcttccccacagtggctgtggtggcactccccatctcagtgacttgagaaagaacagggcctctgtaatgttgatacagaaaagccgaaatcagggctcacagcctggttgaatggaggaggaagggacttaaaagtagtgctattcataagccaaggtggttgacatgaggccttccacagcagtgacagaggagacggaagatgtcattcttgagtaacaggaagttactgtaacaccagtttttattactaaagatgacaaaaatactaccaatgacatttatttgagtgcttactatgggacaggcactgaatagtttatatatattcattcatctaatacaacaactttatgagtaggcactatcattaagacaatgatgtccaaaaaaaggaattaaataatgcagataaagcagtccactttgaccactatataccagccccccgaagggtacagatgtttctcttttggcattcgatggctatttagatgtttcccagtttttctccattataagcagcatggcattgaccatactggtacctgccttcctgggaacttgcaagtcattctgcaggatagagacaaagaagaacaattgctaggtgggaggcaatgtgaatttacaagtttttttagataactccaaattgtcctccacagaaaggctttttcaattcatatcctcaccaacagtgcacaaggtatataccttttgctactcctcaggaaaacctgctgttattaatcttcttacattttgtgctaatctcctgtgtgaaaaatgtcttgtaattattttagtttgtttttctctaattgctagtgaggctgtgcatcttttcacatcttttgacactggctatttgtctttcttctgtgaattacctactcatatcttcttttatttctatttggggctatttgtctttgtcttgttgatttataggacttctttacatattccacatgtttatgatttgttacgtgtgctgcagatatttcctcccagtctataatttcttttatttttagtttatggagccttctaccatttaaaagcttgatgtatccaaatttattttcctttcctttcttgcttctgcattttgtaccttgatgtattttgctgtattttatactttcacgggtttgctttcatgtttggctctttaaaacatctgaaacacattaaacagacatagaacatcctcttttcttacccctagacacagaatataataaagaagatgctaattatagaactgaatcccaaaacaagagttaagtagaagtggccatcatcccatctggatgtgctgggaggtgctagcagtttgctagagagagtttcctaaggcatgaatctccagtgctccaaaccgcttagagaatcaaactcttcaaagggacttctcaaggtaaaccctatatggagtattttccagaatacattaatattctgggatattagtaaagtattaacaattatcacatgaggaaaggcttttgtggtcatatatggctgagaaagacttggttaaacaatattaaatgggtttatttgaaggcaacttaattaatgaacatctattttggtcagaggctgcaagttgtcttctgatagaagtttacagtgtgtttaaaaacccaagggatcatttagttcagagccaagtttctcaactttaactacattttggaatagccagggagcattaaaaaaaaatgcggaaattcaagtctgttagcttcagggactgtatttaataggtctatggtgtggtttgggtatgggaattttaaaagtttccctgatgatgccaatgtgcaacccaggtgaagaaccgctgattagcttcatggcttcatttagtagacagggaacacaagccagtttgggaaatagctgggaccagatagagatgtttggaaccctaggcctggcctttccctctatactgtgctgccttcctacaacacttcgttaatttgtaggtttcaacctggaacacacattacaggcattggctttggcatatatcagatgctaccttgtattgcttgttggttctaaagggtctcagttttcttttctgtaaaaggggcctaatacccccttttcctcgtgtcatcgttattctttgaattgaatgagcgaatgcatatgaaagttctgaaaaatgtacattatgcacatggaaattagagtgggcagataaggtcaggtgacccagtgccaacacagtgctccattcataaatgggtttgggagatgtttattgacagtaattgcttgtgggaataagaagcagctgctcttacagaacaacttcctcacaaatacacctggaattcctcacatcccagcaagctgtcaacatcacctccctcagggaactcttgattaaggttaccatattttcagctccaggcattcagaaaataaattctacataattaaaatgcacatgcatatgcatgaacgtgtatataattttgcatgctgtgttgaatagtctccaacttaataaagtagtacaccctgtggttgtcatcctgcgggtgtctctttccctgggctatcccctaatacagaggacaattgttcagggaccagagagacttaactaatggaaggagctgaaagaagctgcaggcaaaggaagaggcatccagggactggaatgggaggcctctctcctgctgacagcaaagcagcattgtggctttcccagagcatcgggcaatgctttcctgaagaggctttggaagcatttagggctctgtaggaatctggaaatccagcctgctctgtgcttgggagaccaccccctccttagccacagaaggaattcagagcagcctgaaagcggcataaatgcctccacggactttcccttcagtggtaggaaggaaacaatctcactaacaacccaggcagtctgtgtcatttgtaattaattcaaagtatgtatgtggtaggtcctggagacacacagtgggtgttcagaccctacccctgtacttgtggagaatgcagttgtatggaggatactgacaaaaagtcaatggaaaaatcaaagaatgacattttgtcatgttaggaaggaagcagacgaggggccggcaagggtggggtgggagggcatttgctttagtgatgatggtcagagggagaccaatgtggctggagagtgaggaggaacctggcagaaaagcagatgagacctgggcagagagcagattatgccagtgtgtgtgggtatgctgcatctattagacagccatgtccacttcgtgggtgataatcaagggcgatatttaaaatagtcaacacctggcaggggtggacctggttttgcttaaacattttggggagagggcctttaaaaaaagaaattttcaagtgtcttctcaatgactttttgtttttaaaacaaaacaaaactgatacggccttataaacatatggctaggatctttgaaaggtgttttgcatatggaggccctgaaacttaggcttcatcagattcacagtaaatccacctttgaaaatcattcagagcagatgccagcagtaagcactggtacagctgtcctgaggcatcccagctaaatgtcagatgcagatgcagaggttctttcagggctaagaagaaaaccttgaaaagagtggggaaggggtgttagggatatttgcatgtgagtgggggtaatgatgccctctgaatctaagctgcaaagttatagaagttataatatatataatagtaatatattataatatataataacaatgtatgcagacagaggaaaataatggaggagtcagtgggttagagatcttatagaagtcctagaattgtactagtggggtgccagagaaagtgagctaaaatgacaatgaaaatgagtccttggaatctagaggttagaagtggcccattttctggtgatggcaaagggcaggaaatgaccatgcagtgggtggctggagtagtgtggaggaaatgtcagtgaaattgagggttggagtgtgggatgactcacccatgtggaactttcagctacaaatgatgtcatgagttgggtagagaggaagacaatgagaattttttttaaaattaaacttgagaactctttattatgtaagaaacagctataactctcattttcttggttgctaggtgtgctgtccaggatctggaaagaaaagtgcacacaacatctaaatttttctcccagtgggagattctactgctggtattagaatcacaggcagacattactgcacttgtttgggcttggctgaatctctgatcagttacatagttatatatgtctgcattttccctttccttgctggaggtaaatgccttttgaatggtcatagtctctatagagaagtgtgttattaaaaaggaaaaaaaacagcaacagatattttatgatatataatggtttttgttttgcaaaagcctttcacatttatctcatttgatcctcagaacaaacccataaaacagtgagcattttcccatacaagacagaaagaaacagtctcaagttaagcaaaccacagagcttacacatgttatagaaaccagagctgaggcttgaatccaggtattctgcctccctatccagttctctttccaccaaagcatggccccatatctttgtggtaatgttgccatctcagctgcttctaccaaattgtttgttcctaatgttgcaagcctgttggtctcagagaaaaggggcaaatgagagaatcctgggcctgagccttcagacccatgagatatttgcttcctccaggctggagtttgcttgctaaatgaactgtgctggttgtaaagatcatgaagccaactgaaaaagatttataagctgtctaggtgatcatccttaatgggaatacataggagtgtgggaaatctctaatttaccaccttgatttgtgagggtgtgtacactggcatggatacgtgtgtaacccaggcagcctgctacaccagtttccaagctggcttgcttcagtgcattcacacacataaatcctgtcattgggaatatccttcctggcatcattgcatgtctcattcaatctcatgtcccagcttaaatactcaactctttggaccactcttgattttcctagataaatgtaaagttttcctcctctgaactctctgtcaccctcctgggacctcacttatggtacttttcatcttgaattagtgggagttgaaaaacaaccagtctttcgtactctattgtaaatgtaataccttaaggccagggaacatgtgtcattcatatttgtgtatctgccagagttaccttgcaccctgatgtaaaggagctttgtttgcagtctgcaatgagggactgctcatcgggcccccagtctgcacagcaaatcttgattcgaggcatccagaagagttgactgggggtgtctggagctcatgagagaaagaaggctgaattgtggtcctagagagggaaggtaaagtcacggagcgaatgagatcaccccaggaaactgtgagaactagtaagaagtgatgcagcccgaggactgaaccttaggcaaacacataaagggagaaaagtaaaagaggagcctctgggaaggaatcactgggattcaggataaagtgaagtcataggagccaggaaggaatggtgaacagtggaaacattcagagagataaaataagatgtttaaaagtgtccgttggattgaatgacagagaggacatgatgttctttgccatgatagcttctgtgaggtggtggctaaggtgatcagatgtcctccattgcttgggactgagggggtttccaggatgtgggacttgcagtgctaaaaccaaaaaaattctgggcaaactgtgataagttggttactgtaagtgagaaaaataaaaatcaaactccagggctgaagagcgagtgtgagggaagaagcagcaactgaagtgaagagcagtttttggttcacagcaaaattgagcagaaagtgcagagttcccatagacccctgaccctgcacacacacagcctcctgccactatccacatcccacaccagagtggacatttgttccaatcagtgaacctgcactgacacatcactatcacccaaagtccatagtttacattagggttcactcttgatgttgtatgctatatgagttttgacaaagtacaatgtagtttagaatgtcagtatgggaggaaattattaggtgtaaacagattggaagggaaaagagacacggatgcatgaaactgcatttgcctgtattttatataaggttgaaaaagtaccagttgtccacatcaaggaataaagggctgatggagatttgggaggaagttaaaccctgcctcaaattcaactcccgtgtagatctctaaggaaagccctattccttatgctacctagatgaagctgagatgccagaaacacattgtagcaaaagaaataaaattctcaaggatatatggattctggactaggtctattactcatgactcatttattccctcaacaatgcctctgaagaggtcttggaagacattgtttaaacagaacattaagatgaaatttctgtttctggaaggatggtatggaaaactagatgctctgtctggctgtcttaccaaaaacagtttaacagtctggataaaatattttttgaaaaagtaagtgcaagctggagctaggatgaaaacagtgagagttgagagtcctaaaccaaagtgaataaaaaggaacaaaatgttaatacacgcaacagtatggagtaactcaacaccattgtgctgagtgaaggaagccagacaaaagagaatacatactgtgtgactgcatttacataaaattcctgaaactgcaaacgaatctgtagtggtaggaactaggtaagtggtttcatgggagtaggagtagttggaggaattgttacaaaggagcagggggaagcttttggggtgatggaaatgttcactctcttgattataaggatggtttcatgaatgtatattgccaaaattgatcaaatatgtgcagtttatggtacttcaattatacagtaacaaagatcctagtaaaaatacccagactagctcaggcagaaaaaaaagtgacggtaggaactcaaatttgaacattgctttgagtgttttttaccctgagggcatacaccaaactctactgatcctaagcttcactctcacatcctgtcagggcaaggggaaaggagaaaaagcctgaagtggagagtttaataggagagcccctgtaggaaactgggacctccacatgctgtacttttaatgtaaggatgaccaaaacataagccagtccctcactccctgcccgcccagcggataagttttatgtttatctataattattttatctttttttttttttgagacagagtgtcactctgtcacccaggctggagtgcagtggcacgatctctgctcagttcaacctccgcttcctgagttcaagcgattctcctgcctcagcctcagctgggattacaggcacctgttaccatgcccagtgattttttttttttttttttagacagatgcatttgcatcatgttggcctgactagtcttgaactcctgacctcaagtgattcacctgcctcggcctcccaaagtgctgggattacaggtgtgagccaccgtggtgggcccctatacttattttatcttgatagcaaacacaaggtttctagattagtgatcagaccaattatttacctacagcagtaacattaatggttctccatgctccacttacccctttgtggtgatgtgatgagggcagatattccccttgcatgtacaaagggagtcagtccttttggagggaaacccagaaattatgaacctcagagtttatgaaggaactgctgccctttcctctgcagagaggaaaagaaaccattgctctctaatgtaaaccaatcctctataggaagagaaggggaaggtccctaggtgtccacatcctttgaaggtaaataaataatagtttttgggaaaataaaccttcaaatctctctggggtaataaacaatctcgaaattctaaggcttgtttaccattcactcatacttggccaggaatttttgctcatgcacaaacaggaaaatattcacactgtttcttgacagaggatacatgggaacactgcctatctcgagcttaaatacttactggagaagtgaaatactcagttgagcattaataaacataatatggcctcatgtagactgaattcatattatttggattgtaataataaattaaattagacacttaattgattatttaacagctgattagatatagctcaaaacagacctgagaaataaatctaaagagatcaaccagtatgctgcaaagagagacaaaaagatggaaaatatgaaaaagtggttaataggtatgggaaacagaatgaaaagatctatcatgagtctaaatggagtctcaaaaggagaaaagagagagaatagtgaagaggcaaatttttgaaaagataatgactgcagaattgatgaaagactgtaatcctcaaattcagacagaacaatgaattctgagcaggttaaattaaaataaatacattcctaggtacatcatagtgtatattaaaagcagcaagagcgattactctcaaaagagcacctagatcactgaccaagaagtcatctgattttttaaaaattgagatgtaattcatagaccattaaattcactctttttaagtgtacaatttagctatttaagtatcttcacaagggtggaaccaccaccactacctagttccagaacattttcattacccccaaaagaaacttgtaccatttaagcaatcattctgcattccactcccttcccccaacccctgtcagccaattctctactttctatttctatggatttacctactttggacatttcatacaaaaagactcatataatgtggcctttcgtgcctgctttctttcacttagcataatgttttcaaggttcattcatgttgtaacatgtatcagtcactacttcattcctttttgtggctgagtaatataatactaatattcttaaacattttctttattcctttatcagttgataaacatttgggttatttccattttttggctattattaactatactgttatgaacattcatatataaatttttatgtgaacatatgttttcaattctcctggaatatacctagaagtggaattgctgggtcatgtgataactctatgtttggtttctaataaagtgataaacagttttccaaaagtagccgcaccattttacattcccaccagcaatgtacgaggattctggtctccccacatgcttgccaaggcttgtttttgtccatgtttttgatgatagccattgtagtggatgtgatgtggtatttcattgtagtcttgatttgcatttccctaatgactaatgatgttgagcatctattcgtgtgcttattggccatttatatgacttccttggagaaatgtcccttcaaatcctttgcccattaaaaaaaattgattgtctttttatttttgacttataagagttctttgtatattctgcattcttgatccttattagatatacgatttgtaaatattttctcccattctgtgggttgtctttcactttcttaatagtgcccatttaaaaaaaaatgaaccattgaacaccaaattcaaaaaatttaaaaactattatagtgttatcctgatttgctggttacctccttttagccttcactgcgtaaatttggcaaacccaaatgtaagcttatcttggatgcctgcctttctctgccgtctctgacagttgcttaccactccccagaaatgtatttcctgtggagtggacataccataatgtttgtaaattctgagctactcattttttcctcaatatcagatattgccttgtggaatacagaatgactgcccctagacaacaacaatttaagggtggtcagtaagagtaagtagcaattcaaagatatttgcctcatgcgtgggcacatttgtatgtgagtgtgtgcatatacgtgccttgcagatccagagctaatgggataggttggtaaaatgattgatggtcttccccaggaggatgatcaatattaacgatatatagatggttttcctcagatttctcatgctttttttttttccaattcactttaccgggcaagtaggagagacatggagttgatcctctcatttccctccaaacaggttgtggaattcaccttgcatacctcctgtttcctcatacagcccctcctcataatccctctgcatccccaccctatgggtcactgagttgcattgattcagctaactcagtatctcccacctaaccatgttctgtttccatccacaccctcctagtttaaggcttcatggctggcagcctcctaacttacctccttgttgtagtccctcgaattccactctgatctctgcaccactgccctagcatccttctaaaagcctgtagcttgtcatttatactctgcaaacctaacaagagggaccaggtcttctcgtctttagaaataaaacataaatgagcatgtcacttttttgttaaaaatcttctctggctcccctctacctttcgcctgccgtctgaagaactcagcatggcatccaaagccgcttccaggtgctgctatcatcacacttcctgcccgactgcccaccattctcctttcctctcacatcctgtcctttctacaccacggctgccctgcaccactctgccccctatcattgagggcatctccatgtctctggtgcagttccagtgccaactgttctgtgcagactgccctggatgtttgaccagtattattccttcgctcccactgtgctttgtctgtatctcccagacaacagttatcgcatgcctcctgtctccttcctggaaggcggggattttgtgaattcatacataacctctcagggcctggctaatcattgatggtcaataaacatttgttgaattgagctacatttttatgtgcaagcttaactttagaaagaaaaacttagggagaaaaaccaggagaggaggtgggtgtgggtttcataggataacagtctcttgattccccagaatttcgagacgtttcagatgccaccaagctgaaactcctgcctcatgcggcccttgttcctgtcactctctttcttctcttctctcagtctccagcttgcctgctactcctcctccacgtggccaatggttgtggtatctgcctgcttcccctctggcttgtctgatggtcccacgaagaggctggaaggcgaacttttctgggactgtctccatggggacttggaatgtaatagacagtcttcctgctgcaggcaggcaggcaggcaggcaggaggggcaggagagggaggcaaggtctcaggtccctttcctctcttgccctggagtgaactgcatgccccatattctgggaggagagaattcagagcaggtgtttcctcctctgaaaggcaaaacattcctctagcacttcatcttttctctgccatctctgacatttgctcaccactccccagaaatgtattccctgtggagtaaaatctagagttcagctgaaggacaggaagaaaaaccataaaacccttacatatcaaactgtctgacctgctgatgtaattcatttgcaaggacactataagattgttatacttagatagagcttgcgtttggcaccggcttcggggaattgctttctctttttctgcacatagcaaggatcatccctgtccttatcctggggtgtgggacctaccttccttaacccctattacctagtttcctggccacttggggcttccttcttataacttcttgtaatgactgtattcatactcacataacttttctgtatagctttgaaaacagatctccccatccatccttcctgccccttcatgcctttcctaagctctccccaccaaaacacacaatttgagggctagcccagtgcatagcatctacttacacagtccagcatggtatctactcgttcttgtcagacccctattgacttcagtagggatggcactgtgttcaagaggctgaagagacccagagccagtgaatgagacatagggtttattgaaggaacttacacacagggagatctggtggcagtgggttagagaggagaactgccaccacttttaacaagtatgcaatttatatagcattttcacttagtatcctctccctagcaacctccacctggtaaccttcattcaacccaaaacaaagggccttgagcccctgtatgagctgcattccacaggatgggcagagggcatgtgtcggtagtggtgggggtttggatgttcctcatagataaggaatgaatctctgggttggtcactcccggattccttatcttggaactctaaacacattcttcttagaccatagggtcattcgcagggtatgcttacattaaggtattgctgtcacttatgtctgccatacactagtaatatgttgctacttaaatgtaaatgaaggaaaattttcctagccagagcaatcagacaaaagaaagaaataaagggcatccaaatcagtaaagaggaaattaaactgttgctgttggctgatgagatgatcatataccaagaaaaccctaaagattcatccaaaaagctcgtagatctgataaataaattcaggaaagtttcaggttacaaaataagtgtacacaaatcaataacactgctatataccaacaatgaccaaggtgagaatcaaaccaaaaactcaaccctttttacaacagctgcaaaataataataataataataataataataataataataataataaaatacttaggaatatatctaaccaaggaggtgaaagatctctaccatgaaactacaaaacattgctgaaagtaatcctagatgacaaaaacaaatggaatcacatctcatgctcatggatggctagaatcaatattgtgaaaatgaccatgctgccaaaaacaatctacagattcaatgcaattcccactaaaataccatcatcattcttcacagaactagaaaaaaaaatcctaaaattcacatgaaaacaaaaaagagcccacatagccaaagcaagactaaacaatcaacaacaaccacaaaacaaatctagaggcatcacattacctgacttcaaactatactataaggccatagtcaccaaaacagcatggtactggaataaaaataggcacatagaccaatggaacagaataaggaacccagaaataaacccaaacacttacagccaactgatctttgacatagcaaacagaaacattaagtggggaaaggactacctattcaacaaatggtgctgggataactggcaagccacatgtagaagaataaaactggatcctcatctctcaccttatacaaaaatcaacctgagatggatcaaagacttaaacttaagacctgaaaccataagaattctagaagataacatcaaaaaaacccttccagaaattggcttaggcaaagactttatgaccaagaacccaaaagcaaatgcaatgaaaacaaagataaatagatgggacccaattaaactaaaaagcttctgcatagcaaaagagataatcagtaaacagacaacccacagagggggagaaaatatttgcaaactatgcatctgacaaaggactaatatccagaatctacaatgaactcaaacaaatcagcaagaaaaaaacaaataatcccatcaaaaagtgggctaaggacatgaacagacaattctcaaaagaagatatacaaatggccaacaaacatatgaaatgatgctcaacatcgctaattatcagggaaatgcaaatcaaagccacaatgtgataccaccttactcctgcaaaaatggtcataatcaaaaaatcaaaaaataacagatgttagtgtgaatgtggtgaaaaggaaacacttttacactgttggtgggaatgtaaactagtacaaccactatggaaaacagtatggagatttcttaaagaactaaaaatagaactaccatttgatccagcaatcccactactgggtatctacacagaggaaaataagtcatatgaaaaacatgcttgcacatacatatgtataacagcacaatttgcaattgcaaaaatatggaaccagcctaaatgcccatcaaccaatgagtggacaaagaaaatgtgagatatatatatatatatatatatatatatataaaactcagagataaaaaggaatgaaataatggcatttgcaggaatctgtataaagttggagaccattattttaagtgaagtaactcaggagtggaaagccaaacattttatgttctcactcataagtgggagctaagttatgaggatgcaaaggcataagaattatacaatggactgtagtgactcagagtaaaggatgggagaggggtgagggataaaagactacaccctagttacagtgtacactgcttgggtgacaggtgcaccaaaatctcagaaattactactacagaacttgtccatgtaaccaaaacgcatcttttccccaaaaactattggaattttttaaaaaggaaaaaaaatgaaaaaaattaaaattaaaaatttatactagtcacatctttagaactcaggagccacatgtggctactggccacatattcatcattatggatttataacattttcatcattgcagaatattctgtttgaatatagtgtcactatgaggagcatgtttgtctttctgggacatgttcattgaattttatctgagaaaaatgatttttttattgaagcttttattattcatatattgtttcttcagattatcattttctttctttttttttacattttaatttccacagattattggggaacaggtgatgtttggttacatgagtaagttctttagcggtgatttgtgagattttggtgcacccatcacccaagcaatatacactgtaaacaatttgtagtatgttatcccttacccaccccttaccatttccccgagtccttaaggtccactgtgtcattcttatgcctttgcatcttcatagcttacctcccacttatgagtgagaacacactatgtttggttttccattcctgagttactacttcacttagaataacaaactccaatttcatccaggttactgagaatgcaactaactcattcctttttatggctgagtagtattccatcatatattatgcaccatggtttctttatccactcgttggctgatgggcatttgggttggttccacgtttttgcaattgagaattgtgctgctataaacgtgtgtgcaagtatctttttcttataatgacttcttttcctctgagtagatacccagtagtgggattgctggatcaaatggtagttctacttttagttctttaaggaatctccacactgttttccatagtttacattctcatgaaccatgtggaattattccctgttcactgcatccatgccaacatctattaagttttgattatggccattcttggcatgagtaaggtggtatcgcattgtggttttgatttgtatttccctgataatcagtgatgttgagcattttttcatatgtttgttggccatttgtataacttcttttgagaattgtctattcatgtccttagcccactttttaatggttttttttcttggtaatttgtttgagttcgttgtagattctggatattagtcttttgtcagatatatagattgtaaaaaaatttttttcactctgtgggttttctgtatactctgctgactatcccttttgctgtgcaaaagctctttagtttaattaactcccagttatttatccttgtttttattgcatttgcatttgggttcttggtcatgaaatccttgcctacaccaaggtttacaagggttttttcaatgttatcgtctagaatttttattgtttcaggactttaagtccttgattcatctcaagttgatttttgtataggtgagagatgaggatccagtttcattctcctacatctggcttgccaattatcccagcaccatttgttgaatagggtttcctttctccactttatgtttctgtttgctttgttgaagatcagttggctgtaagtgtttgagtttatttctgggttctctattcttttccactggtctatgtgcctatttctatatcggtaccatactgttttgatggctctggccttatagtatagtttgaagtcaggtaatgtgatacctccagatttgttcttttttgcgtagtcttgctttggctatgcgggctcttttttggttttatatgaatttcaggattgttttttccagttctgtaaagagtgatggtggtattttgatgggaattgcattgaatttttagattgcttttggcaatatggtcatttttacaatattgattccacccatccacgagcatgggatgtgtttccatttgtttgtgttgtctatgattttttcagcagtgttttctagtttttcttgtagaggtatttcacttccttggttaggtatattcctaagcattttattttattttattttgcagctgttgtaaaaggggttgagttcttgacttgattctcagcttggttgctgttggtgtataggagagctactgatttgcgtacattaattttgtgtctggaaacgttactgaattcttttatcagatctaggagctttctggagaagtctttagggttttctaagtaaaccatcatatcatcagcaaacagcaacggtttaacttcctctttaccgatttagatgccctttatttctttctcttgtctaattgctctggctaggacttccagcactatgttgaagagaagtggggagagtgggcattcttgtcttgttccggttctcagagggaatgctttcaacttttcctcattcagtattatgttggctgtgggtttgtcatagatggcttttattacattgagatatgtcccttgtatgccaattttgctaagagttttaatcataaagcaatgctggattttgtcaaatgctttttctgcatctattgagatgatcatgtgatttttgtttttaatcctttttgtgtcgtgtaccacatttattgacttgtgtatgttaaaccgttcctgcatcccttgtgtatgacttgtgtgaaacccatgatcaagtgggtttcatattgacttttgtatgaaacccacttgaccatggtggattatcttttagatctgttgttggatttggttagctagtattttgttaaggatttttgcatctatgttcatcagggatattggtctgtagttttttttttttttttaattatgtccttttctggttttggtattacggtgacactggcttcatagaatgatttagggaggattccctctttctctatcttgtggaatagtgtcaataggattggtaccaattcttctgaatatctgatagtattctgctgtgaatctgtctggtcctggacttttttttactggtaattttttaaattaccatttcaatcttgctgcttgttattggtctgttcagggtatctaattcttcctgacttaaggtaggagggttgtatctttcaggaatttatccatctcctctaggttttctactttatacacgtaaaggtgttcatagtatccttgaatgatctttcatatttctgtggtgtcagttgtaatatctcctgttttgtttctaattgagcttatttggattttctgtcttcttttcttggttaatcttgctaatggtctaccaattttatttatcttttcaaagaaccagctttttgtttcatttgtcttttgttttgtattttttttgtttcaatttcatttagttctgctctgatcttggttatttcctttcttctgctgggtttgggtttggtttgttcttgtttctctagttccttgtggtgtgagcttaggttgtctgtttgtgctctttcagactttttgatataggcatttagggctgtgaactttcctcttagcactgcctttgctgtatcccagaggttttgataggttgtgtcactattgttgtttagttcaaagaatttttaaattttcatcttgatttcatttttgacccaatggtcattcaggagcaggttatttaatttccatgtatttgcatggttttgaaggttgcttttggggttgacttccagttttattccattgtgctctgagagagtgcctgatataatttcaattttcttaaatttgttgaggctcgttttgtggcctatcatatggtttatcttgaagaaagttccatgcagtgatgactagaatgtatattctgtggttgttgggtagaatgttctgtaaatatctgttaagtccatttgttccatggtatagtttaaatccattgtttctttgttgactttctgtcttgatgacctgtctagtgctgtcagtggagtattgaattcccccactattatcatattgctgtccatttcatttcttaggtctattagtaattgttttataaatttggaagctccagttttaggtgcatatatatttaaaattgtgatattttcctcttggacaaggccttttatcattatataatgtccctctttgtctttttcaactgccgttgttttaaagtttgttttgtctgatataagaatagctacttctgttagcttttggtgtccatttgcatggaatgtctttttccacccctttaccttaagcttatgtgagtccttacatgttaggggagtcttttgaacacagcagatacttggttggtgaattcttatccattctgcaattctgtatcttttaagtggagcatttaggccatgtacattcaacattagtattgagatgtgaggtaccattccattcttcgtgctatttgttgcctttataccttttttttcaattatatttttgttttataggtcctatgagatgtatgccttaaagaggttctgtttgatgtgcttccaggatttatttcaaattttagagctcttttagcagtttttgtaatgctggcttggtagtggcaaattctgtcagcatttgtttgtctgaaaaagactgtatgtttccttcatttacaaagcttagtttcactggatacaaaattcttggctgataattgttttgtttaaggaggctgaaggtaggaccccaatcccttctagcttgtagggtttctgctgagaaatctgctgctaatctgataggttttcctttataggttgcctggtgcttctgtctcacagctcttaagattcttttctttgtcttaactttagataacctgatgacaatgtgcctaggtgattgtctttttgcaatgaacttcccaggtgttctttgagcttcttgtatttggatgtctaggtctctagcaaggatggggaagttttctttgattattccccaaaatatgttctccaaacttttagatttctcttcttcctcaggaatgctaattattcttaggtttggtcatttaacataatctgagacttcttggaggcattgttcgtattttctctctctcttttcttttttaaattttactttaagttctgggatacatgtgcagaacatgcaggtttgtcacataggtatacatgtgccatggtggtttgctgcacctatcaaccaatcatctaggttttaagcccccacatgcattaggtatttgtcctaatgctctccctccccttgccccccaactccccaacaggcccctgtgtgtgatgttcccctccctgtgtccatgtgtctcattgttcatctcccacttatgagtgagaacatgcagtgtttggttttctgttcctgtgttagttttctgagaatgatggtttcctgcttcatccatgtccctgtaaaggacatgaactcattcttttttatggctgcatagtattccatggtgtatgtgtgccacattttctttatccaatctactgttgatgggcatttgggttggttccaagtctttgctattgtaaataacgctgcaataaacatacatgtgcatgtgtatttacggtagaatgatttataatcctttgggtatatatccagtaaagggattgctgggtcaaatggtatttctggttctagatccttgaggaatcaccacactgtcttccacaatggttgaactactttacactcccaccaacagtgtaaaagcattcctgtttctccacatcctcaccagcatctgttgtttcctaactttttaatgattgccattcttactggcatgagacggtatctcactgtggttttgatttgcatttctctaatgaccagtgatgatgagctttttttcatatgtttgttggccacataaatgtcttcttttgagaagtgtctgttcacatccttagcacactttttgaggcagttttttttttgtaaatttgtttaagctccttgtagattctggatgttagccctttgtcagatggatagattgcaaacatgttctcctattctgtaggttgcctgctcactctgatgatagtttcttttgctttgcagaagctctttagtttaattagattacatttgtcaattttggcttttgttgcaattgcttttggtgttttagtcatgaagtttttgccatgcctatgtcctgaatggtattgcctaggttttcttctagggtttttatggttttaggttttacatttaagtctttaatccatctcgagttaatttttgtataaggtgtaaggaaggagtccagtttctgttttctgcatatggctagccagttttcccagcttattctttttactttgtctttgttggcttgggttaattcgaaaactttgtctttgagctctaaagttctttcttctgcttgtttgattctattgctgagactttccagggcattttgcatttctataagtgcatccattgtttcctgaagtttttattgttttttaattatgctatctatttcattgaaaatttctcccctcatttcttgtatcattttttttttttacttccttaaattgggcttcacctttctctggtgcctccctgattagcttaataactaagcttctgaattcttttgcaggtaaatcagggatttcttcttgtttcgaatccattgctggtgagctagtgtgatttcttggcggtgttaaagaaccttgttttgttttgtcatattaccagagttgtttttctgtttccttctcatttgggtaggctctgtcagagggaaggtctagggctcaaggctgttgttcagattcttttgtcccacagggcgttcctttgatgtagtactctctccctttttctcaggatgtggcttcctgagagctgagctgtagtgattgttatctcttctggatctagctacccagcaagtctaccaggcttcgggctggtactgggggttgtctgcacagagtcttgtgatgtgaaccatttgtgggtttctcagctgtggataccagcacagtatttggggtgtctcctgcgtcctgcaggagcaatccgtttccttcagagggtctgtgggttctgttagctttcctgatttattcctgcagttgttctggagcaaaagttcatgatgcaagactctatatgctgctctgcccatccgagtgggaggggaaatctagtcctgccttccgtctgccatgatttcctccttctgaagccagagtatcattttctaaattgggacttggtttcaccagcatgggtatacaaatggaggcaatttaagagtagcaattatatgtactgcctaatttgtacaatgtaccatgccaggtactttctatatgctacttctgattctcacaacaaccttatgggttagatttatttctatttacatatatggagactgaagctccaagaggtaaaaagaactcaaaactatacactagtcagaagctgggattccaacccatgtctgttgggctccacagtcttttctactatatgtctcagtgcccctccagcatgaaagaccattttatgtgaagacttaccaagctgaaacatttggacttggaagatttaatacgcaatcactgttctcagagatctttcagtctagctagaaaggcaaacaacttcattgctactgtcatcactttgcaaacatttctataacgctataatttacaaagggtgctctcattcttttggtatttcaggaagtattgtagagctggacttaactgacagaaattgaagtacatgcacctggataatggagatacttacgaaggagcaatcattaactgtgattgtgtgggagatgcagaggagatgtctcaggaattgaatcttgatgaatgaggaggatttctataggcagaagggtgctctgggcagaaacagccacattatgaatggtaaacacccatgctgcagcctcatcgccctctaatccaccccacttcctgcagtcagagtgagctttctaaaacacaagactgttgcttcctggcttaaaagattttcgtggttccattaccctgggatatagtcccaactccctgcgatggtttgggaggctgcacagtctgggtgaaatactgttctcacatttccacctctttcttatttcccaccctacagtgatttgtttccttgaatataccaacccttctctcaccttggggcttttattcagacttttcttgacttgactatccttcctttcactgaccacttgcttttcttgctaatgctttttcattccttcaagattcagttagttgcctcctcggtggtctgtggatacaccttgcttgcctctgtcataactgccatccacctcattgagacagcctctcctatgtgactcccacatcacccagacagtaaacaacttgagggcaaggactgtgtcttattcattacatacagagcatttagcatattgtgaatgatcaataaatatctgttgaatgaataaatgagaatattcccatttactaaggatgctgacctgcccttagggatatatcaagccgggtttcatggtgaatgcataagaaggactgtagagaaagcagtatattaaaaatgcatgactcaggatattactacaaaccaatttgtgtctcccatgttgctatacatttatttaataggactaattcttcccctaccactggattaaaaaaaatgtgcagtcccatgacttttctagtaatccttaagttatacaaaccatctcaatttactaattagaaaatcagcagtcaagtctgagcttccctgatgacttgctagcctagcccctcctgtttaattccccgctgttactctctatgataagtatccattacttttcaccttgagtattgcagtacctcttcactggcctccaagtttgtctctctgattttctaaaggacagctgaagttctttctgcagaaattttcagtggctcccaatcacctaaagagtcaaatccaaattcttaactttacattcaagattctccatgatctgactccagccctttctccagttttatcctcatcaaccttataagtctatgctgccattaaatttcccagtgttccctgaacatgcctttgctcatgctcttctatcagcctggatgcctgaccctcttctttgcctaacaagactgactccatcctacgggctgtggctcaaacactcttctctgtgaggccttccccagctcttcagttagaattactaaatcctttctcagtattcccatagctgcagtaggacttttaaaaagcccagtgctttccacctcaatgaaacacataattattaaatgcccaattgtaggcaatgcatcagctgttggctactgtgatacaggagttttatgggggttgttttaacaggaatttaagatctgtagattagtgaaccatgagggcctctagaagaaataggaagtaactcctcacctctttattgtgaggtggtgagggatatattacagaaataaataaggattcttcccagcgtagtctctttaaaaaagaaacatggaaatggccaaatgtctgtcaaaaacgaatggataaatttgtttttctgtaaagtcatacaatctactttacagtaatgaaaatggttgatgccacctacacacatcaatatggatgagtctcaaaaacacattattaaacaaaataaaattactcacagaagaatacatcaatatgatttcaggtgtgatgtaaagttcaaaaataggcaaaaatatatcctttgtatacacatagaaagtacaagttgaagagaaaaagggaatgatgaacacagggttcaggatggtgaccacctgtgggtggagaggggcagtccatgaggtggggcagaactgatgaactacaatgagacatcatcatcacccagaatctacagtttaacttagggggtcactcttggcattgacattctacggattttgataaatgtataatgacatgtatccaccattagagtatcatacagaatagtttcactgccctaaaaatcctctgtgctccatttattcatttgaccctccccctcctaaccctggcaaccactggcctttttactgtattcatggttttgcctttttcataatgtcatctagttggaatcgtacaggatgtagccttttcagactggctttgttcacttagcaatatgcatttagagttcctccatgtctttgccatctttgtaactattctgaatcatctgaaatgtgtcttttataagcagcattttttcccttcagtctaatgatctacgtatttcattgaaatatttattatgtttacatttactgcatttgcagatatgtttaggtgtacaactatcattttgccacacctttctacttatacccgttccatgttcctttctcctctcctttcttgccttcttttgagttatttgtttttattattcagttctttcctctttgtaaataagtttcttacacattattttactaattttaatggttagtctagagattgcaacaagcattactgacctattaatgtctaatataaattaatatttttaccatttcctgtacgaaataaggacattattttttatgctttatttttttaatataacagtcttaaaacacataggcaaatgattaaaaattgaagtacacatattctactgagggtaagcattcaatacattggctgataatggcaataaatactaaagtgtaaacatgaaaacgagtaactgcccatgtaaaggcaagttacctgctcactcactgttaatcaaactctagttttcttcaagttatgcccaaattctttcctaatagaaagcagaaatgtattaattcatcggatatttacttatatgcccgctgtgttttacattgttcttggcactgcagataccagtgttaacgatatggacatgatacaaacaatgtaaagtaattacgatggtgccttgagtttcataagcaccaacaacagttatattacccttattactgctactacacatacttagcctgaaagccttgaaactttgaagcagtttagcaccaaattccctcaagacagctttttccacctttgaaggtttatctctgtaatagtatgttagtcagattaagttgtttaattctacaggatcacaaccccgagagttttagtagctttaaacgagaatctttttcttgttcatatacagtcttctttgactctgagcttcttttcagtatgcctgtcctccatatgcaggctcaggacttcaggcattttgtacttgtcacactttatgtcaaagcttgctcctacaatcaccactgcagaggaagtatagctggagagtcttcaatcacattttgttggctaaagcaagttatttggacccttctaacatcaagagggctggataagagcaattttcctatcagtctggaaggaatcatgctacagtttgaatgtgttccctaaagttcatgttttgggaacagaatcccccgtgcaacagtgctgggaagtagggcctagtaagaagtgattgagtcagaagggtctgccctcatgaatggattaatgtcattatctcataaatgggttagttattgagagaccaggtttgttataaaataaagttcagcccccccttgctttctgccctgtcttcctcttccatcttcggccatgggctggcacagcatgaaggctgtcaccagatgctggtggtgccatgctcttggacttcccaacctccaaaactgtgagcccagtaaacttctattgtttataaatttcccagtctcaggtattctgtcatagtaacacaaaacagattaagacaagtgggtatcaaatactgatgaacgatggtgcagccatgggtaatctaattaaggtgcccattacaaagtgctctcacataccacccctacctccacttaggctctgaaccaccctacaaggaaattattgtttaatttatccagatgagagcgtacaccttgctcacccaaaatcattattactataagaagtagtgaaataatcaaatcctatgcttgacactagtaacattttattgcacctttcatatctcacataaaggaagaatcatgaacgtaatttatgctctgctttaaagctcccaaacattaacataatatgagtcatacatcttatacttaggaatgttcattaaagagcagccatctgattgctccaccacacatattgtacactttattatataaaggaacattattcgactgctttatcagtgcttacactcctaatttcttcttgtaaaagttttaaaatgctgagaactgcaacttgccttaataatttccattgtactttctttcctagttgaactaaacactggacaacagcatggtaggatgagtgacagtcccccctaaaagtccatgccttaattccagatacctatgagtatgttgccttatgtagcaaaagaaactttgtagatatgagcagtttaaggatctttagttggggtgtttatactcaattatgtgagtgggcccaaagtaatcacaagggtctttgtaaaagggagagaagagagtcacagtcagaaaagggaggtagaagaacagaggcagaggttggagcagtgctctctgtagatgtagtaaaggaccatgagccaaagaatgcaggagacctctagaagctggaaaagtcaaggaaatagagtctcctctggagcctccagaaaaaacgcatcccagccaacaccttgattttagccccataagactccacttcaaacttcagacctccagaactgctagatagtatatatttattgtttttgccaccaactttgtgataatttaatatagcaacaatagaaacaaatactttaggtaatcagaaatgcagcatcctggagttatgcctcatcctcagctctcctcaagagattgcttagttcttctccccatactggtcttcttcaaatttcattattgattcccttgcatcattattagtccctcctctcttttttattacctattacaacacagcttggggataaaaagtatttttgattcatgttagatataattgtaagatgcttcctctaatccattttaaagtagatagggtgtaaattttacataaaaggaaggagaaagaaagaaaagaagtcacatgggcttgggaatcagagtggagcttgaatacaagcaccactgggtattagcagtgtgtacttgggtgttatgggatgaatgtttgtgtttctccaaaattcacatgttgaagccctaatccctaatgtagtggtatttggagatgtggcatttgggaggttattagggttagattaagtcatgacagaaggatcctcattatgtctttataaaaagtgaagaagacagatctctctctctaccatgtgaaaacaaagcaagggagcagccatctgtaaatcaggaagagggccctcagcagataccaaatctacaggcatcttgatcttggacttcccagcctccagagctgtgagaaataaatgtgtgttgtttaagccactcattctacagtattttgttatagcagtccaaactgactaagacgttgagcaagtagcttaatctctctattcgttttttaatacataaacttgaaaataatgcttttgttctcaaagggctggtgtaaaaattagatgatgtatagagaaacagcactcatatagagaaaagcttaacatgttgcttggtgttatatggtaaattgtgtcctccaaccctacaatttatatgttgaagtcctaactgctagcatctcagaccatgactgtatttggagataaggtctttaaagaagtaattaagatctctgaattaggttggaccctaatccaatatgactggtgtccatatacgaaggggaggttatgacacagaaatacagagggaagatcacgtgaagacatagggaaaagaaacatctacaagccaaggagagaaccctcagaagagaccaaccctgccaacaccttgatcttgggcttctagcctccacaattgtaagaaaataaatttatgttttttaaaccacccagttggtacattgttatggcagcactagtaaaccagtacacctggaatctgctagacaagtactaaaataaaatgtaaactattaattttgattattttgtcagtagcctccacttccactgcattacaaccatctacttctgggcttgccactatttgaaaccacttcacctatgaaattttaaagtaggagaatccctttttctgatcacaagatgtaacccctctatcccttttaaactactggtcttgtagtctgtcctctttgagagaactcaatctcatcacaagatgggaggatcttgtggtgtgtcaacagtgtgtcagtactggcctggattcatctcattccctccccaccttggacctaatggcaaggaaattttgtattttcaccattcattccatttactctcccattctccttaccctacccctcataattggtcccctgctctggagatataatttgctttttttgattctattctcaaattattgtgtgaatggccaagaaaattttacagccttgtatcttggtgccacatctgcttaatgagtgtagagaatgcaacaaatgctgttttaggcttggctttcacaaccatcctatgtgacaattactctcattttatagttaagaataatctctactgcttaatgagtacaataactcttcaacattatcaataggttcttggaaacttcaactttaagcaaaacaacatacagtaggttcttgaataatgttgtttctttcaatgtctatataaagtcgattacttgtgcaatttggtgccctatgttaggatcaacatatctgtgattctcttaatcgttcccacccttgttatacaatggttataagatggctgctgaagcatccatgttcatgttaataagagaaaactttcgcctaacactatctatttcatggtctcacttcctttagtctactattttttttttttttgagatggaatcttgctctgtcactcaggctggagtgtagtggcacgatctcagctcactgcaatctccacctcctgggttcaagtgattctcctgcctcagcctcccaagtagctgggattacaggtgcgtgccactacgccagactaatttttatatttttagtagagacgtggtttctccatgatggccaggctggtctcgaactccttacctcaagtgatccacccaccttggcctcccgaagtgctgggattataggcgtgagccaccgcacccagccctccttagtctactcttaaatgctgggggtttcctctggctctatccttggttattttctgttcttgccacacacacacatacacacactccatgtatgatctcatcccatggcttgtatgaccagccacaccgtgctaatgattaggcagtctctttctctggctttatcctcttccctgagctccagttcttaatctctgcttaaatattcatggggccattcagagggaacatgatcaaaacaagattctttctctttcccttaagacacgtgtcctcctctcatactcttaattaatgacattgtcatcgtctcatcctcctatgctagaccctcccaaggtctctcttcagaaacctcactctgcctgccctttactctcaccaatgtctaacaagtcatcaaatcctgtcaggtctcctttagatagcgaggttcttctgccttctccccactgctctacttgaggtcaggtccttatcagcttgtctctccccggaagccttctctcccctccacttgggggagaggtgctctgcgggggcagtgccagcagagtggccaagtgtgaagctggagcctgagagcccaagctcttatcctggtgtgccacacaaccttgggcaagttgtttaacctcttgtgcctgagttttctcatctgagaaatggggataataatattacctgcttctttgggctattattgtgaagaataaatgaattaatgcatccaacgtattttgaagagtgcctggctcaaatgctgtgttaccgtgattgccattgaaaaccaggcatgtttacaaagtgcttagcctagtgctgaggttttagtgagtactcagcaaaggttaatattattattaatatttttatctgtgccctttcttctacctctacatttaagatcctttttaaatgcttccaactgtattttataatttatctcttaacatctgtctccctcactagactgtgtacttcccccaggcagaacacagaccaggtcttagccattgctatatgcacagcatttagcacatttgttagatgaataagtaggaatagcaaccaaggcttagctcctgatgggtgtaggcactcttgatggttaataagcaaactccttttaatctaattctgccttactctcaggcctcaaagctgatgttcctcctctgtgttttcatggcacactgtgcctaatttcttttattgtaaaatgattgcactttaaagtgattatctgtaacttgttgcctcccttaatagattgtcaatttctacagggcaggaagaatgtcttattcagcactatatgcccactgcacagcacagtaagtgacctgtgatactcaatttatatctgttgaataaatgcatgcatgaattaattctttcaatgctctgagataggaattaatattattgttcttttaacactggaggaaatccagaattaatgagataaaatacattccccaaagcacaggaagacaggttgaagacatatgaaatatggatattgaatttgtaagcatatacatgtagctgcatgtgacagagtcccaaagtaacagtggcttaaacaaggtagacattgagcagggcacagtggctcaagtctgtaatcccaacacttttggaggccgaggtgggaggatcacttaagcccaggggttcaagactggtctgggcaacatggcgaagccccatcactacaaaaaataaaaaattagccaagcatggtggtgcaagcctgtagtcccagctacttgggaggctgatgtgggaggatcgcttgagcctgggaggtggctgttgcagtgagctgagatcacaccactgcactccagcttgggtgacagacagagagcctgtctcaaaaaaacaaaaaacaaataaacaacaacaacaaaaaacaaataacaaaaaacaaggtagacatttacctctcatgtaaaagtctgagctggaatggcagctctgctccacaaaatcagcagcgaccctgctacctgctcttctgtggctttgccattcctgtggtgctgtcctgtttgcatggtcaccccatggctgcagttcaggcagtggggaagaagaatgaggaagaggcaagcatgcctctctccttgcagaacacaatttctggaacttagaaagttcaccctcacttctgcacacatggccgcacttaactataagggtggctgggaactgtcatctttatattggacagtcatgggcccagcttcaaattccattactttgaagaaggagagaaataatattggtaacaagtggtctctgctatggatattaatgctcccccttttctaggtagagaggggaggatggaaaggagagggaatgatattatcgttgtttttcttttttaaaatagctcaaccctttttcaacatgtcaatcaccatttaaaaaaggggagggaaggttactgctgtagattaaaagaaacttacgaactaaacgaccaaatgtagtcaccgtttttaatatcctgatttgaataaaataaccataaagaagacaattggagaatttgaaaataatagcatttcaaatgtgataacccactgaattatatcatactttgaatgagatagtttggctatttctttttagaaatgcatatttaagtacgcagggacaaaatgacatgatatctgggctttgctttaaaatatttcagcaaggctgggcgctgtggctcacgcctgtaatcccagcacttcgggaggccaaggcgggcggatcatgaggtcaggagattgagaccatcatggctaacacgtgaaaccccgtctgtactaaaaacaaaacacgaaaaattagccgggcgtggtggcacatgcctgtagtcccagctactcgggaggctgaggcaggagaatcgcttgaaacctccgcaggtttcactgagccgagatcgcgccactgcactccagcctggcgacagagcgaggctccgtttcaataaaataaaataaaatatttcagcaagagaaaggagtggggatagacaaaacaatgacatgattattgaattaccttactttgaggtatattaaaaatatttcacggtaagtttttttttttttcaactagctcggccttgttaatggagagatttcagtcgaaagatagaggtaataaatcaaggctttttctctaaagctccaggtccttgccgagctcagggaatggaggtaagaatcaatatctgtgtccttatgactaagcctctcaccaacggctcccctaggggcttggtttcttcttttagattacaatagcactgacattttagaaaagaaaaatagccccacaaaatacttaacatgctggacttgttgctggcacacgcccggagagaatggaggaaacgatggttgcaggctgtgtctctctagaagatagtctctccttttttccttagaatgtgaaaatcctctaaaacccagaagaaaaatgatactatctgcaaaatttgacccacagcaggtcatggctgctttttcttcttaaaggaatagctaaatgtaatcgatgtgtatttgtttctggggctgctctgtgctagttcacaatcagccagggtacaagggtaacatttgctgcccctccatctgttttcttgtagctaagaccagggcttggaagtttcagggcaggcacagccatgagagaaacaatttccatgctgagcagattacctgtaagtgcctctcagcctcagcagcagggctgattttcttcctcctgattacagtgttttggcttttagaggaaattagaaccaggaagtactatattctctgtgaaaatgataaaagcagttttttctgcctgtggcgctagaaatataatatggcaaaatgcttatgatgaatgaaatgaatgcggttgctcatgcatagaaacccatatgcccatgtaaaatcagcgatgtgtatgcatattaagacattacatttattttgacaaacactttttaaaaaaattttatttaccttttaagttccggggtactcgtgcaggtttgttacataggtgaacttgtgtcatgggggtttgttgtacagattatttcatcacacaggtattaagcctagtatccactagttattttcctgatcctctccctcctcctaccctcttccctccgttaggctccagtgtgtgttgttcccctctatgtgtccatgtgttctcatcattcagctcccacttataagtgagaacatgctggtatttggttttctgttactgcgttagtttgctaaggacaatggcctctagctccatcatgtccccgcaaaggacatgatctcgttctgttttatggctgcataatatattccatggtgtatatgtaccacattttctttatccagtctaccattaatgggcatttaggttgattccatgtctttcctactgtgaatagtgctgcagtgaacatacatgtgtgtgtgtctttataatagaacaatttatattccttttggtatatacccaatgatgaaattgctgggttgaatgatatttctgcttctatgtctttgaggaatcaccatgctgtcttccacaatggttgaactaatttacattctcaccaacagtgtataagcattcctttttctctgcaacctcactagcatctgttatgttttgactttttaataatagccattctggctagtgtgagatagtatcgcattgtagttatgatttgcattactctaatgatcagtgatgttgagtatgcttattggctgcataggtgtcttcttttgaaaagtgtctgttcatatcttttgcccgctttttaatggggttggacaaacacttcttgaatactaatttactctgagtgttgcctgaaatactgaggaagaaaacctgattcttattctcagggagctgaacatgtgctctcagttcttattcttcaaaggtcagtgccacagaatatcagaaaattcaagtttaccttttccctgagggacactctgtgcctcccccatccaagtctttattgccatatataacatcccttactggtaagtgcattgacaggcggttctggccaaggtcaaagaatcatctggaagaagattgccccaagtgtctttgacagaaggccaggcctgacagctgcttcttgaagaaagtgtttggttgatctaatacatactattcccttctctttgagatccacgtggcttactagcacttccatgtcattcagattttctacaataaagaaaaacattcgacctagtgtttcccagacttatttgacctcagaagccttgcccaaataactcttttatttgtgtttcatggaacatcctttgggcaatgtcaatccagaggcatcttgaaccattggaatttttggctctggtctgaattaaacagactaggaatgtgcccaaataggaactacttttgtcaccttctttgatttttgacttgcttaaggctaaaatctaagagactgaaaagcttataagatctttttaatgagtatcttgttatttagctttatccaagttaaaaatccatgcttaacttacctaaagctctgtttcaaagtgcattgaatgttagagttgagaaacttaaggcaggaccattcactgtattgcataattccttgcgcagcctgtgaggtggtttccaggcatgtattcataatgtgaacaatgttccctggctttgtgtgacacagacaacctgaagatttcctatacatcagaaggctgtgcccatgagtgaaaggaagctgattaatttacctttgaatcgctattgtgtaatacagtgtctattgcatagtaggaacttgataaatgaatgaatagattaagggatagtctagcttcaggtatcatgctcattcatttttttcttcagggaaaccaagaggttgatggggttcaggacacactgaaccacagaatatggtactttggcatattgaatattttaagctgaaggaatttgagaaacagcaggtgcaggaagaactctctgaccttcccctgaagcagccgtaagagcctcatgtgggagatgccctttcatgacttggaggaaaggagccttcttatctctgaagacagagggatactgagaggaatctgaatgaacaggccctgccaagtttgccccagtttactatacgtagctcatacctttgtcctatcacattcttccatgactgtcctctccatcaaacctagaatgtcaatgttcagttttaagctgttaaaagaaaatcttcagacaaatttaacagagtttaattgagcaactagttaaaactagttttaaaattgttggtaaaataggccaggcacagtggctcatgcccgtaatcccagtactttgggaggccgaggtgggtggatcagttgaggtcaggatttcaagaccggcctggccaacatggtgaaaccccgtctctacttaaaaaaaaaaaaaaaatacaaaaaattagccaggcgtggtggtgcacacttgtaatcccagctactagggaggccgagggaggagaatcacttgaacctgagggttgcggtgagccgagattgcaccactgcactccaacctgggtgacagaatgagactctgtctcaaaaaaaaaaaaaaaaggtaacataaaataggatatatgcatggagaaacctttaggccgaacttaacatatgtaaggaggtagttttgagctaaacttgatataacaatttccccattgtagatattaatgtcactctgtcaccatcacaaatggacttatatggtctcaactccctctgggtaataacagaacagtgggttttgtaaggtgggaacaaggaaacagaacaatagaaaaaactagttaatatcaggctacttcaggttacttttttataagagagcagaaaaaaacttccttattatgttgaaatcttctgttttcagagaaaacaaaactagtctgttttaggatctatctgcttccttaaaatttcgatttgattatatggcatttagcaagagtgactccattttgtttaggtctgctttgttagggcctaatgcatgaactcaatccaaaaaaatggcctgccataattttgtttaacaattccccccttttggtcaggttctcacctagatgtgggtgtgacagacttagggctttagcactactctcagttaccatcattttgagtttccagtcaacatgtcatttataggttacagggtccatccacaagatcatgtatttctttgagtttttgctgttccagtcaaaagagactatttggtattctatggatggctgcatggatacatttcaaacttttgagagaatacagcatatcagggagactaccattatgactatcaggaggataataacaatagtttggagtatgctccttagccagggtctccatgaaccaaaccaactaaagtcaaatagatcaaagaatgagccagataaaaagtttacttgttttaatcaagcagcttgtttgttaatctcctatacttgttttaatcaagcaacttgtttgttaatttcctacaactgagtctgcataatacctgatatattactcctccatgtacaacagaagtgttggcaactacacagatatttctctgtttggccagtagacaatctagagcaattttattatctactacaactttagcaagagaatttaaagaaatctgttgtgcaaccatagcctttgcagtagaatctgctctactgcatattatgagggataaatttctaaccattgcctcatttatatttattccaagccacggcaaaagggatcaaaaaatgatgcccactcagaaggacgaaggtctcctggaaatgttctctttaacttattatataggttaagaggagtggacaaatgttctgtctagctatgaaacaacaaaaataccattcaaattcctagcccacattggtccttcatctaccatccatcaagacataaggttgcccatgtataaggttgactctcaagtcctccacaaataaaagtgtaccccatgggcgtacacaaggtccccttttcagttcagttgctcataggggcagaagaaaggaaaaattaagagaggtaagagtttgatgatggcagagaaatcttgatctgggaaagctggccatatctaagatgccattgcttctggggagaaatgatttgttttactgtaagatttccaatgtgtttacagtttcaagagtctggaggggtccttctaagttgtgagattacagacccaaggtttgaggtcctgaagttttgctgcagtgtgggtggcaagggtggtcattttcttatgtcatttccagatgacccaatttctggattctagattgtgaaagatttgtccacggtcagtggatgatgaaaaacttcctctaccgggtgaaaatacactttggcataatacattaaagccatgtagcatttagttgtaacagaggttaggagagtgggagatatatgaggttctattattaggagcagaggccttccagtgactctttcataagtggtcaacttatcttttccactgcaggtagatctggttgtcatcaatctgcaatgcctttgaacaaggcaatccagttgatttagttagctctgccgaattttattgtatctgtaatacctcatttaactgtttaacaacttgttcaatgaaacaagtacctcaatcactggagatttctcccggaatgcttcataaagaaaacatttcctaataactttttagctactgtttagcattggccttcctgcatgggaaagcttctatacagttagaaaacatgcatcaaaaatggcaattgaatgaaattcctctataaatgttcaaatggaccatcatgtagcagaaaggtacctgaagttttgattgtgtgtcttctcaggattatgggtttgtcaaaccagacattggtcataaaccattttagctatttaaaacagtcatcacatcaatttttaaaaatataatttggatcattttatctctttcatgatgagccatagagttcagaacttttaataatggaagctttaagaactcaggaaggaccaggtggtcatgcaggctgtccctgagtccatactcaacattggatttctatcctcttaaataccaattttctttctccaattcaggtgcatagcactcttcattagatgggttatcataggtaatttgacttggaccacaaagttcattcaaattgcatatcaaaacaatttcagtaccagctaatttagcatgaaaatctggcaaagtattttcttggtgctcaattaattcttttcctgcttgagttaggagttttacaaaccaatcgttagagtttgaggattcttacccagtttgaatgataaaatcctacagttatcagaaacctgtagtcaagagtgcttgtcagggtcctttgtatatttttcataaaactccttgaagacacacactttagaattttacttacttacaaagagctttcagaaaatgcatcagaattaaggaattaactgtggaaataagacttaagacagtatagttaaaaacacaattgacaaggaacttgcttatttctatggccaacaataatttaacataataaccataattatgactgataacatataccatgtgttttttgtttgtttgtttgtttattttagagagagagagagagagagagagagatgcggtcttgctatgttgcccaggttagcctcaaaactcctggcctcaaatgatcctgtcaccttggcatcccaaagtataataaaacatttacataaatataactgaaatgttaaacatcatttcttattttatgttaaacatcatttcttattttacaatgcttcccatataatttgacatattaaataagttggtttattatctcttttggctgcttttggggccctttggaacaccctaaagttagtttaaggtaaaaaaagacaattttaaagtttgaaacatgattttgggaagcctatcaagaatgtcaagggtttagaacaatcagaataggattacaggtcactagagtcactagagtaaagtaatagtcattcatttagccaaagttataattaaaaggtttttaagaagcaaacatttttactctttaagaggaaactcagttttccaatcaaaagatctaagaaagacaatatgagaatctgtctctccttctctcctttttttatttttatttttgcagtttgcttaaaaggtgaacaaaaatcttttactgtcatgttaataccacacaaaaatcttgttcaaaagagaaaaccaaattttacttttgtattagtgtattatcaataccaaagctaatttaaataatactttataaaattcattctatcttagtcaacttttgaccacacaagatttccataaacttttaataacctcttacaatttttttgtattctttcttttcatacctttctatgttcatttagttttatctatataatttttattctttcaataggaagcaacctttaaataacttctaaactagacaaatttttttcccaaatgtacatttttatgcctttataactttcataatcaaaaacatatctcgcttttcttatataccttgcatatagaattatttcttttagtttagtagttttaattacatgtgttaatttgaattttaactcttagtaaccccagtttctagtgacaagctgggaggtaattttgaactgtttaatatgactatttgtagatgaaaatcatttaataattctttagaaagatgtttccccaattttttcattattaatagatctaaatatatttatcttttctatagcatttaaaaataagatgtcaaagtacataaatgtaaacttacatttaataaacaatgtttcactattttaggttacttagaaattactcagacatcttatgattatctgttacttaatttaacatgactttaagataaattactgaaaagaattttgaaactatgacacagttaccatccctaatatcctcccctgttggcctgccacatggcacctaggattgctgcgaaggacagggctcatctggatcctaaatttacacaccacatatagagcaccagacagaggacagaactgtgtagaggatgcctggaggatttgactcctctctgcatggacaggaggcatagctgtgtcagggaggatggaaccatatcgggtttggctctcccgtgcccaggtgctgtggcgacacatatgaacccaggcttcaccacggctctctagaccccagaattgaattagaggacacccgggattttactgggactatctaggatccagaaggcatgaatcatttttctgtttctgcactcccaccctgcagctttccaggaggcacagactaggtccatatctctctgtggctctgacacattgagctccttttgttctaggagccatagacctctctgccctcctcttcttccacccagcctgggctgtctctttgtgaaccggaggagagccttctcccttcgtattctctaggacaaattggctatcctggggagattttagggtgattctggcttcagtcctgccaaattcttccccagaggcaactagcacatacctactgtaatgtcaagatatagagaagttatatgtgatagattaagacatcaaaattgcaccccagttgcacaagaattgaggtatgagcaaaaagagaatgtcctttattttaaaaaacttaacacacaacaaaaaaaagcagctgctgtctcctctctcacatggaagtaaactctgctggccccagtcactctgtggtgatactgccattggatgcgtagcatgaataactggctcattcagcatttcttccccaccacttcatttctttatcctcaagagggtcattttccctcttgttgctttttttttttttcctgccattcattgcttttgaaccagtttgcttcatctcaagccatctcattctcacatgaacacacacatcttacccaggttcttttctgcctctaacctaattataccacaaaaattctttctctggacttgtcatgaacttaaaagtggccctaattataaatgatgggcataaggatgctctaatgacatacttcaagctaggaaaaagagagccattaagtgtgtggggaaaatgaagatattagactaacagtcatcacttgcaaagtcctccaaagtcctcagaagcctccttcagaatctttggaaaagtttctcttctacctcttcatctttctctgattgcaactgtccttcctcaagtagcattatacaagataagtaaatccaaatacccataccattttatctctgggaaggactttagagatattttatgctgagcaaactaagactcagagaagcaaagttatttgccaaagatcacatggctagccgatgttagaggatttgtacaaggcctccttcctctgcactgagtgctcattctaaaatttcatgttttcttcttatacttggatgcttaattgttgagtctgatttaattatactggcggctaatcgaatgcatccattcattcagttaatattaactgagcctctacaatgtgctagacactgttttaggcattggaggttcagaggtgaacagggtagacacagctcctgctcttgctgagctgacatacttttgggaaaaacacaaagaaaaacaactaatcaatgcagtgtataccatgaaaattgacagattgataatggaaatactcaatagtacttactgaggacaagcctctcaagtaaatgaaatttacttggcagtattttggccagatttagggttaagggatgtttgtgggctactctaaggataatacaaaaatgtattctgagttgcaaagaagaaacttagaaaatgttgggacatagtttattttataaggtaaaaatgaagcttgtttcctgatatattccttatgaggatttgaccacaggcatgacacagaaagaagagtcaataatgtagacgataacctgaaattcacaagagaatatactgtcaacattccttcaggtgtctacacacacagacacagactagcaacatagcagaattcaaaaagtattttcaaaaatcaatacatggagaaatttccataaaatttcaaatatcaataggtaaaagaaccatgagagaaatatttaccctatctttttactaaaaaggcaagactgggctacacactgtggctcgtgcctataatcccagcactttgggaagccaaggcaggaggatcacttgagcccaggagtttgagaccagtctaggaaatatagcaagaccccatcaccacacacacacacacacacacacacacacacacacacaaaaaggccaggcgtggtggctcacacctgtaatcccaaaactttgggaggccatggcaggcggatcacctgaggtcgggagtttgagaccagcctgaccaacatggagaaaccccatcctactaaaaatacaaaattagccgggcatggtggttcatgcctgtaatcccagctactcgggaggctgaggcaggagaattgtttgaacccgggaggtggaggttgcagtaagccgagatcgtgccattgcactccagcctgggcaacaagagcaaagctccatctcaaataaaataaaataaaataaaataaaataaaataaaataaaataaagtaaagtaaagtaaagtaaagtaaaataaaataaaataaataaaataaaataaatccaggtgtggtggtatgtgcctgtagttccagttactcggaggctgaggtgggaggattgcttagcacaggagttcaaggctgctgtgagctatgatcatgccattgcattccatcctggaggacagagcaagatgctgtctcaaaaaaagaaaggaagaaagaaaagcaagaaaggaagacagaaagcaagcaatcaagcaagcaagaaagaaagagagaaaggaagggagggagggaaggagggagggaggaaaggagaaaaggaaggaaggagaaaaaacaattgtttacagtggactattttcagttcattgcaagtataaagaaatacaatttatgtttgtatattaatttgtatcccacaaccttgctgaacttgctgattagttctagtggttttttagtgcattccttaggattttctatgtacaagatcatgtcatctgcaaatggcaattgttttacttctttctttccaatctgaatgcattttctttctttttctattgtactggcactgccagtacaatattgaatagaagaggtgcaagcaggtatctttgttttatccctgatcttagagagaaaacacgtagtctgtcactgtaagtatgttagtaggtgtgagttttttgtagttcctctttatcagggtgagaaaattatcttctatacgtacattgttgaatgttcctattataaaggaatgttgaattttgtcaagtcctttttctgtatctatagagatgatcatgtggttttatgttttattctattgagatgatgtattatattaattgattttcaaatattaaactaaccatgcattcctgggataaatcatacttgatcatgttgtataattatttttgcatattgctagattaggtatgcttgtattttgttgagaatattttacatccatattcataaacattggtccatagttttcctctgatgtctttgtctgattttggtgtcaaggtaatattgaccttactgaatgacttgaacgtatttttttttttgaaaagttgtgaagaattgatattaagtctctgagcatgtagtagacttcaagagttaagcaatctgtacctggactttttttgtgggtaactatgattactaattaatcttttcacttgttgtagtctcttcagattgtctatttcctctaaagtcagattcaatagtctatgttttctaggaatttgtcaatttcacctatgtcatctaatttattgggataacatttttcagagtattttataatcctttttatttctgtaatgttggcaataaagttatcacatttattgctgattctagtaattttaaccttcactcacgttttcttggtcagtctagctcaaggtttttatattttgttgatcttttcaaagaaccaactttttgttttatttactttattgtttttccattatctatttcattaatgctcactcttatccttataattttctttcttttgcgtgctttgggtttagtgtgccgttttttccccctgtgtcttaaggtgggaggataggttattgatttgagatctttcttctttcttgatatgggcatttctaaatataagtttccctctaggcatgactttagctgcatcccataaattttgatatgttgtgtcttcattttataaacactttatctccaagtgttttccaattttgcttttgatttcttctttgacccatttattaatttctacattttaaattcttttcccagattgctgttattgatttcttttttctctctttctttctttcttttttttttttttttgagatggagtttcactcttgttgcccaggctggagtgcaatggcgcgatctcgactcgctgcaacctctgcctcccaggttcaagcgattctcctgcatcagcctcctgagtagctgggattacaggaaactgtcacctcacccagctaatttttgtatttttagtagagatggggtttcaccacattggccaggctggtcttgaacttctgacctcaggtgatctgctcgcctcagactcctgaagtgctgggattacaggtgtgagccaccgtgcccagccgctgttgttgatttctaatttcattccactgtagtcaaagaatatattttctgttatatctatccctttaaatttattgaggtttttatggtctagtatatggtctatcctggaaaatattccatgcgtactgaagagagtgtatattctgctctctttggaagtgttctatcagtgtctgttagatgtagttcgtttacagtgttgtttgagttttctattttcttgttgatctctgtctagtttttctgttcattatttaaagtggagtattgaaattttcaaccattgttgaaatatctatttctccctttatttctgcaatttttacttcacgtattttggtgctctgttactaggtgcatatatgtttataattattttgtatttccgatggatccaatcttttatcactgaaaaaggtccctttttttctctaataatattttttaacatctgtcttgtctgatattagtatagtcacttcagctttattatggttgatggttgcataacgtcctttttcatccttttgctttcaacctatttgtgtatttgattctaaactgtttcctgtgaacaatagatagttaaaacatttttttaaatccagtctgacagtctcttccctttgaatggattgttttatctatttacattgatatgattggatttacatctgccattttactttttttatgtgtttttttttgcactaaatgaatattttttaatgtagcatttaaatttctttaatgatttgttttaccctgaaacctccgcctcccaggttcaagcgattctcgtgcctcagcctccagagtagctgggattacaggcgcacaacaccatgccaagctaatttttgtgtttttagtggagatggggttttaccatgttggccaggctggtctccaactcctgaccttaagtgatcctcccaccttggtctcccaaagtgctgggattacaggcatgagccaccacacccagcctgttttacttgttaaaagttatttcttagtggttgctctaggacttaacatatactatcttatcagaatcagcttcaggttcatactaacaatttcagtgagatacagatgttactcctatctagctctattcccctttctccctttttgtggcattatttttatacatattacatctataaatgtttaaactcaacaatacattgtaataattattactttatataactttatcttctaaagaagataaggaaggaaaactattgaatatttatagcttttgttatattaaccttcttatttatcatttctggttctcttaatttgttcttctggatggaagttatcatctgaagtaatttacttagctcagtgagcttaatggaaaccttcaggaaagttgtagaacataaaatgtataatatatgagcacttagaaaataaactgacatttgtggaacattatagattgtactaggggctttatacagtcatgctgcataacaacattttggtcaaggacagaccatatacacaatgatgatcccataaggttataatgaagctgaaaaatttccttcacctagtgacattgtagctgttgtaacgtcacagttcaatgccttacttacatgtttgtagtgatgctggtgtaaacagatcagatctactgtgtttccagtcatatcaaagtatagcacatacaattatgtatagtacatagtacttgataatgataatgactatgttactgctttatgtattttctatactattctttttaatcattattttagagtatattccttctacttgtatataaaaaagttaactgtaaagcagcatcagggtggtccttccagaagaaggccttgttatcataggaggtgacagctctgtgcattttattcccccctgaagaccttacagtgggacaaaatgtggagggggaagacagagattctgatgatcctgaccttgtgtaggcctaggctaacatgtgtgtttgtgtcttcatttttaacaaaaaagttcaaaaagttaaaaaaaataaaattttttaagtaaaaagcttatagaataaagatataaagaaagataatatttatgtatagttgtacaatgtttgtgttttaaaattaatgttattacaagagtcaaaaagtttaaaaaattaaaaatttataaagtaaaaagttatagtaggctacagttaattattgaagaaatagattttaaaaataaatgtagtgcagactaagtatacagtgtttataaattcagcagtagtgtccagtgatgtcctaggccttcacatccactcacagactcacccagagcaactttgagtcccgcaagatccattcatggtaaatgccctacacagttatatcatcttttatcttttttactgtatttttactgtaccttttctgtttagatacacaaatacttaccattgtgttataactgcttacagtattcagtacagtaatattctgtgtaggtttatggcctaggagcaaaaggctacaccatataagctaggtgtgtagtaggctacaccatctaggtttatgtaagtacactctgtgatgttcacacaatgacaaaatcaccttatgatgcatttcttagaatttatccctattgttaagtgatgcatgactgtatatgtttagcatgtaatcctaaaagtacttctaaatggctaactttaacttctgctagttagccatttaagatatgaggaaactaaagctttaagacttgatgcagctcttttctgatcatctgtactattacactttaccaaatatgttttaatctctctcacttctctgaaccagcatgtgctgattcttcctcctggaacttgctttgctgctgcagtcaaactctattgtccttcagaatggagctcaactgtcactccctggagaagcattccttgatctttcagtccatgtggaaaattgttaattgtctataatatttaggtcaaaagaaatatggaaagtaaaactgcattcagagtagctgctcgacaaatatttgtggaaccaatggcacatatcgtatatttaaagtgttggctcaactgtgtagttgttaagactctctgggttggaagtgattgaaatgcaactcaaaattgcttaagcaaaaaaggagagattattggatcttaagctcaaaaggtcaggggtggctggcttcatatggccacattttggttctcaaatgatgtatagttagttaaacctacctggaggcagatttcagctcaatgtaatgatgaattatttttaaccattagagagtcttaccaatgagaagtatgtggttataatagcaagagttttatttttgttttagtttgaagtacccccgaagctaaccctgagctgaggatttgggagccaatacagtagtctcttccatccaagggttcactttccacagcttcagttaccaggataactgtggtccataaatattgaggagaaaatttcagaaataaacaatcccaaattttaaatctcatactgtcttgtaatgtgagtaagccctcagtccagcatatccacactgtatacactacctccccttagtcacttaggaatcagcttggttatcagatagactttctcagtatcacagtgtttctattcaagtcacccttttttacttactaatgtccccaaagcacaagagttgtgatgatggcatattgttataattgtcttattagaagtaattgttgttaatctcttattgtgcctaattatagatatgtctgtataggaaaaaatacagtatatatagggtttggtactatttgcagtttcaggcatccactgggggtctcataacatatctccataagggaggactactgtagtttaggaggtaaagagggatcatggggagaagcatgaagaagagtgacagagaagcaacacagccaagaaagggcactttacaagccagccatcagtgtggatgactggtgcttagtcccagtggagaacctctgggaacagtgtaagccatacagctcaaggccatcccactcaagggtcgagggagcagggtctttacatactagccctgatagttagttgccaagggctgctcccagggagcatttgttccctggcatttcaggcctaccttcttggtgggaaggcaggctgcggcaggaggagaaaagcaaggaaatgcagatggtggtggttgggagttgggttggagtgcactgaaatggtaggggtgaggagatctgcttgaggggaggctctgacagcacctactgtacatttgttgagcactttatgatgtgccaggtgcttggcacacattatcctgtttgtttctcagtgcaacccaatcaagtaaatattattttactcatcttatacatgtagaaaccaaggcccccagaagataggtaacttatggtacagctaaaatgaggcaaggttcaaggtcaaacccaagtttgcctcattctatattacatgattattctataatgtcattgttgtagtcagggttctccagagagacacactgatggtatatatacagagataatatgaaaaggaatctgttaggggaattgactcatctgattacagaagctgagaaatcccatgatagactgtctgcgaactggaaaaccagaagagctggtacaggggttcagtccagactgaagacctcaaccagggaagttgagggtgtaactcttaatgagaggttgaagagcctggggtgggggggtgggagggtgtggtggggtggtgtgaatccttgagtccaaaggccagacaacctgaagttgtgatgcccaagggcaggaaaaaaaagggcatcctttctctgagagagagagaattcacccttcttctgctttcttgttctgtctgggcccccatatgattggatggtgcctgtccacattgaggttggctctttcccattcagtccactgactcacaagccgatctctggaaacaccctcggagacacacctggagctgtccaatcattctagtcaaaagcaaaaccacctgggcttccctttcagcagaagagggaagggctcattgcctactgaaacactgagaataatgaacacctcaccaggtatctgtgtatcccctaatccattcaggttgacaccacaaatcaaccatcagtgccaccgttgctgcctcttaagctgctaatactaagctgagagtacataacaaaccagcaggagtgttctagagggtttggggtttggggatatgaattcaacccccccacccaccaaccaccaacattaagcagccacaaaggagtggcatgaaggcagaatgtgggcagaaactggggagacaaacttcgtcctttgctgaagtgccagagagggtggcagaaagaagtgtgaccttgtttgtgagctgattataggtgtcagatcctggggtctgggtccagcccatgctgaagttcgagggagtgggtggatgggcagaaagaacacttgaggggccgtaggcagatgaaatgtagttttattcagcaactttctcatcaacagttttctcactagcagcttactttgacattgtttgccctgtctcggctgcttgagccggccgcccccacacacagctgcgtggctggctcacccctgccttcaggatcaccagcttaactctttctctctctgggcatgagcaagctgagctgtgtcctggctccttcctgtccttctgcaaggcggaaagctttggctctctctctttctctgggcgtcagtgcacccgtcatgttaagccatgttgagcagagccaagccccaaaagccccatgcacagtgtcagcaggacagttataccttttacagacaatagtgatgtagggccaagggatggccttcccatgttatggctacatggctgtggtaacaagtggagttatatgcctgcactctaaactcggtaagtcatacaggatatcaacatcctaccgtggcctatccttgaccaaagcaccgccatgctccttataaaaggtatatctgtctgctttagggctgttggatgccaggtcccagaggaacttttttctgagactgtgcttatggagcccaagaaggacaaggaggaaagtctgggctttagcaagacaggagtgaaggagcaatccccatggagaagggctaggtcccggaggcggcttagagaatggggtggaacatcatgcctgcctagcttatgaaggccccaaatgagaagggatagctattgtcaagggactaagtttctaggtttccctggacacacattcttgacaacagtttgttgggcataaagaagaccagcttcagacagacctacgcttccatctgagcttggttgtttacagctgcactaggttgaaagcatctgccttggaacctgcggatgtgaccttatttggaaatagggtccctacaggtgcatcaaattaagatgaggtcacacaggactagggtgtgccctgatccaatgaccggtgtccttagaaatgagggaaatttggacacagagatggtgctggggttggggggtgaccatgtgaagacagaggcagaggttggagttatgccactataaccaagatatacccaggattgctggcaactgtggacagttagaagggacaaggaaggattcttccctggatgtttctgagaggttggccctgctgacaccttgattttaaacttgtagcctccagaactgtgagaataaatttgaattgttttcagtagcccagtttgtggtatactgtttttctttttttcttaattgaaacaaatatactatgtgatgaaaatttctctgagcctcagtttcttcctttacaaactggagataaaagcggacacatgtaatagggttctctaaggcccctggttcaataaatgtgagttcccttcaaggagatgcagagggaaggggtgcctcacagtgagcctgcccatgaccctgtgctactctcagggctgtgtgaacagccagcagctcctgagaaaattagctgtggtctgctgatgtgaacatttttctcttttcactgctgtggctcccttctggctctttctttccagagaaagctgtctggggtcccaaattgctcctggaagccaggccggttttagctgatgctaaatggattgctgcccataggagagctgctgtctgatgtcagagacggctgggcactaattaaggggttactgtgtttacaggaagagggggaaataaatgtgaagactgcagtgcttcactgctgttttaatagggcagaggccaactatgacaccttttatctgagagggtggcagttcgggctgctcacagccactcaggtccctcaagtgtctgcggcaagcaaggcctgaggcccaagaggggtggtctctctcactttctctgttccctcagctcctcatcttttccccattttactttgttataggaggaggaaacaagaagtgagggaacgtctggctggttaaatagatacacttagaaagaagccacgtttccagtctttagcctggctgctcctgatcccctgcaatactgctgttgatatttggaactgataaatcagtttttctaaacaggtcctacgagactgcttggattttggagggacaggaaattaaagagccttgggggtgaggcagggtgggctatcagcctgctctcccacactgtccccttgccagacagcagctatgataggagaaagcaaatggagggacagaggagaaagcttgagcagatatttggccaaatatcatcgccaaagatccaggccggccccatccaggactgacaactgtgacacaggaactgattggccagagtttctagtttaaagctggctgcaaatcagaatctcatttctttctgccagactctcagccaggagcttaattagctagaagggtcaaaaggactgaacttccacactgtaatcctgacctatagttcctaactctggaagccttttggggtactccagccctggatatctaacaaagagcttcaggttcaaagggacatgggacaaggaggactgggaggcatgctgggggtgtgggaggtgccacccccagggaaaagcagctgccagcaggacacagtccttgcaaagggctctgactaggaaagcaacctggtggcttgtttacattcaactgaaatcagactaaaaaattaattgcagcaaggttcccaaaaatgtttctacttttttccatgaaggaggactgaaagctcagcaagaattaaaatggtatctcttatagctaccacttattaagtgctcttcacagctgcaagtctgcatacactttgtatattccttacaagaatcctgcaatgtatgtgtgattattcctactggatagatgaggaaactgagctcaaagatggtaattaaggtggtcaagagcacacaataagtacgtggaagagcctggaatcaaatttaatctttttctatgacccctatgctttctgctctctcagtgttctagttatctattgctgcataataagccacccccaaagtcggtggagtcagtcagcaaccattttattatgttcatgcttctgtggggaaggatttaggcagtgcactcatctctgcttcacaatgactggggccttagctggggtggccccaagaactaggagagctagctcaactagggccgtctgtcaagggcttcagttatactttctgctgagttcctccatttttcctcacattgcatctgctgatgtccaaagtggtaccctcacatatcaggtgcttggatttaaatggctggaacagcatctctttctctgtctaccaagcctctccacatggctagcttgggcttccacatatcaggagggtcttaggatagtcagactttttacatggtgactggctttccccagaccaaccaaaagagacagaaattagaagcttccagtttcttaactactgacaccagcaacaggcacagtatcacttttgctgtatcacattgaacaaatgagccacagagcctgtcagagtgatagcttgtcagactcacggccacagagcctgtcagattcccttagatgcgctgtgaacatcacctctgctctttaccaggcaccctgcaatgaaggagcttttcactcaaattacggtgttttgccgataatgataatgattcaattttgtctcaatttttagatttacaaatagcttccagctatttctctgatatgagcttcacaataggtctttaagacaagcagaacagattgtactaccctcactttaaggaaaccaagctttcaaacagcaaaaaggcccaccaggttatatggagggtaaactcccagcccacctgactccatgaagctcggctagctgcggttaagagctctctctgccgtacccctgctctgttaatgtgctctaatttgctgtatattattattctgcagctcttaagaaaactcatttccagagggctttcaaattaatagctctgttaataaaacatagggctagaaataactttatttcactgattttaatgatgaagaaagacgtgttttacttctactgaagttaaacatctatttttttagttgaagtaaaattcacatgacataaaattaaccacgttaaagtgtgcatttccgtggcatttagtacattcagagtgttgtgcaaccatcctctccatctagttccaaaacattctcatcatcccaaaggcccagtgttttacaaaacaaaatttatataatattcaccttctacttagaacaaaatgctttgtagataattattaatgtttggttctattaaaataaaataagctcagtctttggactcaggctaacttagatttaaatcacagctcttcagttttctaaccatgtgactttcagcaaggtatttagctaagcctggtttctcattcctcatacgaagaaataatgatgtctacttagatgggaaattgtggggaccagtgagataatggacttcaagcacctcttacagtgcctagttcttagtgtttgcttaagtgaaggtaggtgttattcatagtattaatgaccagaaatgtgttataggacctttggaaaaccatcatagccctctgggcctcagatccccaagtggaaactgaaagtatggccctaaacaacttctaagctctgatatttaagatgatgaaatatcttgcaggtttattctccattccaatgtttaaaaagcctcctgccaatttcctgttttccccacccctgacacacacacacacacacacacacacacaccacatacacacaaaaaatcctatttccatcctcattctgatgactttatttttaacagctttattgaagtatacttgacaacaaaaaactgcatgtattttacatatttgacatatgtataaacctataaaagcatcaccataattttgataatgaggatcttgctatccctgcaggtttcttgtgacccctttgtaatagtctctcccatctctccccactcctcagttaatagattgttgtgatgtgctcatatttgtcatttttgttgtccaacatttgcagagacatgggttccatagggcaggactatgtatattttgcttattgttgtatccctagcaactgtacaatacaagaaaacagaggttgctcaacaaatatttgttaaataaatgaataacccctctgttcctttacttttgatgcagtgatactttagcttttttctctgtctgctgtggtgatcaatgcctagacaggagggagctctaggggctggcatggttgggaaagtttcacaaagggagaaaattgctttgaggctctgatgatgaaaagggtttgttgaggaaggcaaagctaatggcttaagcacaggccaggaaggaatctgggaaagatgcaaaagtaaggattggatcagaggtaatatagtgactgacatagctgacaagtggcaaggattagacccctggaagtgagggaaactgaagcctttctgaaataggaaaacaaaaataaaaacaaagcaagagctgctggtaccttggctgggagtcataagatattagaattggcatggagattcaagattagacaaatacccttataatgcaaatggaaaagatgaagtccagagaagtgaaatgaatttctccaggtcccatagtagactagtgggagaatcaggaagaatccagtttcttattgcccactgggcttcattcattcatcttttaatgcttatttatttaattaattgattgagctctgacaatatgcaagtactatgctaggcactgggattacagagatcaaacatcgtttctgggctgggcatggtagctcatgcctggaatcccagcactttgggaggccgaggcaggcggatcacttgaggtcagaagttcgagacctgactagccaacatggtaaagctccagctctactaaaaatacaaaagttagccaggcttggcggcgcacacctgtaatcccagctacttgggaggctgaggcaggagaattgcttgaacttgggaggcggaggttgcagtgagccgagatcatgccactgcactccagcctgggccacagagtgagactccatctcaaaaacaacaacaacaacaaaactatatatagttcctttgaatgagctcatgatgtagtgaaaaaagggttaattatacactgtttaaaatacaatgcgattgataatcataggtagagcccaatgttttcgtgaggaaccatggattcaccaagaaggtcttctcagggagggatgtctgaactgtgttgcagggtgaataggaaggaacaacaagtagtagagagagaacatttagagcattagaaagagcacatgccaagaaacccaaaatacattggagaacttccactgattcaagatgatagcaggccgccgggtgtggtgtctcaagcctgtaatatcagcactttaggcgggcagatcatctgaggtcaggagtttgcgatcagcctggccaacctggtgaaaccctgtctctgctaaaatacaaaaaaaaaatagcttggtgtggtggcgggcacctgtaatcccaactactcaggaggctgaggcaggagaatcgctggaacccagcaggtggaggctgcagtcagccgagattgcctcattgcactccagcctggaggttgcagtgggccgagatcccgccactgcactccagcctgggtgacagagtgagactctgtctcaaaaaaaaaaaaaaaaaaaaaaaaagatgatgatggaggggaggctgagtacagtctagccatgaagggccctatacattaaggagtttgaccttttctcttaaagccatggaaaatctttgaaggattttgcttgagggctatgatgggatttgcctttaaggaagtttgctggttcaggagcatgaggaagagtggaggcagtcatgctggaagttgggggagagaggtggtggaatcatacctccatggaatgatctttctgaaatgcacatctgaccagtcacttccctgtttaaattttccagcagctccctgttctctataaaagccagtccaatctggggcttgacccacaagccatttcataatcctagcctcactgacttttctagaattttctactgcttcttacccatggcctccttccctatgcccccttatcctaagacccagctctactgctatttactgttctactaaagtaccaagactttttagtcttccatgcctttgcacttgctcttccctctttctagaatgatcacatctgtcttttctgctggcagaaccttcttattgccttctccaaggctccattcaagtgtcttctcccctgagaagccccttctgactgcgttaggaagatttcaccactgtttaggtaatgttcccatttaatctagtttctgtcttagtaaaaagcatttgcaatgctatagtgtaattgtgtacatgtcaacttattagattggaagcttcttgaggtcaaggatattttcatctctggaatccccaagcttcctgggctttacccccaggccagtgaatgggtctctggggtgcctaggcatctgaatttttaacaagtgcccctcaaatgattgaaggaagggaccaggacctgatgggtattataggaggacacccatataagatcctgactctccccgccccatctgaattctgtcccaccaaaattcatacattgaagtgtcaacctctgagtaccccagcatttgactatatttggataggacctttcaagaggtgattaagttgaaatgaaatctttagggtgggctccaattcaacctgacaggtgttcttataataagagaaaatgtggacacatacaaagagacaccagggttgcacccataaatgaaagaccatatgaggacacagtgagaaggcagccatgtgaaggccggggagaaaggccacagaaggaaccaaccctgccaacaatttgatcttggattttccagcctccagaactataggaaaagaaattgcagttgtttaaggtacccagtctgtggtactttatcatagcagccctggcgaactaatacaccattgcagctctgtcccacaggctggaatgcttgggatttgctctgtatctgctcaagacagtcattttctgatacacagtgggagttattagtttcctcaagatgtgttgcttataagggaattcgttttgagagacatatctaggactgctgggctgcagagagagtgagggtactttagccattcagtcatgcattttctcctcctccccagctacactcagaggatataaaaaaaccatctggcagatgagggccctggcggttaccatggtgaggcagagcagagccggggagactggggtatgtatcgctgtccctgacacttgagcccagtgaaatgtcagcctggcttgcgttcattttggataatatttttatctgactttttttcccccagctaagttatttaaaagacttgtgtaggtccagttctgatcactggatgttttcacctacagaaaaagctctttgagaataaggactaaatgccttcctattttattccctctttctggcgtcttgtctacccctcccgctatcccccacattccctgcagaattaaaccagtgtctattactgagttgatattcaagaagtatttgataggttgagttgaattaattaacctttggagaaactcttgttttcatgtttgcttctgatttttaaagccactgacaattaccttcactgggagtgtctagttaattcaagtggcaagttccagtatgtgatatatagctgccatcagggttgagacctgtgagcaaggtgcaggggtgccaggaatttagtacaagacaaaacctgagtgtcagggctctatactcagttggacttgggtttgaattctgggtctgttgtcaactccttatgtgacatggggacagagacttcatttccctggcctccttcattgtcttcaaaatggggatcctaatcatacctgcttcctggggtgcctgtgaggcttaatagagatagtgtgactaaagctttgtatctggcatcaatgagtggtccataaactatagccattattgtaatactattaaaagtttttatttcagttctgcccttaattctgtgaattttggtacttgtttcccaatctctaacatttctggaaatgttctgtctcagtaaggtaatgtctgggggcaggtgtggacagccacagacctctacctcctctcaggccatccataggttctcttcgataatcatagggtgtctgaggcttctagtggcagaaatgtctggggagggcgattggctgagcatggagaggtttccgagggtaggaacctgacagccaggagaggaccaactcagaccagcttggcccagactcaggaggctgcagccgccagcagggctgtgtagggagggtggcctcattggcatgcagtacccaggctctaggaagtatgagcccgtcagggggtagcgaacagcaacgggtgttgtggaaacagctggctttgccccactgtgattctagtccactttttctttccttccttttattctaaatcttaaagagaactaccatatgatccaacagtttcactactgggtaaataaccaaaggaaatgaaactagcatattgaagagatatctgcctcctcatgtctcttgcagcactattcacaatagccaagatatgaaatcaactgaaatgtccatcaacagcaatccttatcctgttttctccccttatgtttatttccaaaagagcaaaggcttgactgcagcttcgtgtaattgcttctaaatcataatggatctattttcctttttgccaagattgaaccatggtaaatttgtaatgatttacttacaaatagagccacaggattgattataattcaagctctttcattctttagctatgtggccttaagcaagttactaatttttgcattgtctgtgagccttgattttttcctgccaaacctcattcctccagtcttttgcatctccaaaaaaggtgccaccatcaatctatttgctcaagtaagaagcctaggtaccattttgaattcctttcttccttactccaactaccatccaattcactagcgattcttactgattccaccactgaaatacaggatatctcaaaaccatgtagttctcccgcctccaccatcacctggaagaggccaccagcatctcttgccttaactttaacaccctcctcaccagttgcttgctactgtctttgtccttcctccacttataatatgtctatctcaatgccagccagagtgatcttgttagaatgtaaattagactatggactgcctctgcttacaatccttcaacctttccactgcattcagaaaaaaatccaaactccttgtcacggtctatgtatctctgctgacctttgcagcttctttcttgtccattcccttctttgctttctacattcctggcatgtgagttgtctcacattttcccagatgtttctagtttctattgcctcagagtccttacacactccaattcctctgcctgcatcagtggaccatccacttttcacattcaagggtctttcttatacttcagggctctgcttaaaatttacctcccagaaagacctttctccatttcccccatgcaatccagagtagggccccttctcctcccccggcttttctctatatttgtgaccagttagtttcccttagagcacctatccccatttgtcatcgttctctgttgtttttttgtttgtgctttccagtggaatatgaccctaatgaactacagaccctgctgagtgcctactggaatgactgcaaatacataggaggtgtccagtaaaagaaaagaaaaggaaaggaaagaaaagaaaagcctcttagcttcctttccttaacctaacagatttaaaccttccctgccttcctttggttgagcttcaccacatacctttagacttgctttaaggaatacattcctgctaaagagattcattgaatttctaccatgtgtcaagcatggtgctaataaatgtgataaatctggaaggagaaggcattctggtatagcagagagaggagcttggcttaggagtctgaaagacccggatactgccagctcctctcaaccagcacaccactggtaaaatgttacttttcttggcctcatcccctcaaaaacaaaatccaaatcttagatgtcctgcttacaggtccccacaggaacattcccataccctaacatttatcatagtaagtaataatctgcttacccttctttattttctactaaactctcgaggattattcatcttgctcactatctccctcacccccttttacacatgctgtattggaaggcttaaaatttctggagctgccttgaaatctttgagcctcacagagtcctggaggcctaactttgtgtccccctcctcttgtcagatgtgccccttgccctgcacccagtagggaagattcttctatcagccagctcagttgcattaacctggccctcaacctaaaataacaggtttcacctccctaccagcccatggaattattcaaacaacaaagtacaccctcccacaggaatcaggggccacctcacccccttgtcacaacacagcctgcctcccaaagccctgtttgttcattctgttgagtataacccctgtgtggtcctgcagggtatgcagtgccttctaccccaggctgtcagtatatgtgactaatgaactgctgtcaatcgcatgggtccaacgtcaggtgttgtgtgcttggctattctcagagtcttagggcaacactccctctttcaccagcggggcaaagaggaggcaacaaaacactcatatcctcacatgcctgcactaacatacacacaacaagaagtatgatagtgatgtaggcaaaaaatagtaacccccataggtttgcagatgaaacagactcctgttacaaaaggcagcttaacaagagaaaaacaactagaagcttattaacattcatatgtcacatatatgtgagagatacccagagaatgagtagttcttgaagaagtggctttgaattccagcttaagtagcattttcaaaaaacagtacatttttagagaagtgacaagacaaaggaaaagggctttgaatctctacagctggcaatgtgcggaaaggtaaacaaatggcagataaaggctggtttgtaaagcttgttaatataaatccctccggtatcatttccaggtggtgaaggtctaaagctgtcttcagtggttaacctgtgttcaccctggtggagaggggacaaggtatcttttgcctttgtaaatctatgttttgcttttaagcaagtggagggagggcagagagctctatcatcctggaggaagcatctgacagactcctgccttgggatgacacactcttagccacagctttcaaagccctcctgagtcctcgacagacactgcaaattgatcatggtactctttcctgctgcacctggactttgccccagaatcattctccacttgctgaatgtagtcataagagataaagcctatttctcactcggccccaaacttcccgtgatcagtgtcctgtgatgaaggaaactctgcggcttataactacatttgtagcgctcagctctgcatcccactcccagtaccggggctcagatcatccaagcttcttactggagaagaatctcactctaggaaatttttaatgttttcaatgtcattggtcatacatctcaatttttccgtaccttaatggcttctttcacagactctcagcaatgccataccatctttctgttcctctgctggttctaaactgggttagactcacatggaaacaagcaaatataattgtaaattcataattatgtgatgtggtagagagaactcaaggtttacagtcaaggtagacttccctgcctcatccttgttgagctgtgtgactgcaggcaaatcatttgtacatctctatatcttggttttctcatttgccaagtgaggacaataataatatctgtcctcccaatatcatgtatcattacatatgtaacattaatataacatataatgttacaaagtagcataaatgaataacatttaaaaagttaaacctccaaggtgtttaaaagcagcatacgggtatttcttgccactgcaagaaaaaatctgccacttttctccagggtggctgaataaatagggcagcttttccagagaggcagccatagtagacattccattatgctactgcatattcaactagagtataaaatgtgagccctcagcctggaggtgttaatgagttgccacttagaaggaccagggaagcaaattaagtgcatatgcataaagcagtcagaactgccagccctccatgctgtctggaaactgagctgctcaggccctcatcctctgttcatctcatcccctgatttagcagctgtagttggtggaccaggttcatgtgaataagaccattggcttttctgcctccacttcccagaaccatctcactccagaccctgtctaaactagtgaagttgaacacatccagtacttgggctcatcatcagagagatggaggtgggttggtcaccaagaggtaggatgcccacttcattgttgctgaaaaacatgctttaaaagcttcctaagattaatgatagttacttttctcttttaagttattttttcctatatggtttctgttttctacaaattccctgtttcactgttgattagttttggtctgcatcatttaggtagagtctttcttcaagtatctgccaatcttgggctgtcagcatgtatttaagagaaggatattaaaaagccaaccagagacttgaaagagcatgagtggggctgggggcttcatggcagaagggtcacaatcagcaacatcagtatctctgtgtcttttctctttgactggttaggttactcaaagaaggctgttctttgagtctcccatccccagctccatatctagcctggagactgccagccttctgaggacctggtggagaagggaataaggagtccttagaattcaatatgtagattttcatcaaaccttactgtttccagtacattatccctgccctacacccagaatgggggctagatggccaccaatccagagtccatttggttcactgtctccagagagtcagtttctgtattctgtttcaaggaaaggggcacttgtcagctttgagaagcaatagaggttatccaggagtctaagtgcactgtaaatagatttccaaccgatcttgtggttttcagcccccacttctgtcccatctcctcacactttcacagatccctgatgctgccaattatggagtcctggatctctaaggtccctatcagcttgcttttggcctccctcactgctggctgaggattcaatgttctgaggttgctgagtcagttgccctttatccttttgtcttccagcttcaaagatttttttttttttgcttttttttccctctcatgttctcaaaggtttatacctttaaaagaaaatccctttcaaaatatttttaatgggactgaaggatcagaagaaagacacatgtgttcaatctaccatcattaaccaaaagagagaaaataccaacacaaaaaaaagacatagagcacatgtgacgtgtgtatcttggcaagatgctgctgccagggattcagagccaaaaggagagcccaggtttcttatatcacctgttttccttaatgcaatcccacaaagtagtactattttccatatttattaagaaggaacaagtaataataagaattagtattattgactctctagtatgaccagctgtatgtcttttagggcttccctacaaaataccactgactgagtgggccttaacaacagaaatttattttctcacagttttggaggttcaaagtccaagatcaaggtgttgacaagcttggtttctcttgaggcctctctctttggcttgcagacggccatcttctactgtgtcttcatatgatcttttcttggtgcacaagtatttctggtggttctccttctgataaggacagcagtcatactggattggggtctcacccatgtgatctaatttaaccttaattactcccttaaagaccttaactccaagtacagtcaaattctgaggtatagggggttaaagactctaacatatgaattttgggcaacacacaattcagtccagaactaatctggtcattttatttccatttcttcatttatttctcacaatcagccgagggttaagtattattattattattattgttattattatatatgaggaaacttctgtttagagaacttaactaactcttagactgcacagctagaaagagattatgtattttgttttctattgctgctgcaacaaattatcacagtcttagtggcttaaaattacacaagtgtattatcttacagttatgtagttcagaagtctgaaatgggtcttactgggctaaagtcaaggggccagaaggccgcattcctctctgaaggccctcaggaacaatctgtctccttgccctttccagcttctagagattgctcgtgtttcttgactcaaggttccttcctccatcttcaaagccaatgccagcaggtcaaattcatctcacattgcatcactctgaccttttctgcttctctttgtgattataataatatattgctaatatgttatttataactattaataatatatgatataatattgtaatttaaggacctttgtgattataataggcacaccagtgtaatgcaaggtaactccctatcttaaggtcagctggttagctaccttaatcctcttttgtcatataacagaatcatcttatgttggtattaaattgtatgtttctttttctttctttctttctttctttctttctttctctttcttttttttttttttttttttttttttgagttggcgtctcgctctgtcaccaggctggagtgcagtggcacaatctcggctcgctgcaacctctgcctcctgggtccaagtgattctcctggctcagcctcctgagtagctgggactacaggtgcctgccaccatgcccagctaatttttgtatttttagtagagatgggatttcatcatgttggccaggatggcctctatctcttgaccttgtgatccacccctctcagcttcccaaagtgttgggattacaggcgtgagccaccgtgcctggcccaaattgtgtgtttcttaacgtaaacattgggagggagtttgtcctaatggaaagaggaccaatatcagagttggggtatctgtgctctacttttgatctttttcaagacatattattttatatatattctgtatctttttggattgtgtactatcttcctatagcaatggtcctcaactgtggtgattttgtctcctagaggacaattagcaatgtttgcagagattttttattattacaactgggggagaaggaaggtgctactggtatcttgtttgtagaggccaaggatgttgttcaacacactaagatgcatggataccctcccaaccccaaagaattatctgactccaaatgccagtagtgaggttgagaaacactgcccaattatggtgtggaaaattgatgttagagttgcaagcgaaaaagccagaagatgagttaggagaaaatggccacggtctaggggagagatgatggtgctttagactaacatagaggcaatggaaatagaaaagtagtgagatcttacatcaattttggagataaaagtgatctgatattgagaggaattatgtgtgggaagtgaggatggtgtcaaggatgactgccgagttgctataatgaccttctacgtaaatggagatagagttactgaaatggagacttccagaggaataatagataatacttaaaatggatcttattttatgtaaattctggtctaagtatactaacccatttaatccttataacaacccagcaagataagtgctattaacatcccctttttataaatgagaataaagaggcacagacaggtcaagtaacttgctcaggatcaccagccagtagtaagtgggttttgaatgcataaagtcaaattccagagtctatattcttaaccactacatgaatccaccttttggaagaacagatctagagagaaagatcacatctctttccatgacttcatatccttcaatcctaagatcagagtgcatggtcaatcactttaatattttcctgtgtattttaacattttccttgtgaatattcccattgtattcacaaggaaaccctccctccccccaacttgaaccagtaattttcctgctctcataccaaggtgctgaacattgctggagaagtccacagagctttggccactgttataattatgaagtcatgagcacacctgtccatggaactctccatagcagatcattcttctatttctcaagagcatgttctgtcacactttccacactgccttccccaaattcactctgctcaagtcccccactccatcctcgtgcctccacacagtctgtagataatgctgtactttatttcatcacgaaaatacaagcactgagttgatactgcttcatcctctgaacactccctacctataaaccaatctatattcccatccatagcttctttcattcccaaattagtgaaaaaggtatctttcttcccaagtaaggtaaatccgtccctcatcttgtgctcaggattccttctcattcggcctccccatggatcattctaacactgtctcaactcttcaatttctctgacttgttctacacctgcccagcacttaaaggtactcaatgctgtgttacacaatcacaaagtgctgttcttatcacagctcttgcttagttgacatcaaatgtgagagaataatattcagtcactagggtaaacctgaaccacaaacatttcagctctttggctacaaggcaattttaaattttaacctatgtctgtaagagcatttataccatgagtaaaagttgctgctttcttttccagttccagagcaatcattcaagtcaaaacttttagaagataatatacaatcatatttctttcccaggaaataatttttacaatcacaaggaggaacaagccagaggcactcttgcccttaacataggtctactctgatgttgtattttccccatcccccagtatctggccaaatgaatacatgcaggagatgaaatatggagaaagaacaaaaggactaattccacttgtgagagatgaaggaacaggagcactctcatgtttcttaggtaatgtacattctttccttcatttactcagtcattgaaaaagggttgttgaattcctaacatgagtcaggcactaaggaaagcaaatgctaaacctgcccttcaaaactagtgggggcccaatacctttataaatcatcataacacagctccacaatcccttggccacatttccaaaatccaagggactctgaaaatggaaagttgattcagaagtttacaactcttgtttgacagtaaatctggccagactgatttgaaaccttttatagacttcatacaagccgggtattcagacatatccctcaaaaatagtaatatgttaaatttatagcatgctgccccagaaccaatagggctgctatgaatattaaaattctgaatttggaaatgcttctggctgcaagattttctgtgtagggagagtacatgcctgtgtagagggactgtgatgaggaagaaacatttattgggtataaatatcatgcaaattgctttatatacattatttcacttagacctcaagacagcccagtgaattaggccttgtggtcccattgtacagatcagtaaactggacccccattagcttaaataacttgcataaagaaggggcatagtgaggagtaaaacttatatttgttgctatatgcatgctgatatataaatcaaatcatttaggtgtgacagagaaaatttggatctgagcagggttactcactaactcatattatgtcataaaagacatgaaaaagatctgcagagccatatagactcatgtttttaaaagagtcagagaggggcactcagaggatgcgggcatgcatactgttttagggctttagggaacgtatcaagaggaggtggaatttgagctgattcttaagcagtaggcaatcattttgcatgtaagctgataagcatgtttagtcttccctgcttgatggaaaacagactcctggaatgggtttctggcatctgttcttatgggagcttccccagcggattcttccttatttcactctgtgagtggagactgagctggggctcatggttatgcatgggctgtttcctctggggttaggagtgggcctctggatttgggtcctgcatactgtgcccaggtgcacaggtttttgaagctcggcacccaggctaccagccaaaagaagcgctctggggatctcataaaatggatttcatttgagtagaaagcttatttttgtcctgagtggttgtacatcaaactcctttcacatgtcttggaacaatgaaaaaggtttggcttggcctttcagggcttgtaagagcctagtttcctctgggatttacagaacactggtcttgtcctctctgggtggtataggaaaaatgcttccatcacaagtttctctggtggcacatccatttttcacctgggaggaacctacaaattgaaatgtttggctcataatgtggaatagcagaatgttgttagcgcttctgtggtggggttggttgaaaggatattgtcttcatgctaggctctgaggtgttaaatgagaaaacggaacaaacaggaaaaccaggacctggtcagactcagcctataatcactgctgagaactggaaaaggaattttcagcaggacagtcctactctggggcattccctccaggctggacaggctgagagtcagaaatgctgggctattctagaggtaccactaatgggcctgcaaccattttatccttctctctgtccaatgagggagaagaactagataatctttcaggttccctctcgtttcataattcctgtgtctgtgattccaagtttttaatttcacatggaaaatatttgttgtaaaaccaagacagtatgtgattgtttaagtgggagccaaagagaggaaactggggagagggttgtgtcagaggatcaccaagtgtaatgagtgcaacaggagaatcagacagtaaggagtcaatgtgcactgcaacccctgctcagagctaaccacactctgaggagcagctctgatctctaataattttttttttttttgagacagggtctcactctgtcacccaggctggagtgcagtggcatgatcgtggctcactgcagccttgaccttctgggctcaataaattctcccacttcagccacctgagtagctaggacaataggcccctccaaccacgtctggctttttttttttcttttagtagagactgggtttccctgtgttgcccaggcttgtcttgaactcctgggctcaagtgatcctcccagcttggcctcccaaagtgctggtgttacaggtatgagccaccacacctggcccctagtgaatttaataacctaccctgtgcctgctccatctgtcaggccagggcagagtcagcagtcagttttggctgccagcctaggataatgattacctagccaattggagattggcctttcatgtgcacctgtaatggaaaaattacagagctgtctagtttcagagctgacatctagtggagccttgttccatcccactctaagtctgtttctttcaagcgatacatgttggttaataacaacagctgaaagccaatgtggtgtctttgtggatcagcattttatcgttttgggcccaaggctttgcaaatataccgtgctctttcacaattggggataggaggggatatcaagttgtaaagggaccctaaaagcatgagggtatatactattgcatttaaaatttcatttaaaaattattaaactatgcaaataacaccatgctcatttaactgcagggcttcagtaatgttgcatctgatcatagaagtagccaatatttaaaaagtttctaaaatgcatctacttattccccaaagatatatgagtcacctccatgtgttagggcagtgctagaagctgggattacccaggtgagctggattagttctctgccctcaaggggcttatagcatcaaggggagacagatgtctaacaaaataattataatgcagtataatgcaaggtggtgggtcctgtgacagcagtaaggacaaagtgctttggaagcacaacagagaaacaacagatggattaactgaaaagtgtgtgtgtgtgtgtgtgtgtgtgtgtgtgcttgtgtataacaagggagcgttcccttggtggagataaggatgccactaagggttaaaacaattacacgtttaattgatggcaagcacgggaatgaaattctataatttcaggtgcagtggcagaattgctaagccacagaatacatattgtgatggtaagtacagaagagaggttcattcattgggcggatggttattctcacctcctatgtcacagatgctgtgagaaggctgtgctttagcagtggcaaacaggaagacatagtccctgcccttggattttacattttggttcaggagatagtccagaaataagtaaacagataaacagataaaagttgtcaattatagtcaagaaagtaagcagagagtgtggatgtaaaccgtggtcaagtttcctatgaaggaaatttcaaaagagccgcagcaggattgtgggggaggcccatgggatagggtgccagctcctggggtgaagtttaagctgagctgggaagagtaggaggggctcaccatgagaaaagtggtcagcagaacgtctggcagaaagaacagcatcagtgagggctctatgcatgaaagatgtttttggaggactgggggagactaacgaatgaggcaatgaatgaggtagtgagagaggaggagagtggtataaggaggcttcgggaggagctctgtgcatcctactctccactcccctcctgatcctgctgctcctcagccatccttcttcctacgacttcccacacattgacaacaaaatacagggtccagctagggcccatgggcctctcccaaccttgtttcctgccactcttgtccttgctccctgcccttctggacactctgtccctcttgcttttactcaaactccctaagcaggttcccataccagaaattgggcacctgctcttccctctgctggggatgctctgctcctggtcattaccaagatgtactctctctattcacttacatctttcctcaaatgtcagctcactagaaaggcctcacttgaccacccatcccgacactagagtagatacaccccatcacctgacactctgtctccttgtcccgctttgtttttttgtaatacttcatgctcactcccaggcattttaagataccttttcttgtttatctgttcatgttgccgtgtcttccactggcatatacacttcatgaagtgtacatgtcaggtcagggctggcttcatgggtgtgtgatctgtgcagttgaccagggccccatgctctgaaggacctgtgcttggattcatcctctgctattgctgtcttgagattcttaataattttgtcttttaacttgtgtgtagtaagtgaagcccaatgtagcaatggagtgtgcacagagagcatgagcagaggcagtgcactagagaatggcacacatatgcagtgtggtcgagcagcaatgcctatatgcatgggcagcctggccaactgatatgcctgcacacaccatgaggcagctgctgtgctgtggagccctgagacagtgtccaggcttggattggcagtggtgatgcaaggccagcagcagaagcagcaataggcatggctgtagaagtgagagtggctctgcatggaggaaacttcctgaacccctgatgggaggttggcttgcctatccatccatccctggagcctgcttccaaggttttacgaattcttggccaaagtgctgggacagaaattgctggtgctcagccagtaaactttgtgggcaaataataacaagataaaagtccataaattgacattgcaagaaagcatatcagggagatataattcttcagagtctgaaatccttgattttgaaaactactataacattgctttactattcactagcttagaaatagaaactaaagtggaagattattgcattcaacagaaaacactgttttcacgtgaatcttcagacgaacccattatcaataaggaagacaattttaaaatgatttttttcttataattgaagatacagtgatagaatgtataagcatgcattttgaattatatacaaatcatggagccactttccgtttcttatacaacctccataagttaaaaagccagaagaaacatttaaatacgattatgtaaattagcatttaaaattaaatgtatagacttacatgaaactcatttgtatgaagagttaaacctttttaaaaaattgttccataagaatcatcagctctagagaaaataaaatttatatttaaaaacaatttgtctgtaatttatctccatggtgtcaccacctataaaatccttttaacagctccaggaatagctgcattagcagaaagatccttctcaaaattaaaaaaaatactaaaaattatttgcaatcttgtatttatcaagaatgatttatgtctctttaattatatgtattgaaatgaagtggctaaaagtataaaacttgatgacctaataaattaatttgtaaaaaagtgagctaaacaaaaattttatgattgatcaagatgttacattaatattatttatcgtataaagttacaaaaccagaaatattattgctttcaacatgtaagtttatattgttactcactactacacttattatattttataaataatgaaatatttttaaagtggttcaagagactaagtaaaggagtatttacagaatgagcagagttaaccaacaaggaacgttaaaggagcatagattagcagcagtagggagattttaccacaattggtactgtagaagcaagaagagagacgtgttacagatcccatggagagcttgggccacagaggagggtttacctgataggatcttgtggtctagagggatgcagccatgaccagaatccatggcccaaacccctgggagtaaggggaagaaataccctgatatctctcacctctcatcttccaatctcctgttgtactttctattggctgaatgccaccaaaagctggaaggcaagggaggctgggtggtaaaagtctacaatggacagcctcctggagtatagaacagggtagaggacgacagagaaaagatcgctctgtgtgtgtgtgtgtgtgtgtgtgtgtgtgtgtctgtgtctgtgtgcgtgttgcaaactgagaacaaggacttttgtctgttaaatccactgctatatccctagcacttagaaaagtgcctgacacatggtaagtgttcaaaaaaatacctgtcaaatgaatggaagataacctcacatgtgatttagcagtgctagaggcttcctgtagatcatcattcctttcttcctcatccctcttgtgaatgcttgctcatgaatgcatcttgttccactgggaaggatctgcaggaggaacctctgaggcctcagatgtcaggtgcttatccatccacagctgccttgcagggacagaagcccagatggcttggctgtcctctttataaaaacttctgtggctcaggcagtgctctcgtggtagacccagccctcctatcttagccacagctgatggccagatcaatatgtgacacaaagtcacaaaaagtcttctgtctctgaagggggcctggcaggatgtatgctcaataggagcactctcttttgagagctggtaaattggtaaaatccttcttttgaagaagcatacctgttgggtgagcaatgaggaagtggatcttttcctgctctttcatgccttgcgctaaggactggaaatgggcagagaaaggcactaacatttgtgagaacctactatgcgccagacattttgtaattgtgagaaactacacctaacatgttgtatccatgatgtgacaagtgtgtaaagacagaaaaccagtagactaagcatggctaagtgaaaggataaaaaagatttcattgatgttattgttctgcctctgtgccagtgctagcaatcaccaatctcaatttattgtcacatgaagaaaatacttacctgtatttttgttatacataaatgcttgttccctggtgccacaaataactagcacttaaacataaatttaattctttcagcaaggcaatctttatttctgcagaaagggtgctctcaccattatttcatctgtgatgagcaccctttctgcaggaaataaagattgtcttgctgagagaattaaatttatgttcaagtgctatttctttgcagcaccagggaacaagcatttacatataacaatttgtttctgctgatgttatttgggtattgtgttaatagcagcattcctaatggctatgctagtcgccgtttcaagatataactcttctctttcctcctcattctcttctgcttttatctgccattggcaaccatgagcattgctttgtttcactgggagctctttcttctgatgaatttgtaggagtctcatgaaattttattttcatacctagtatggggtttgaggacacagctattaagtgtttacagatacattattacttcttattactttattttattgctctatttggctgtattggaataatctttgtgtcatactcgtgttataatttttagagtggtaatttagttttagctgtgtgtgtgtgtgcgtgtgtgtaactcctggaactgtagatttatgagggacaatacagtgggaaatgtgcagcctaaatcttaacaacagggcatgttgggatgggaacataaagcacacaaataatcagtacaacacttttaaacaggagttttgtgaaagtgaagttgttttaaattaccctttagaaacaggagataaagtgagggagtagaaaggcaataaaggctgaaggatgaggaaactgtctcctaatgaaattagctgaacttttagcctttgtctccaattgccaaagatggttagctattacactgagccatgtgaaattgctgacagtcaacgttttttgacctattttatccaagataattatagccttaattagcaacaacccaagcttcaaaaaagaggaataatttcttactattactattatgtttttattatataagagacacatgttttctgaagaaaaaagaaatgcagataagtgatgatatggtttggatctgtgtctcctcccaaatctcatgttgaattgtcatccccaatgttgccggaggggcctggtaggaggagaatgaattatggggtggacttcccccttgctatttctgtgatagagtgagttctcatgagatctgattctttaaaagtatgtagcacctccaccttctctctcttcctcctgttctggccatgtaagatgtgcctgtttccccttctgccatgactgtgagtttcctgaggcctcccaagccatgcttcctgtacagcctggggagccctgagccgattaaaccttttttctttataaattacccagtttcaggcattcctttatagcactgcaagaatggactaatataagtgaaaacaaaaaatggtcacatatgcatatataatattgtatttaaatatgctctttttgctgcttttttagcatttcatctttctgtttatactgcccatctgttctcacatgctatctactttatccattagagcactttccatattaatcacagttattttaaagatttgctgtaaagcaactgttgttaataggcctttagtcatgtggtgttaagctgtctgggaggggaagcattcttgggccctataattaggtctcagccctttagtgagcttgtgccttggcctgtggacttcacagtacttcatcagtttccccccacctccttgcacccacttaggtgggacagaagagctacaaagggctggagttggttagactctggaaaaaaactcaatagtttaggcttggtaaaatattttctcttgaggttaggccttgctaagaacagaatgctctggtgtatttaaaaatggttccttttccccttctccctgccagacatgaagctctagggagtttttctctgatattcactgtgagaacctggttgagcttctggaggtaaagttcacaaaagtgtggagctcctctatgaatgagtccccctggagtttttaactcatggatttgcccacagggatcctgcagtaattcatcaattacacttcaggttttcttacctcctcactggtttccatggagatttctattcaggagtttctgctctggtaaattgtgattctcgattctctgaatatgtgtgtctgtctcttcagttttggggacaggggtatgtctgtgaccccacttctctgacagatctaagaacagttgttgatttttcattttgtttgggtttttacttgttaggagagagtgatgactgccaatctcctgatcagaaatgagaagtttacatgttatttgataacttgattttttaaaatttacaatatattgtgaatatatttgataccagttaactatattttttaaagtttgatacgtatttcattgtgtggatataccataattgattaaagaactagcaaaacttaatggttaaaagcacagttgctggagtaagactacctgaattcaaattcacctcttccacttattagctggatgattgtgggcaaattagttgacctccttatgcctcagtttcctagccaacaaaatagagataatactagtacctgtgtcatggagtttttgggaggattagatgagttagtaaatatgtaaagtctgtacaatagtgcctggtacatagtgcctctatgaatgtgttagacattaagtcatcttctgctgttgggtgtttctgttgtttccagttttttactatgataaataatcctgcaatgtctctacttagatcacaatctttgttcacattcttaactgtattcttagcatatatgtctattaggacaccattttgacaagtgacagaaaatccaactcaaaagtggctcaagcaaaataaataagtaaataaatagtgctatggtctgagtattcagaccaatttccccttcaaaattcatatgctgaaatcttaatcccagtggtgatggtattgggaggtggagccttttggtgggtgattaggtcataatggtaaaacctgtatgaatgagattagtgcccttacaacagagacctcagagagttgccttgccccttccaccctgtgaggacactgcaagaagtctccatctatgaaccagaaagtgggcactcgccggataccaaatctgccagagtcttgatcttgggcttcctagcctccagaactctcagaaataatttttttaaatttatttataagttacccagttcatggtattttgttttagcaggccaaactgacaaatacagatagatactttaaaagtaaataaaagtattggctcacttaagtgcaaagtccaggactggtgctgtttgatccaggtactgaaacatttcttgcaggactcagtgcctttttatttctcagccttaccctttttcatactggatttatcctcaggctttacatggtagcaaaatggctccaagccaagtcctcctggatttgattctagctaaaagaagggacagtttctctttcttagaactggatgaaagtcctgggccatactgggtcatgagcccatccttgaatcaactactatggctggaggagtggaaagtactgaatggcttagccctggagctggagaggtatcagtccaacgcaaatcatgggaaatagtcatatagaaaggatggcttcataatctgaaatactaacaaaacaaaacaaaaaaagaaaggagaaaggacactgcgtagccagaaaataaaagaaatattaatttcttagacgaggtatttctgggtgaggaggattctggattaagacttttgatacattttgccaactttttttactccaaaaagtttgtaccaatctgctttctcattagcagtataaaacgagccattttctgggattgtagccaacaaaatatttcttgtattgtttttctcaatcgtatttcttgatatggtaggccagaagaaagtatttaatttcaatttgtagttccttgtaaattgaattgcatattggtttgatatatttgtatgtgtttattggccatgtgcatttattcttttgtaaattatggcatttcattgattctaagacaccattggttataaaacagaccattattttgtgtaccaccaagaaattttaaagaaacaaaccctctgcgactaaagtattacagaaatacttctttttttatttaatttagaagaggtttgctgattttagagatgttaaaatatagaacatatgcatccttgaatcaatgaaatatggtacttattgggctgggggcagtggcacaaccctgtaattccagcactttgggaagccaaggcaggtggatcacttgagcccaggaatttgagactggcctggtcaacatggagaaacccagtctctactaaaaatacaaacattagccgggcatggtggcacacaactgtagtcgcagctactcaggaggctgaggtgggaggctcgcttgagcccaggaggctgaggttgcagtgagctgagatcgcaccattgcactccagcctgggcaacagtgagatcctgcctcaaaaaaaaaaaaaagatacctattaatgatctcttttttattattattacacatttatcttttacttattgaatttgttagtgatttattatagatatttttccatgtttatagttccacttataattttaattatggcattttaaaaaacatactgatgtttatatttttaggaagtaaaattattaatattttcatttattgtttcaacctttgatgtaatatttatgaaggtattttccattcttagactattcaaagatttacataaatttacttcgagcatttctactatttttttttactttgtatttaatccacctagaatttatttctttttatgaaaagaaaaagtttcaaaattttgttttttcaaatggttacctgctcatacaccatttattaattaggcatcctttctccactgatttgaaagattacctttattgtgtgctcaatatttctataaaaatgggtctatttatttatttaatttttagtttttgtgggtgcatagtgcatgtatatatttgtagggtacatgagatattttgatacaggcatacaatgtataataatcacatcaggataaatggggtatccatcacctcaagcattcatcctttctttgtgttacaaacaatccatttatactcttttggttactttttaatgtacaataaattgtcattggctgtagtcaccctgttgtactatcaaatactatattttattcatttctatctaactatatttttatacccattaaccatccccacttcccccacccttttcagcctctagtaaccatcattctaccctctaactccatgagttcaatttttattaattaattaatttttgttaatttttagcttccacaaataagtgagaacacgagaagtttatctttgtgtgcctggcttatttcacttaacataatgtcctccagttccatccatattgttgcaagtgacatgttctcattcttttttatggctgaacagtattccattgtatatatatgtaccacattttaaaaaatctattcatctgttgatggacacttagattgcttccaaatcttggctattgtcaacaatgctgcaacaaacatgagagtgcagatatctatttgatatactgatttactttcttttgggtatatacccagcaataggattgctggatcatatggtagctctatttttagttttttgaggaaccgcagactgttctccatagtgggtatgctaatttacattcccaccaacagtgtatgagagagtccttgtattagtctgttttcatgctgctgataaagacatacccaagactgggcaatttataaaagaaagagatttaatggacttacagtttcacatggctggggaggcctcacaatcatggcgggaagcaagaaggagtaagtcatgtcttacatgaatggcagcaggcaaagagagagcttgtgaagggaaacttcttttgaaaccatcagatctcatgagtcttattcaccatcacgagaacagcatgagaaagacctgcccccatgattccattacctccctctgggttcttcccatgacacatgggaattgtgagagttacaattcaagatgagatttgggtggggacacagccaaaccatgtcagtccttttttctccacatccttaccaacattcattattgcctgtcttttggatataagtcattttaactgggatgaggtaatatttcattgtagttttgatttgcagtcctctgatgatcaatgagggttcagcaccctttcatatacctgtttaccatttgtatgtcttcttttgagaaagaagacttgtatgtctattcaagtcttttgcccactttttgatgggattattagattttttcccatagagttgtttgagctccttgtgtattctggttattaatcctttgtcagatgagtagtttgtagatattttctcccattctatgggctgtttcctcactttgttgatcgtttgctgtgcagaagctttttaatttgatgtgatgttccttctatatccagtttttttagagtttttatcatgaagtgattttgaattttatcaaatgtgttttcagcatcagttgaaatgatcatagggtttttgtcttttatccagttgatgggatgtgtcacactgattcatttgcggatgttgaatcatcatagcattaaatcccatttggttatgatgaatcacctttttaatgtgtggtcgaatgcagtttgctagtattttggtgagaatttctgcatcagtgttcatcagggatattgccctgtagttttccttttttggtttgtctttggttttggtttcaggttaacactggcctcatagaatgagtttgggagtgttccctcctcttctactgtattttttggaatagtttgagtaggattggtactagttcttctttcaaagtttggtaaaattcatcagtgaagtcatcaggtcccaggcttttctttgctgggagactttttattatgtcttcaattttattacttgttattagtctgttcaggttttggatttcttcgtggttcaatgttgataggtgcatatgtctagggatttttctatttcttctaggttttccaatttgttgacatataattgatcatagtaatctttaatgatactttgaatttctgtggtatcagttttaatgtctccttttccatctccagttttatttatttgagtctgctctctttttttcttagtctggctaaaggtgtgtctattttgtttatattttcaaaaaaccaactttttgttttgttgattttttttagttttttttttttcatttcagtttcatttatttctgctctgacttgtattatttcttttctcctactaattttgggattgatttgctcttgcttttctaattatttaagatgcatcattagattgtttatttgaagttaatttacttttttgatgtaggtgcttattgctgtaaactttcctcttggtactgctttcactgtatcccataggttttggtacattttgtttccagaaatttttcaatttctttcttaatttcttcattgactcactggtcattcaggagcatattgtttaaattccatgtatttgtatagtttccaaaattcctcttgttattgatttctggttttattccattgtgatgagagaagatgcttaatattatttaatttttttcaatattttaagacttgttttgtgatctaacatacagtctatccttgagaatgattcatgggctgagagaaagaatgtgtattctggagccattggttgaaatattctgtaaatatctattaggtccatttggtctatagtgcaaattaagtctgatatttcttgactttctgtctggatgatcagtccaatgctgaaagtggagtgttgaagtctccaactattattgtattggcgtctgtctttctctttagatctaataatatttgctttatatatttgggtgctccagtgttaggtgcatatatatttaaaagtattatatctttttgctgaattgaccccttgatcattatgtaataaccttctttgtctctttttatagtttttgtcttgaaatctattttgtctagtataagtatagctactcttgctcctttttggtttccattggcatggaagatcttttttcatccctttatgctaagtctgtgtgtgtctttataggtgaaacgtgtttcttgtaggcagcacatctttaggtcttatttgttatcctttcagccactctgtcttttgactggagggtttaatttatttacattcaatgttattattgaaaagtaaggacttattcctaccattttgttatttgtttgctggttgttttatggtcttctcttccttctctccttccttcctatcctcctattagtgaaagtgattttctctgttggtatgttataatttcttgctttttattttttatgtatctcttgtatgttttttcatttgcagttatcatgagacttgcaaataatataatctactattttaactgatgacaacttaatactgattgtataaacaaacaagcaagcaaaaaggaaacaaataaaaactctactctttaacttcttccccctgctttttgctttttgttgtatcttattataccgtctatgtcttgaaaagctgtcaaagttattatttttgttaggttcatcttttagtctttctgctcaagataagagtagtttacacacaccaaaattacagtgttataatattctgtgttttttttctgtgtacttactattaccaatgagtttttttaccttcagatgacctcttgttgctcattaacatatttttcttttagaccaaagaactttctttagcatttcttgtaggacaggtctgatgttgatgaagtccctcagctttggcttatctgagaaaggctttatttctcctccatgtttgaaagatattttctttggatatactattctaggaaaatggaaatgttttttcgtttggcactttaaatatgtcatgtcactctctcctgacttgtaagtttccactgagaagtatgctaccagaggtattgaaactcctttgggagttttattattaaataccttgaggtggtcttctttgggtaaaatatgcttggtgttctgtaaccttcttgtatttggatattgatatcttcctctaggttttggaagttctattattatccctttgaataaactttctatccctatttgtctcttaaaggcaaataactcttagattcacccttctgaggctattttctagatctctatgtgtgtgcttcatgctttttttttatttttaaattttgtttcctctgactgtgtattttcaaatagcctgtcttcaagctcactaattctttcctctgcttgatcaattctgcttttaaaggactctggtgcattattctgtatgtctattacatttctcaactccagaatttctgcttgattcttttaaattacttcaatctctttgttaaatttatctgctaggattctgaattccttctctgtgttatcctaactttcattgagctccctcaaaacagcaactttgaattctctaagaggtcacatatctttgtctcaaacagatctacttacaatataatgacatacctctatattcttacaccagcaccacattgttcaaattcttacagacttacaatgtattctaataccacatttcattgattctaaggttttaaaaaacattttaagatctctgatatcagaatgtctcttacaatagaaaaaaaagaattatatcacaacttaactgtgagcatttaacatttttaatagtatgtaaaaaatggtttctcttatagtcaataacactttcaattgaataagttatggggtataaaatgtttatctacctgcttaatcatcctttttagtattttggctcttatctgtttactcttccatgttaatattagaatcactttgtcaaaatattttgtaatttattgagaattgtgataaatttattaattttaaaaagtataatcttcaaaatattaaatattttcaaattcttctttaactaccgtcaataaggttttatggattttttaaaaatctagcttttacatatttttagacttttttttgagacagggcctcagtacataccccaggctgaagagcagtggtatgatcacagctcactgtagcctcaacctccagggctcaagtgatcctcctacctcagcaacccaagtagctgggactagaggcacgcaccaccacacctggctaattttttgtattttttagtagagatggggtttcaccatgtttcccaggctgatcttgaactcctgagctcaagtgatctgcccactgcagcctcccaaagtgctggcattacaggtgtgagccactgtgcccagccttttagatttttaaaatatcaactttagtttgtaatatggtttggctctgtgtccccaccgaaatctcatctctaattgtaattcccacgtgtcagggaagggacttggtgggaggtgcctggattatggaggcagtttcctccatgctgttctcatgatactgagtgagttcttacaagatctgatggtttaaaagtgtttaatagttccccctggatctctctctctcctggtgctttgtgaagaaggtgcttgcttcccctttgccttccaccttaattgtaagtttcctgaggcctccccagccatgtggaactgtgagtcaattaaatctcctttctttataaattatccagtctcaggtagttctttatagcagtgtgaaaatgaactatacagtttgtgcatatgcatcactatgaatgggatctcttttgtattatatcttctaaattgttattcatcctgcatggaaaagctgctgatttttgtttgtttgggcatatggaatttatcctgagaacttagatatcagaaaagaaatcaggaaaaagtaagaagtttattataatcaactctctttcccccaaaatgattaggtgacagaaaaaggcattaagaaaggaaattaaaataatatacaaatgctttattttagccataagtttggatcatctttgtcaagcaacattttgttggaactatatgtgactttattaagtatgtgtcttggtcacttcaggctgctataacaaaataacttacacatcacaaaatgatatctattacaattctgaggctagaagtcccaagtcaaggcaccagcacatttggtgtctagtgagggcctactttctggttcgtagagggcactttcctgctgtgccctcacatgctggaattctggggcctcttttataagggcactaatcccattcatgaaggtttccgcctccatgatctaatcacctgccaaaggccctactacttaataccatcacattggtgattaggtttcaacatatggattttgggaggatacaaatattcaggccatagcaatggagcacagaaataactatgctgggaaatttcacattgctcctgaaggtctcagtgcctttttggggtccagagacttgggctctgggtctggctcagatcaggtgagatcctacaggagacactcatatttttagagctatacttcctcatctgtaaaatgatgactttgggccaaattattctaagatttttctgccctaacattctggggactattaatgagtaataaaattgactgatgaagtttatcccctttttgtcattacctatcctcagccagcaaaaagaaacattagaagacaaggaccaagtgaaggagccagagaaacaaggtgcccatataatatataatatcaacattcaaccctcgagtacctgaatgttgtatcgcactgctggacaaagcaccagagcaggcattgtcctctggtaccaggaaccatccagtttattaccagccttttgttggtagctcttttgccccagataatgtcctatttgattttgtcttgactaagcacctgcctgtacctactgccttgtaagaaacaaaatctgaaagaaggaaaaagaaacatggtaggagcataatagctggctgtttattcactgaaggagcatttatagatcttctttctatttaggacccagaatgcaccaaataccacgagtgggacttttgtagggaccaggtataatctttcctctcaacaatgggttacagatatataaacaaacattcatgcaaaggattattttaggtgctatgatagaaatcttaattagatattgtggggatagaaaagaaagagtttaattttgcaaggatgaccaagaaaggcatagagttgctaagcctggttccattttgaaaggcagaggtggagaaggatatgtccatatagggaatggcaagagcagaggggcaggggcatgacccagcctggagaggctgcaggtctaaatataggctacagggatgggcacaggaaaaatactaaaggtatgtttaaaccgtgtttaaaacattgcggaatttacctcttagtgaagctatggcaggcttttaagcaatggggttcagtgggcaaatttacattctaaagagatcattctatcgtatgaaacctgcatgatttgagaaggtttcaatgcactgacaaggagtctagtgaagagagagctgcagtagtccaggtgagaacaaagtccacattgacatgaaaaagtggagaaagtggcatgtctatgtgatgatggattagttttctatcatggcataacaaaacatcacaaacttggtgacttaaaacggcacccatttgttagctcacaattctgtagttcagaagactgggcctgctgtgggtatgttctctggacagtgtctcacaaagttgaaaccaaagcgtcagctagagctatagctctcatctggggccagaggtccacttccaacctcattcaggctgttggcagaatttattttcttgcagttgtaggactgcagtcacaattttcctagtagctgtcccacggtagccactctaagctgctagaagctgtccctctccatctagagttctcgacatggatcttcattttcttttagagctatacttcatagctcttcattttcttcatgttggctggattgcatctctctgatttccctttctgtgaccagcctgaataaactctcttcttttaaaggacttggatgtttagattacccagataacctctttccttaaagttatctatatgatattacctaacctaatatcaggagtaaaattattcatattcacagtcccagggattatgcatggtgtgtacatggcaggaaatcttaggaagggtcctcttagaattctgccccccacaaatggtacaaaacaacaataacaagagtaaaaagtagactagatagacactgtttccaattgcatgaaggaagaagaaagaggaaaagactcagtgattttttttggctgggtggtataattaccagggtaaggaggatgaaaggacaaaggggctgggattctactttgggcttggtgaggttgacgtgtctgtgagctatgcagttagtccaggagacagtaggattaggaatacaggaaaatagttgggaaagaaatacaagatttttagttagtagcagatagatgctaggaacaccatgggactggataaaatgggttttattttaattgtgtaaacttctctgcattcctaaactatatgttccttgatggcagatctatgtgtttccatttctgtatgttgggtgccttccatatagtatgtgctcaggaatgttatggatggatgaattgttgagattatgcaggtaaaacattctaagtaaaaagttaagggctgagaacagaaccctgggcaatgtcagcatttatggaatgagcaaaggatgaagagtccatgaagggggaaaagtcaggtggaaaatcagaagagagcagtgcctgcaaaagacaggaggagagtctcaagaggaaaagctaccatgaaaacaatactgaacattttactgaacaattactctctgccaagtaacgtgtgtgaagtttacttaatcctcaaaataatcccatggtgtaggaactctttttatacagaagaggaagctggggcccagagacgtaaaatttttcctggatcacactactggtcaacaagagagatgaactctaagtcctggacacatgaccccagagccgaagctcttaaacactaaattacacaggtgttctaccccttctcccttcttgctgaagagaaaaaactcctaaccaggacaaacagaaaacccagtggaagaaatagcatttggcccttgatagatgggctgtactttagcaacggagctggaggaagcccaggtaggtttgccagatttagcaaataaaaatacaggacacacagttaaatctgaatttcagattaagattttttcttagtataaatatgtccccattatatagcatgctccaatcaggctagaatttttactctccctttttacttctacgcttcatagctcatgctcttcatctctacggcacactgtaccctttctttttgccagtcttaatgttacccatcctcgaagccccatccatattaactgtcatttgcccagcattcctacctaaaaaatacattcatatggatgacctcatttgatttacaaagcactcttgcaagtaaacatggtatgcattattaaccccttgtgcagatgagaaaacaagcttgggatgcaacatttttttttcttttttttttgagatggagtcttgctctgttgccaggctggagtgcagtggtgcgacctcacctcactgcaacctctgcctcctgggttccagggattctcctgcctcagcctcccgagtagctgggactagaggcacgtgccaccacacccagctaattttttttttttttttttttagtatttttagtagagatggggtttcaccatgttggccagatggtcttgatctcttgacctcgtgatctgcccacctcggcctcccaaagtgctgggattacaggcgtgagccactgctcctggctgggatgcaactttcacagatcattcattcatgtaactgggaccccagggtcttatgacagcaactttcattctttttccacgaattcacactgaaactaatgtcagccttccactttgattctcagtgctcaggtacctctcctttttcttgacctctcagtttggctcttgatttaaagtttactcttgttgttcaagtcttacatttccaagaacacttatgttctctcaagacaggaatccgccttgtacaactttggcccctgcccttcatacatatccagttgaaactgattaattttctccaaatcctgttaaatgatcttgaaaatcactcaggtctgagcaatcctccaagtgttccgagttcttggcagagtgtgtcaccagtacttgtgactaaaactggtattttttttttaatttcatagaatgtaaaaaattgtggtcaaatattcttccctaatatccccagcttagtgatttcttctggatagacattcccatccaccacagaaatgtccaaaacaaatagccaaggaataggcaagtttatctaatagtaatttattcttccattcttcattcaacggcacttaataacacctgcaatatgctagctattgtgttagtcagtggagatcaaagatgagagagatgcggtcctccttttctaggaattcacagtctgttggaggtgactcaactttatacaaataccagaggacaaagcacaatagataaatgacgtgaaaattcagatgtgggaggtagttatctccagcttggaaaaggaaaggataacctcagcttttaaccttgattctcctctaaaattcatacagccagtcctgatatactaatcatgtggattttagcctcagaataattactgtgattatctcaagaattttaaaaaggactaaatgctaatgtgaaaaaaaatgaaaactcaacatgagacattagaggaaattgttaagtacagtggggaaggttgagaattcccaccccctctcatctttggctcctctgctccagtgagaaatggcatacctcattctctgctttgtattcattattcttttacttataaccatcttacagaatgaatctctttctccgtctctccttctccctctcttcctccccctttatgtgatagacgtatctgtctttcatatcttatttatcctagtatacttcagaaattgcctttcttgatttgtttcttgcaatttcctgttttgtatcattcattcattattcatgccagccagtgtttgtaattgtgatttggtaattgttattcaatgaatgagtatcagcttgaataactcagctacaaaatcataatactttatatcattatttcactttctagtttcttaaatatttttgtgtgtctacttttttttttaatctcaaagactttatgacattagtcatctttatattacgtagaccacaggagagaaacttggacctatctacatttgatttggggccagcaccctctaagtctaatctcctgcctgtgtccattgcctcctgcacaacagttaataaggtgcactcaccaccactcctgccacaagcacaggcatgctgttgttgcttctattaagcttcaagacaataagctgccctctggctggtgggactatagctccataaaatgatacacttgctatactctgttctgcaccttttcccagagaaccatttctctgctcctcaccttgggagtaatacatctttctttgcttttaccaaagaacggctgttgtaatatagcttgagaccagggatttaacctgctaggaaattcaacatttatttaaggattatatttagcggaaagatgaaaaagggccctactcaaccggtatatgaaaagatgctcagtgtcactgatcactagggaaaggcaaattaatatcagaaggagatataaccttatgtctgttaggatggccattattaaaaagatggaagataacaagtgttagtaaggatgtggagagaagggaacccttgtacaccattggtgagaatgtaaattggtacagccagtgtggaaaacagtatggagttttgataaaaattgaaaacagagctcccatatgaaccagcaatcccacttctggctatatattcatgaaaataaactcagtatgtaaaatagatatttgcactcccgtgcttattgaataattatttataatagtcaagatatgaaaagaatctaagtgtctgttgacagatgaatggatagagaaattgtgggagtgtgcatacacacacacactggaatattactcagcctcaaaaaagaaggcaatcctgcaatttgtgacaacattgatgaagctggaagattttgtgctaagtgaaataagccagacacaggaagaaaaattctgtgtaatctcacttatatgtggaatcttaaaaagtcaacttcatagcagcagagcagagaatgggaggcaggtgggggtggggagcaggaagatgttggtataaagtttcagttatcttacgtagggttaataagttctagtcatctaatgtatagcctggtgactatagttaataatactgtgttatctacttgaaatgtgctaaaagaacagattttaagtggtctcaccacaccaaaaatagtgaattatctgaggggatggatatattaattatcttaactgaagtaatcatgaggtataagcatatcaaatccaattatatttcataaagctgatttttttaaagggggaactattgattattaaatgttttccatacaggttcagcactcaacataacctatcctgataatagacaaatggccagtgtctccgcattagcaatctatcgagatctctgacctagctcctcaaacagccagcccaaacctctcatgctgggtgggcagccttagctgctgaccttctcttccctccagtgggtgttggtagcgtgaaagatggcccatctaattgccactgtccctaatgtgcatgtcctcagtagtcaaactaggttagaggaaagttgcaaataattacagaaaacagacattgctctatttggtcctattgtgatctatcattatagcaaattccctgaaggaacagaggtccttgccagccccaaacagtcccctttagactcacacatcctccagctattcttacaagtatctcctcccatagattgagcctccttattgcatttgataagccaggccaccaggctgtaaacagatgagaactactggctgcacaggaacctgtgacccagatgccaccatataccaaattcaaacacagtgttgccccagtaaaatttgtaatatcacaatgattacaaaaataaaaacaaaggtcttacaaataatatccccatcaagaccccattccaaatgtttggcactgaaggctcaggggtttaggattctctaatgatttgattttgggaaagtccaccagtggcaagctctactccaacaggtcattttattgctccttgcttctaatgctattctatttccttgtattgcgagggcttctccagctccatgccaacaactgctacaacccaaggccctcctcctataggccccagcaaaccccacatctataccaaatgccttctctgacctccaccaatggaagccccttgccttttgccttccttagcgacctgaaagtcattggataccctggccatctcttgtggacacatgctcatatatttcattggtgatatattagtctccacataattctcaatttttaacagtcctcattgatgctggatcctaggtcagttttgtgctcagcaaaacttcaaaatttaaaaaggggaaacaacaactaggggtgtcactggacattgagtccaaggaactcaaacaccttgggaatatattgctgctcaggcctcacacattatagttaaaatctctcatgtctcagcttatggcaaggcccccacagaagaggcagtctttaatgaaatagatgaccaacttgctcaaatttttcaaataaattcagatattaccctatgctcttgtccttggctggatgggcttatgagatctctggttatcatagccctgggacccaagtaactttgggtcaagcatcatgacactgccatgctactggctctagcccaaacccaagtcccctaatgttatctctattccctgtcccaccactggtttcataccaagggaaatggggattgccaatggggatccataccaagagatgggcattccttctctcattggcaagatgattttattgaactgttgccccagtctgctggcaaaaattactcttcctcaatgatggctgatatttatgtatgcatattcttgtcttatcctttccagcattctactgccaacaccacaattacaggtgtcaccaaaacttagatagctctctttgtgcccccagatatcactgactctgaacagggtacacatgttgctgctcattcatttcaggtgtgggctttacttacaacacggcatcatttggaactttcatttgtcctattgtccacaggcatgtggcctaatagacagacataatggcttactcaaggaaattctcttaaaattaccaaatggataatggtctcccaaattgacctctcttttgcccactgccttagttaatctgcaatttcaagctttagagcctatgacatcccaccaacatgtaacaagagctcttcttctcccccttaaaaccacaaaagagtatgcttctcacctatgagtccgtaatatttaagcaaaattcctcttctcaattatacctctgattctgctaccccttttcaatcctggcacaatccacactagattgtcttctggatcagcagtgaatattatggaactcaccaaaaattgagaggacttgttccccaaacatgtaatactgtgtccctgaaaactctctgccaaagcttgttgtccttccctaatatgatagttttgaaggtttgctagctgtaagtccctctttgctaggaatgaaaatcttggtgccttgtcccatacctacaattgtgtggatcttccggtaagaaaaataagattttaaattagtttccaatgccaacatttctaaataggatgcatctctggctccattccattatatttattttgaatgggtgactactgcaagacccaggatcataatgaccatgactaccatcataataaataggcattccccagcatgccagcctatgccaaaagcccaaaaatatcaccatggaatatttttgtttatcttggcctggctgtgcttcatttggctcaagcctgggtctgggattctgtgactctaactcaatgtcaaataccataggcttctttctgccgatgctgtcatccctacttgtgtggggcagtcactcaatccacagcttccctgtaaaaggtactccttaacttcttaaggggcaaagggatactcatcttcaggcaaatttgtaataatttatcaaatgtatatctttgcctcaagatcttggggctagtcaagggttcatatcagaaaccctttgccccagccacactagggcccttaagggtaccatccacaggtcacttgtagtcaacagcacagacaatggccatcgtctcaggaataatgacctcagaccagcagaccaaagtgtcccaaatgataatttcagtgtgacttatagtcctaaccttgacactggtaactcgagtgatgacacaattccatggtgaacactgccaagtcaagattctgctccctgaccccttcttttctcccaaacctaaccatggttcttccatactcttgcctcatgacttacccttggccccaagtttgaatctatgcaacgtgcttactctctgctcccaacctaactgatgacaatgtcaccatagttattgtgattgcttaattacaggtgtcatccactctgcttatggagtctctgtgactccattcctctcctatacaatttctctccattcccctttcctacaagaagctaatgcttattggcaggaccttacctgcttagactataccgaagcctgaggaatgactctatacaggggtctgtctttgcctattacctaacctgctgcatcaaggaactcccatttaattatttagatttgtgcttgactcactcttttctcttttcatagggttttctcctggtatgagctatcaccctgcaaattagctgatctatacccactggtcttaccattttatttctccccttaatatctaaaacctgaatcaggattcccatctccactatccctactcttacagccacatcagctctgattccccctcatccaactatccatccttcactctccactacttcgctgtcaccatctccactccctactttcctgaacctgatggacaatatctatgtaacagtaacagggtatgtcacccgagagctaaacttccagcaacactgggcttgctaccaagggccccagcctggaccacaacttattcaactaatttctgtccctttggagatctatgatacttgtactaaatacttgtcatcttctccatcccctgtacttcccccagcactcccttgaccttcctaggtgcttcctcattaatcttcacttcaaggaccccttgccctcctcaacttcccctaccaaccaatatatccagctgtgtctcccctactccacccccactttgaaataagttggctatcacacatctgcatcggtataaatttgctcaccagaaatccccccttttaagacctttgggccactcattctcctgggacgatactcctgctcaccaggcactcatactctgctcctataccccactttcttctaacctatgtagcctggcctgtgtcctagggccacatagtagccaggtcaccctgcatccaactagagaattcacatttctcatacagccttccctcaagagggaagggtgtttttttaacctattatgttgggcctcatcacaatctttagtataacaggcataaatttaggcatttttaattctctaaaacaggctcaactcagaggagccacacagacagtgtcacactcccagaagaccacatatgtcaagaagcccaagctttagatgctgtgaataagggacaaagctctgtggttgccatggtagctgagaacagcttagcattagactatctactagcatctcaaagtggagtttgtaccttgatggaaacctcctcctgcatgtgggtcaataacacaggaacagtcttcagaagagttcaacaaataaaacaacaaagcaaaatagtcaatcttattactccaagagactccgtggattccactgatttttctggatgtctccttctgcctggggcaattgactccccactatctttcagaaagcttataataataattgctattttaataataattatgataataactattattttgagttagctttgcaaattttttctgtcaagtacaagtttgtttacgggaatccttggagtttgccgtgctaacccaaatatcatggatgaattgtgaagacaataagtaagaaataggaaaaaagcttggaaccccaactgacatttgatttagtgccagtgaagactgtctcatctcccacctgtgtctgatgactcctgtacaatgagatgtgtattctttcactgtgccctgtatgttcaggcgcagtcttactgcctcttttaaacttcctgatgggagctgtcctccaccagcaggacttcccctttacaaaagactcatgtagtcactaccctctctcttctggaccctctccaggagacccctccccttcactcctttcctttggacttccccatctatgtgagcaatcagacttccttcgattacacgaaaggactgctcttaagagttttcacatccaaagctaaccttgggagggggcttcctcatgttatgatggagttgtccttatgtatattattacagttgttttgctgaactttgaagccattctggacgactagaccctgcctgacagctaactctaatataatcactgctcttagaaacaaaattgtttatgataaacttaagcctacaaatttttagtgtgtggtggaatatgttgcagaagatttctctaactgggaatgacttttttttttttttttttttttgagacagagtcttactctgtcacccaggctggagtgcagtggtcctatcttggctcactacaacctccacctcatgggttcaagcgattctcctgcctcagcctcccaagtaactgggactacaggtgtgtgccaccacgcctggctgatttttgtatttttagtagagatggggcttcgccatgttggccagtctggtctcgaactcctgaacccaggtgatctgtctgctttggcctcccaaagttctgggattacaggcgtgagtcaccccgcccagcctgggaatgacatcttatatctgtggcagaaataacaaaagaagcttctaaactaccttaacgtggggtggggtgggtggggacgagccttgtattcgccctgaagccctgatgtgcttgtgttaggggatggccttccaggaagtcattcttactcctgctcattgtggccaaattcttgtgatcaatttgtgtaaccgtctatctcatgggagaaaatacttcagctttcttactccctgctaaatggttttgtgagtaatcaagtatataataaaaccacagtcatcagaaaactcaggtcatgacgacattctggaagataggggttgccagcagagcagaagaaccatattgctcaatcttcgctatttgcaaatttttctaaaacgcattcatctgctttcctgcaaagaaaaggtcagaatgctgaacatgattgatagtctctttatactctcctggtacaaagtaaaccatagtacttgtttctgttttagctgtgatgttacagaatcctaggatggcaaagtagtatagatagggtccagcctatgccaagaaatagtaaaataataatgaattctcctgtcctgagcatgtacatttgccaggcaatttgcatgcattatctcttaaatccttaaagtaggcctgtgaagtagctaccgtaaccaaatagtctagattgcaaatgcatttgaaaatctcttttcctttttcttttttccctagtctcaagacataaccttgaagcttactgcagaaacatttttcctcctccttagccttaaaatatagccttgatgtgtactttctttgaaacaccaagtccctccctttctcgccatacactcccttacaccatgcacatttattaataattgtatgcttgtgtctaattatgtgcttatttagaacttctaagggggccaatcttgagacagaccacgcatagagacccagctgcaagattccagagattctctcaaggaagttagtcaataacgtggccattgttgagatgatgccagccctcactccagatgccagaccgtggctccagatagccatggaacaagacacacagaccttgtactcagcacccatctcgcataatttccattgccagttcccccttttaagcccctcttcccagcctaaggtttgaagtgattacttttaataggaatccagccacttcctcatgactagttttggttaataaagtcactttctttttttgttgttgttgttttaacttttgttttaagttcaggggtacaagtacaggtttgttacataggtaaacttgtgtcatgggggcttgttgtacagattattttgtcacccaggtattaagcctatacccattagtcattttttctgatcctctccctcctcccacactctaccctctgacaggccccagtgtctgttgttctctatgtgttctcatcattcagctcccacttttacatgaggacgtgtggtatttggttttctgttccttcattaatttactaaggataatggcctccagctctatctatgaccttgcaaaggacataatctcattcctttttatggcttcgtggtattccatggtgtatatgtaccacattttctttatccaatctgtcattgatgagcattcgggttgattccatgtctttgctattgtgaatagtactgtaattaatatatgtgtgcatgtgtctttataatagaatgatttatattccttccggtatagacccggtaatggtattgctaggtcaaatggtatttctgtttctgggtctttgaggaatcaccacattgtctttccacaatggttggaccaatttacactcccaccaatagtgtataagcattcctttttctccacaaccttgccagcgtctgttatttttttgactttttaataatagctattctgactggtgttagatggtctggcattgtggttttgatttgcatttctctaatgatctgtgatgttgagtttttttttcatatgattgttggccacaggtgtttctaccataccttgctcttgctattggactctgcaagcagtgagcagttggacctgcatttggttacattactaatgccattcctattttacagaagagaaaagtgagataaatttcaatgtcatttagttggcacaagacttagctggttttaaagcccctgtcactctctgaatccaaaattattgccagtgtctctccttcctttgatgacagtgataggccaaatgatgaccctccaaagatgtctacctcctaatttccagaacctgtgactatgttaccgtacaagtcaaaagagacattacagatgcgattaatgtatggatgttgtgatggggagattattttcaggatcatctgagtgggcctaatacttataagagggagacaagaggttctgggtcagagaaggaaatgtgacaatggaagcagaggctgggctgataaagctatgagccaaagattgctctctagaggctggaaaagtcaaagagtggatgctcccctagaacttccagaggaatgctgtcttgctggcatctgaattttagccctgtaagactcatttcaaacttctgtcctccagaactgtaaaataataaacttttattgctttaagcccttaggtttctggtaatttgttacagcaccgtaggaaattaatacaatgtcctattacactttaaatggactctctgatgataccactttttatcttgcattatatactttttataattatataaattttaaatttttaagctctttttttctctatatctagcaattttttagtgcctatgttataataggcactatacaaggcactttacaaataaaggcttatttaatttttctaacaacctgtggtagagatagctagttttccacatgaaatgtgtacttcccttccatagtaaggagtggtttctagaaattggccgcccaacctgaacaatatttcttgtaagtatccctataagtttatctaggcgtggccatgtgattagtttttgccagtgaaatttgagcagagctgatgtggttagacagcatatatgcctccccaccctacctttccctttccacagcaacttagggaactatgtgttaataatggcaggaccataaagtggtccattttcaccactgtaatcttttacgagcaaggaataaacttcttttgtgtaatcttgtgatacttggggatttatctgtcgcagcagctactggtaaccatactccaactctgtgaagtataacctcatgaagtatgaaggattcacctcatgtttaatgatagtgaaactagggctcagaacaatgaagtagcttgaccaaggtcacaaatttaaaagaggcagaggcagggatgcttaaacagtgaaactagggttcagaactatgaaatagcttgaccaaggtcacaaatttaaaagtgacagaggcagaattctgactccaaagaccattgtatttgcacgatgttacatagcattttattgttcaatagtctgttgaaaatatccatttaaaaaacaataaagtctctgaatcatagatattagacctaaaaggcactttacagattatcttccctaaaatctcctacagtacttcaaagatgagaaaaaggaagcctaaaaatggcaagtggctggcccatgtgatgagacacagccaggactggaactgaagcctccttttcattacctaaattgctcctttagatgagcttgtataggagtcaactctttttcataaatggttttcaaatatttgatataagatcattcatggccataaagacagagttttctttttagaatgaaaaatggaaaaaaaatagttatctttaggaataaaaccctctgaggctattgcatataataatttatctatatattttacagatgtagatatgccatataataattacattttatatatatatacacaaaaaatacagtttttttggtttgtttgtttgtttgtttgagacagagtctcattctgtcacccaggctggagtgtagtggcctgatcttggctcactgcaacctccacctcccagattcaagcgattctcctgcctcagccttccaagcagctgggactataggcgcataccaccaggcctggctaatttttttgtatttttagtagagatggggtttcaccgtgttagccaggatggtctcaatctgaccttgtgatccatccaccttggcctcccaaagtgctgggattacaggcgtgagccatcacgcccggccagtatagttctattcttaatctcttgttctattgagatggaaatatcttcatgttataaaaataaaagtggcagagcactgaacagatggagagttaaatgaatgaactgaggattccacatcttggctgcctgaaaatatgttctactacagtaaacatatttttagcaaacaaataatggcaacccatgtgttgatctctcaccagtattctctagcttggctcatttattccctgaggatagctgaacttctttgcaagaaacagatatttcccacacttttcaagcctcgaagcgaattcgagaatgccagagaactgagtaaaactgtaaaactacacttaggattttgcactgggtgaaatgtctctagtgaaatcaggacatttgtatagaatggaccattctgatttctgctactgtcttaattcattaatttaacatggaaattctaatatgtgtgtaattttctcagaaaacccattatttaataatgacaactctgagcaaacgaggtgtgaaattttaaatatacaatgtgccatgtgttactggtagacccactgcctttgtgattctccatgttaaattttgatttcaatgcagcatcttagcatcaagaaataccaaccctgggatagaactagagggcatataacaaagagtatgcccaacttctattatctgagaattgtcttcaagctctacctgcatactaatgttattcatttgttaacagtttttctgtaaatgacttttaagttgagtcattcttaaaaattaacgactttcttgaggtataatctatgtaccatacaattcattcattttaaatataaactcagtgatttttattgaatttgctgagttattcaactataactgcattcaaattttagaacattttcattatctctgaaaaattccttgtgcccattttcactgctggttcccattgtgggccccaaacaaacaataatctactatctgtccatatgtatttgccttttcaggatatttcataaaaatggaatcatatagtatgtggtcttctgtgcctcacttcttacattccctcagagatgtccattagtctgtccaaccaaaaactggggtcaggtgaatcctgagacttttgcgggagcctgtggcaacccacaggtgaggtcgccctgcatgttccttgattacagtcagatcacagctctacaccaggtccatggagaaagaaagaactgattttgatccttctccatgttcacctatgaaaacctcattacaatgactttaacttcttttacaaagtcaaatttgaccatattctcagaactcaaccagggtcatggcctttgcagtggagtcaatccaaaggcctcactaaaccatatacagtcatccctcagtacacatgggggattggttccaggaccacctgcatttaccaaaatccatggatactcaagtcccttatgtaaactggcatggtatttgcatataacttatacacatctgcccacctctagattactagattacttctagattatctgtaatacctttgtattataatattaataataataattaatattatacaataatttatatacatatacatttatatacatattaaattattataatagtatataataattatatacataatatataattatatacataatatataattatttatatacataggaattataatacctatgtatataaatgctatgtaaatagttgttatataagtgaatattgatgaatatattgacgaacatagatgcaaatatcttcaacaacattctagcaaaccaaattcaacatcacattaaaaggatcatataccatgatcaagtgagatttatctttgagagaaaaggataatttaacatttgtaaaccaatagatatgaatacaccacattaacagaatgatcatctcaacagatacagaaaaaaattttgacaaaattcaacatcctttcatgataaaaagtcatatcaaattaggtatggaagaaatatacttcgacataataagggccatatgcgacgaagccacagtcaacatcactctcaatggtgacaactgaaatctttccctcttagatcagaaacaagacaagggtgcctgttcttgtcacttctatttaacatactactggaagtcttagcctgagcaattagacaagaaaaagaaataaaaggcattcaaattggaaagaaagaagttaaattgtctgtttacagatgatataatcttatgtaaagaaaaccctaaagactccaccataaacttttagaactaatacattcaataaaggtgcaggacacaaaatcaacatatgaaaattagtgtgtttctgtacactaagaacaaattagttgaaaatgaaattaagatatcaatcccaattacaataacatcaaaaagaataatatgtttatgaataaatttaacaaaagaggtaaaaaatctgtatactaaaaactgtaagatattgaagaaataaactatagaagtcacaaataaatggaaagatatttcatgttcatgaatcagaagaatttatgttgttaaaatgtccagactacccaaagtgatctacagatgcaatgcaattattatcaagattacaatagcatttttcacagaaatggaataataaatcctaaaatttgtgtggaaccacaaaagaccttaaatagctagtgcaaccttgagaaaaaagaacaaagtgggaggtatcacactccctgatttcaaaatatattacaaagctgtagtaatcaaaacagtatggtaatgacttagaccaatggaacagattagagagccccaaaataaactcatgtatatatggtcaaccaatctttgacaggtgaaccaataatacacaatgaggaaaggaaaatctcttcaataagtggtgttgagaaaactagatatccaccttcaaaggaatgaaattggaccccttttacaaggctgtttttatttaaaagaaaagaagaaattggacccttgcctttcaccatatacaaaaattaactcaaaatggattaaaggcttaatccattaatcttaaaatctgaaaccataaactcccagaagaaaatatagggaaaaactttctttacattggtcttggcagtgatttttggatatgacaccagcagcacagacaacaaaagaaaattaaacaagctggattatattaaactaaaaagcttttgcacagcaaaggaaacaatcaacaaaatgaaaaggcaatatattagaatgggaaaaaatatttgcgaatcatatatcttataagggactaatatccaaaatgtagaaggagctcaaacaactcaatagcaaaaacaaccaaaaaacttaattaagaaatgcgcaaagcatctaaatagacatttttccaaagaagacctaccgatgaccaagtatatgaaaaagtgctcaatatcactaatcatcagagaaatgaaaatcaaaaccacaatgagatatcacttcacacctgttatgatgggttttatcaaaaagataaaaaggccaggcatggtggctcacaactgtaatcccagcattctggaaggtggatcacctgaggtcaggagttcaagaccagcctggcccacatggtgaaaccatgtgtctaccaaaaaaatatatatataaaaaatttagctgggcatggtggcacacgtctgtaatctcagctacttgggaggctgaggtaggcagaggttgccgtgagccgagatcgcaccactgcactccagcccgggtgacagagcaagactctgtctccaaaaaaaaaaaaagattaaaaagtaacaagtgttagtgtatgaagaaaagggaacccttatacactcttcatggcacaatcattggtacaatcattgtggaaaacagtatggaggtttcttttttaaaaaatagaactaccatgtgatccagcaatcccacttttgagtacatacccaaaggaagtgaaatcagtatctcaaaaagatatctgcaccctcatgttcatttcagcattgattaatgctattgtgattacaatagcgaagattttgaaacaacctaaatgactatcagcagatagattttaaaaatgtgattacacaggcacatgcacaaacacatacacactagaatattattcagccataaaaaagtaaggaaattctgtcatttgggacaacatggatgaacctggaggacgttatgctaagtgacaaagccagatgcagaaagacaaatactatatgattttacttatatgtagaatccaaaaaaagtcaaactcatagaaacagagagtagcacagtggttaacaggggtttgggggtggggaaaatggggagatgttggtcaaaaggtaaaaagttttaagctgtaagatgagcaagttttgggaatctaatatacagcatggatggtgatggatgttttaattaatttggttgtggtaatcattgcacaatgtatccatgtatcgaataatcacattgtacaccttgaatatatacaattttgtcaattaatatatttaaataaataaacaataaataaataaaatgtgactaccagaaagttagaaaaaaaaaaagaagaagggccaaggaaaactgtcaattctgtctgtgtctgggctgggccaggatcactgtatggagtcaaagtaagctgcaggggccacttctggggaaaactcttttatcagtttttttcaagtttcagctttgcacccatacttccatcagaactgaaaaattttgatttcctggaggccaccctaagagtcatgagaataacaaggtcacatggcctagtctgcactggttatgattgggactacaatgcagctatctgatcactataggtatctgatcaaacctctgatgaaatttcctctttgattaaggaaaacattcttggcaaatgttttcttctggttcttctgggctacaagaatttcacctctagctgcacaatgccaagcatccccagttgtacctctaagcctggctccagttctgaaaaccaataaaacagagctgcagtcttattactaattgtgagctttggtatccatgtggtgtgagactgctttgaatattcttttgttttctatttgtttttaacaataaacactctgggccccatgagacactcagctaagcacattaaaaaggtcaaaaggactttgaagagtcaggaggtagaaatagtatgtttttgagcttcatccatgttgtagcatgtaccagtatttcattaagttttattgctcagcaatgttctgttgtatgtatgtgccacaatttaattatcctttcaccaactgacattgtaattactcattcaccatttggtgggtattagaattgtttccccttttgattattatgaataaagctgctatgaacatccatgtctaagtctgtgtgataaatatatgtcacatttctcttgaatatatacctggaaatacaatcactggatcatatgttttaagtttatgtttaattaaaaaaaaattccaaacattttcagtgtacttgcactattttaaattccccctaacaatgtctgaataattcagtttctctacatcctcgcagcatttgctgatattattgttttttattttagccatttttaggggtgcagtaatatttcattgtagctttaatttgtgtttctccaatgactaatgatgctgaacatcttttcacatgattatcagccatccgtacatcttctttaataagtgtctgtttaggtatttgcccaattcctaagtagactttttaaagtactgagttttgagagttctttatatattctagatagaaatacttgtcaagtgatttacaagtattttcttcaagcccataatttgtcttttatccttttagtagggtagttcgtagagcaagaatttttaattttgattatcgctgataaaaacacactaatttttcctttaatagatcaggcacttagtatcagatctgaagactcttcactcatttctaggtcccaaagattttcccctatgtttctttctaaaaggtttatagttttgcatttctcatttaaatccatgatatattttgtgttaatctttgtataaggtgtggagtttaggttggggttttttgttgttgttgttgttgttgttgttgtttgccaatacatgcctacattagtcagcttgggctgccataataaaatattgtgcagtgggtggtttaaacaacaaaaatttattttctagcagttctggaggctgaaagtttgagatcagggtgccagcatggtcaggttctggtgagagctcgcttccttggcttgcagatggccttctcactgtgtcattacatgctgaggagtaagaggtaggagagagggcgcagggagggagacagctctcccttttcttataaggccattaatcttattggattaggattccacccttataatcacatttaaccttaattacctcccaaaagcctatctcaaaatacagtcacattgtgagttacagcttcaacatatagatacggggaaaataaaattcagaccatagcaatgtccattgttcactcctgctccacgtagaaaaggctatccctcttacattgaattgctttcaaatctttgttaaaaatcagttgagcatatttgtatgggtctatttctgaattctctatgctgtttcattgatctatgtgcctttctgccaggactacatattgattactgcagctatatgttaagctttaacatggagaagactgattcttcataattttctttatcaaaataattttgggccgggcaaggcggctcacgcctctaatcccagcactttgggaggcctaggcaggcagatcacctgaggtcaggagttcaagaccagcctgaccaacatggtgaaaaccccgtctctactaagaatacaaaattagccaggcgtggtggtgcatgcctgtaatcccagctacttgggcggaagaggcaggagaattgcctgaacccgggaggtggaggttgcagtgagccgagatcgcaccattgcactccagcctggggaacaagagtgaaactccatctcaataataataatatattattattattatataattgtatgtatatttttatatattatatattataatagtagaataatactattttattattattattattttgggcgttctagggcctttttatttttatgtaaattttaaaataagcttgtgtctacaacaccatgttggggtttttataaggattgcattaaatctatagatcaatttgcagagaattgacagctttatcttgttcagttttccagtccatgaacacggttaagcatctcttaggcttctaagcaagcctaaggccttgctttgatttctttcatcagcattttgtgattttgagcatatagctcctatacatgttttgttagatttatacttaagtatttaattttctttggagcaattataaatagtatgcttttgatttcagttccatgttggcatatagaaatgtaatttattttcttgttaatcctgtgaccttgctcaattcacttattagttccaggaaggggtttttttggtggatttcttgggatttttgatttaggaaattatgtcatatttagacagagaaagtttaattccttccttttcaatctgattgccatttttttcttgtctattgtgctgcctggaacttctagtaccacattgtatgagaatagtgatactgaatatccttgccttgttctacatcatagagggaaagtattcagtttttttactgttaaatatgatgttagctgatactgatttgattatataatctgtcttcattagcctattaatatggtgaattacatctattgattttaaatattgaaccagccttgcacaagtggaataaatcccacttagttgtgatgtattattcttattacatattgctggacctgattttctaggttttttttgagacagtctcgctctgtcacccaggctggagtgcagtggcacaatcttggctcactgcaacctctgcttcctgggttcaagcgattcttgtgcttcagcctaccaagtagctgggactacaggtgcctgccaccatggctggctaacttttggatatttttagtaaagacgggttttcgccatgttggccaggctggtctcgaacccctgacctcaagtgatctgcctgcctcggcctcccaaagtgttgggattacaggcatgagccactgtgcccagccctgatttgctaaatttttaatgaggtttttgcatataagttaataagaattattggttcatagttttttttttttgtaccgtatttgcctgatttcatctcagggtagtaccaaactcataaaatgaccatgggagtgcttcctcctcttttattttctgtaacaaattgtataaaattgtattaactctttaaatgtttgatagaactatccagtaaaaccatatggtcctgaaaattttctttatggaagctttttaattacaaatacatttctttagtcgtatagggctagtcaggttatcctctctatcttggtatgttttgtaatttttgggattttgaagatttggtccatttcttctaagttgtcatatttatgatgaaaaattattcataatattttcttatgttttttaatggctgcagggtctgtagtcatagcccctatttcattcctgatattgatgattcatggttttttgatcattttatctttttcagtcttgctaaaagtttttcagttttgttgattattttcaaagaaccagttttttgtttcatttattttttcctttgttttcctgtttacaatttcatttattgcttctcttcatgattttcttccttttgatcttctttgggtttattttgctcttcttttctagtgtcttgagataggatgatatggcttgaatatgtgttcctgccaatgccaaatctcatgttgaagggtaatctccaatgttaggggtggggcctatgggaggtgattggataatgggggtggatttctcatgaatggtttattagcactatctccttggtgctgtcctcataatagtgagtgtgttctcacaagatttggtcatttaaaagtgtgtagctccctctctccctctctttcttgctcatgcttttaccacatgatatgcctgctccaccttttccttctgccatgattataagcttcctgaggcatccccagaagcagacaccgctatgcttctcatacagcctgcagaaccgtaagccaattaaactacgttttttttaaataaattacccagtctcagatacttctttacagtagtgctagaatgacctaggtattgagttgagatctttccactttactattataaatacttagtgctataaattttcctctcagcactgctttgactgcatcccccaaattttcatgtcttattattttcattcagttctactttttaatttccttttagatttcctctttgaaacatgaagtagttgtttaattttcatagatttgaataattggctgttgtctttctgtaagtgatttctagtttgattttactatgatcagagaagtatatcccttcttatttccctccatctctcctcaccctcccatactccttcctttattccaggttacaggcttctccaatgcctggaaaaaaccaagaaacttacctcaagaaatatctacctttttttttttttagatggagtctcactctgttgccaggctgaagtgcagtggcgcaacctcagctcactgcaacctccacctcctgggttcaagcgattcttctgcctcagcctcctgagtagctttgactagagtcatgtgtcaccacgcccagctaattttttgtagatttagtagagatggggtttcaccatgttggccaggctggtcttgaactcctgacttcaggactaccggcgcttgccaccatgcctagctaattttttgtatttttagtagagatggggtttcacatgttagccaggatagtctccatctctcgacctcgtgatcggcccgcctaggcctcccaaagtgctgggattacaggcatgagccacagcgcccagcccagtctaccttcttttttacacctttcagagacctttcatgattgcctgctgaattattttaagggtagttaattgtatttaaagaggaggaacagggaaaagtgtgtttatgccatctttacaattgatttttatatattgattttctccctctcctgggacttttactatctatatttgtatgcatgaggactttcttatgtctctgaggctctatcctttctcctcctccttctcctccttcttttctctttttttttttttttttgctcttgagattggataatttctactgatttatcttcaagtttgctgatttttttataagcacaaatctgctgttaaaccttctttcataaattttttatttcagttattgtacttttcaactgtagaattttcattttgtgtttttaaaataatttttatttattgacattctctatttgatgagtcagtattgtcatacttttaagtctttaaagatggtttcctgtagttctgtgtaaatatttatatgtactgctttcttggctaagtccaaaatctggaccctcagagatggaatcttttttctgctttttttcctattgatggaacacgcttttctatttctttttttttttttttgtggataacttgatattttgaaaatatattgtaacaattctgaattctgattcccccagggtatctgttgttgttgttgtttttatgaagaaagaggtttaattgactcacagttccacaagctgtacagaagcatggctgggaggccttaggaaacttacaatcatggtggcaggtgaacgagaagcaagcacgtcttaccgtggcagagcaggagagagcgtgcaaagggggaagtgccatacacttttaaaccatgagatctcatgagaactcactcactatcacaagaatagcaaaggggaaatctgcacccatgatttaatcacctcccaccaaacctcttctctgacatgtgaggatcacagtttgagttgagatttgggtggggacacagggccaagctttatcaaccaccactgcagttggcagtgttcagcagataacaagacacctgagaggtggaggcatgagaggcatcttgtctcctctagctcctcatgccttacacaacaggagagcccagtctgtttcatattaaggaagaaaacatgggaaaagctactaaacaaatgattaaaaactgaaatcaagacagctgccattacaagccatttgaaagcccccagagttgttaaatctcaggctgggaaaggagttctgttcaccgtcacttcactcattgcctcactaaattttctggttttttttttttttttatactttaagttctagggtacacgtgcaaaacgtgtgcaggtttgttacataggtatacatgtgccccattggtttgctgcacccattaacttgtcatttacattaggtatttctcctaatgctatcccttccccgtacccccccaatgacaggacccagggtgtgatgttccccaccctgtgtccaagtgttctcattgttcaattcccacctatgagtgagaacatgcggtgtttggttttccgtccttgtgatagtttgctcagagtaatggtttccagctacatccatgtccctgcaaaggacatgaactcatccttttttatggctgcatagtattccatggtgtatatgtgccacattgtcttaatccagtctgtcattgatggacatttgggttggttccaagtctttgctattgtaaatagtgctgcaataaacatacttatgcatgtgtctttatagtagcatgatttgtaatcctttgagtatatacccagtaatggaatcactgggtcaaatggtatttctagttttagatccttgaggaatcaccacactgtcttccacaatggttgaactagtttacactcccaccaacagtgtaaaagcattcctatttctccacatcctctccagcatgtgtgtcctgacgttttaatgatcgccattctaactcatgtgagatggtatctcattgtggttttgatttgcatttcgctgattgccagtgatgatgagcacttttgttggctgcataaatgtcttcttttgagaagtgtctgttcatatcctttgccccctttttgatggggttgtttttttcttgtaaatttgtttaagttctttgtagattctggatattagccctttgtcagatgggtagattgcaaaaattttctccctattatgtaggttgcctgttcgctctgatggtagtttcttttgctgtacagaggctctttagtttaattagatcccatttgtctattttggcttttgttgccattgcttttagtgttttagtcatgaagtccttacctatgcctatgtcctgaatggtattgcctaggttttcttctagggtttttgtggttttaggtttaacatttaagtcttcaatccatcttgaattaatttttgtataagatgtaaggaagggatccagtttcagctttctacatatggctacccagttttccctgttagccatatgtagggatttattaaatagggaatcctttcccgaagtcttgtttttgtcagatttgtcaaagatcagatgtttgtagatgtgtggtgttatttctgaggcctctgttctgttccattggtctatatctctgttttggtaccactaccaggctgttttggttgctgtagccttgtagtatagtttgaagtcaggtagggtgatgcctccagctttgttctttttgcttaggattgtcttggcaatgcaggctcttttttgattccatatgaactttaacagttttttccaattctgtgaagaaagtcattggtagcttgatggggaatggcactgaatccataaattaccttgggtggtatagccattttcatgattttgattcttcctatccatgagcatggaatgttcttccatttgtatgtgtcctcttttatttcattgagcagtggtttgtagttctccttgaagaggcccttcacatcccttgtaagttggattcctaggtattgtattctctttgtagcaattgtgaatgggagttcactcatgatttggccctctgtttgtctgtttttggtgtataggaatgcttgtgatttttgcaacattgattttgtatcctgagactttgctgaagttgcttatcagcttaaggagattttgggcaaacagggacaatttgacttcctcttttcctaattgaataccctttatttctttctcttgcctgattgccctggccagaacttccaacactgtgttgaataggagttgtgagagaaggcatccctgtcttgtgccagttttcaaagggaatgcttctagtttttgcccattcagtatgatattggctgtggatttgtcataaatagcgcttattattttgagatacgtttcatcaatacctagtttattgagagtttttagcatgaaagactgttgaattttgtcaaaggccttttctgcatctattgagataataatgtggtttttgtttttggttctgtttatatgattatgtttattgatttgcttatgttgaaccagccttgcatcctagggatgaagccaacttgatcatggtggataagctttttgatgtgctgctggatgtggtttgccagtattttattgaggattttcgcatcaatgtttatcagggatattggtctaaaattctctttttttgttgtgtctctgacaggctttggtatcgagatgatgctggcctcataaaataagttagggaggattccctctttttctactgattggaatagtttcagaagtaatggtgtcaactcctctgtgtacctctagtagaattttgctgttaatccgtctggtcctggactttttttggctggtaggctattaattattgcctcaattttggaacctattatttgtctattcagagattcagcttcttcctgatttagtcttgggtgggtgtatatgtccaggaatttatgcatttcttccagattttctagtttacttgcatagaggtggttatagtattttctgagggtagtttgtatttctgcgggattggtggtgatatcccctttatcattttttattgcgtctatttgattcttctctctcttcttctttattagtcttgctagcggtctatcgattttgttgatcttttcaaaaaaccagctcctggattcatggattttttgaagagttttttgtgtctctatctccttcagttctgctctgatcttagttatttcttgccttctcctagcttttgaatttgttttctcttgcttctctagttcttttaattgtgatgttaaggtgttgattttttatctttcctactttctcttgtgggcatttagtgctataaatttccctctacacactgctttaaatgtgtcccagagattctggtacgttgtgtgtttgttctcgttagtttcaaagaacatctttatttctgccttcatttcattatttacccagtagtcattcaggagcaggttgttcagtttccatgtagttgtgcagttttcagtgagtttcttaatcctgagttctaatttgattgcactgtggtctgagagacagtttgttgtgatttctgttctttcacatttgctgaggagtgcttgacttccaactatgtggtcaattttggaataattgtgatgtggtgttgagaagaatgtatattctgttaatttagagtggagagttctgaagatgtctattaggtccgcatggtgcagagctgagttcaactcctggatatccttgttaacgttctgtcttgttgatctgtctaatattgacagtggggtgttaaagtctcccattattattgcgtgggagtctaagtctctttgttggtttctaaggacttactttgtgaatctgggtgctcctgtattgggtgcatatatatttaggatagttagctcttcttggtgaattgatccctttaccattatgtaatggccttctttttctcttttgatttttgttagtttaaagtctgttttatcagagactaggatttcaagccctgcttttttttgctttccatttgcttggtagatcttcctccatccctttattttgagccaatgtgtgtctctgcacatgagaagggtctcctgaatacagcacacggatgggtcttgactctttatccaatttgccagtctgtgtcttttaattggggcatttagcccatttacatttaaggttaatattgttatgtgtgaatttgatcctgtcattatgatgttagctggttattttgctcattagttgatgcagtttcttcatagcattgatggtctttacaatttggcatgtttttgcagtggctggtaccagttgttcctttccatgtttagtgcttcctttaggagctcttgtaaggcaggcctgctggtgacaaaatctctcagcatttgcttgtctgtaaaggattttatttctccttcacttaggaagcttagtttggctggatatgaaattctggaatgaaaattcttttctttaagaatgttgaatattggcccccactctcttctggcttgtagagtttctgcccagagatctgctgttagtctgatgggcttccctttgtgagtaacccgacctttctctctggctgcccttaacatttttttccttgatttcaacttggtgaatctgacaattaattgtcttggggttgctcttctcgaagagtatctttgtggtgttctctgtatttcctgaatttgaatgttggcctgctttgctaggttcagaaagttctcctgaataatatcctgaagagtgttttccaacttggttccattctccccgtcactttcaggtacaccaatcaagcatagatttggtcttttcacatagtcccatatttcttggagcctttgttcatttctgtttactctttttttctctaaacttctcttctcactttatttcattaatttgatcttcaatcactgataccctttcttccacttgatcgaattggctattgaagcttgtgcatgtgtcatgtagttcttgtgtcatggttttcagctccatcagatcatttaaggtcttctctgcactgtttattctagttagccattcatctaatcttttttcaaggtttttagcttccttgcgatgggttcgaacatcctcctttagctcagagaagtttgttattgccgaccttctgaagcctacttctgtcagctcatcaaagtcattctccgtccagctttgttccattgctggtggggagctgcgatcctttggaggagaagaggtgctctggtttttagaatttttcagcttttctgctctggtttctccccacctttgttgttttatctgcctttggtgtttgatgttggtgatctacagatggggttttggtgtggatgtcctttttattgatgttgatgctattcctttctgtttactagttttctttctaacagtcaggtcctttagctgcaggtctgttggagtttgctggaggtccactccagaccctgtttgcctgggtatcaccagcggaggctgcggaacagcaaatattgctgcctgatccttcctctggaagcttcatcccagaggggtacctgcctgtatgaggtgtcagtcagcccctactgggaggtgtctaccagttaggctacaagggggccagggacccacttgaggaggcagtctgaccattctctgagctcaaacaccatgctgggggaactactgctctcttcagagctgtcagacaggtatttttaagtctgcagaagtttgtgctcccttttgttcaggtatgccctgcccccagaggtagagtctacagaggcagtaggccttgcggagctgcagtgggctctgcccagttcaagcttccccagccgctttgtttacctattcaagcctcagcaatggtggttgcccctcccgctgccaggctgctggccaatcttagactgctgcactagcagtgagcaaggctccatgggtgtgggacctgccaattcaggcaccagatataatcttcaggtgtgccatttgctaagaccattggaaaagtgcagtatttgggtggaagtgtcctgtttttctaggtaccatctgtcacaacttcccttggctaggaaagggaaatcccttgaccccttgtgcttcccacgtgaggcgacaccccaccctgcttcggctcaccctccatgggctgcacccactgtccaacctgtcccaatgagataagccaggcacctcagttggaaatgcagaaatcacccatcttctgcgttgatcatgctgggagctgcggactggagctgttcccatttggccatcttgtaatggaatccatttgttgttgtttttgtttgtttctttattttttgaattaattctttttttttttctttttggaagtgttgttttgctcttgttacccactctggagtgcagtggcatgatttcggctcactgcaacctctgcctcccaggttcaagcaattcctgcctcagctttccgagtagctggaattacaggtgtacaccaccgcgcacagctaatttttgtacttttagtagagacggggtttcatcgtgttggccaggctggtcttgaactcctgacctcaggtgatccacctgcctcagcctcccaaagtgctgggattagaggcgtaagccactgtgcccagacattttttgaatgaattctctggagtctgtttctctcatagtatagtctctgctggctgctcagctgctctctaaaaaattgtttaaaaaattttacatctggctttcatgggttcactgctgagttggcatagctcagtggccagccaataattcatcagaagttttgcttaaacacctttgccagggtcaaaaaggcctctaccctttgaatctcatcttatgagttatgatgagtgtataaatcagtgttcaatcacagaaacagaaccagtaagatatatctatctatctcaataaatatattaagagatttaatgcaagcgattggcttaagttattgtaggggcaggctagacaagccaaaacctgaaggacaggctatgagaagagaagcctggaaatctagggaataagctaaagcttctgtacatagaaagagtttcttcttcatcagggaagccccagttctgttcttacagcctttcaactgattgaatcaggcccactcagaagagctgggataatctccctgattcaaagtcaactgattatggactttaatcatatgtataaaataccttccacagcaacacctagatttgtgtttaattgaataactggggagtataggctagtcaaataggtaaaatagaatcacagagagccattgaatggtttaagcaaggtagtaatatgatcatgcttgctttagataaatacaccctctggtggctaggtagaggaagaaggagctggaggttcttgtaatagacaaattaaagagatattaattgcctgaattagcactataacactgagtttgaagaggagggttgaattaccataaatattttgaaagtaaatatttataaatgtatttatatataattgtaggttcagttacacagacagtgtagggttggtatatagagtaagagtaatactctgtctcacattttacattacatccgtctaccgatcatctattaacctcttggagttgccattttcttatctgtacctttttccctcaataaatacgtttttttccaagttctgacaataagccccatgctgaaagccctggttatctgaattgccttccatttatccttgtatttcctgcacaaaacaaagaccacaggaagtgagttagaatactctggaagatgagcatatctcatttccttaggagtatattgcaaaaacctgtctaccgaaaagtaacacttatggactgactaaatgcatgcccaagcttagagaagctgcaagaacaggagtaagcaatccaagaggcccaggtggcctagaatgcatcaatttgtatttatcagtaggagctctgctcctggatgaatgcaggagttgaagctgactctgcttccctgcccgtgcttctagagccttttgtgggctcctgtgttagcagtgccaatgccccagagaaatcaatcacaagacctgaatttgagtcctcctgtttctttatgtggtcctgggaggtggcaactctaaactttgggacaaaggacaatctccaactaccgctgaccttggactgctaagtttcaagggcaagatacatagaaaatgaacctgaacaaatggtttcttttcattatcagctgtgatttgaacctaatttctctgtagagctcttagtcccaatgagcagaactgggaaaatgttaaggactctctttgcacttttagcttaaggtctaggctaggaaatgcctcagaagacaaatgaagcctcccttcccctgatcccctatgttgtggtacccttgtggtgtctacttgaccttcccaggacatggataccccttccttagcctcatgagagaagagatatttccaaagccaaatgtagaagacaaaaaagggaaagctgaagatctaacattcagattccagggttgttttttttttaaatcattttccttatcacactgaaatctctgctccaaccctgagcctctatcctccttggtcttgatccaaatcagtactttagtgctccacagagacggagtcggggcgatggagggggtagtcttggcctctctctagaggctgcctttcccccaaaccctctctaactgtaactaaatctgtttgcttgtattagtggagaaattgagtttcagaaatcattatgcagttcatgtgggtgctaacatttaggtaagctgcctgacagcagagctataacaaatcattgcttattgctatgctgctctgtagagtcctgagagaaagagtctataggctgctgtgtgtccttggggcagccagagccacagcttttgcctttcagtggctttgtgcaggttgctgtcaatttttttagagggacccctctgttcaccaccaaacccagcccaacccccttctgtgaagtcttcaccgcccccattgctgctcccccagcaaaagtataatgaatcacctccctcctctgccattgctctaatagcactcttttattattgtgcttcaagcatgattgttttcattctttactgagctactgtctgcttaacactagataggttatttaagccttaaaagagattctctctgccctcacaaaagtccacagtctttagcatgactcatctgccagcctcatcttgtaccatgcctccctcactctctgttaacttaacttcaggcaatggggagccagggaatgtttcaaagcagaggagaaacccaatcatgtttgtgctttttccagatgactctggtggtaatggaggatgcaatagttgggaggaagaccggagtctaagttactgtaaagtggttcttatcatgtgaaagatgatgaggttggatccagcacgggggcagtcagaatagagaatacatatactttgattctaatatgtttagtatttttcatgtaaaaaatgccacttagatctcttaatcagcaaaacaggaaaggaattgctgtgtatggatgaaatgagataggggatgaacagcacctggcatgaagcctggcgcatagtcggtgctcaggaactgcttcttgtctgctcccttccacctgcagcaggcacagctctgggctctcatccttcttctggaggagagaagaagggagaaaagcgatgtggcagcaaaccagggcagcgacctcatcagttacaggtgaaaaagatggacctaaattgttcgagcaaatgaatgaatggccttactgctcttgcagaccagtggtatatctattcatccaagattcagattttaactaggaacagcaggaggataagtttctacagtaaagacagttgttagaattcacagagcagagaagctctttaagagacaagattcctgatagtcttttcacgaggaagaagaatattgattacaagagaaggttctatgtgtgttaggccctatgccctctcctgcctcaggagaggagaggatgccctgtgagcatcagttccatttggtgatctttttcatttctccctgtttccttcattcatggctgcttcaagccaggacaaggcaaaataaagaaattctgaccttcagcaacttctttatgctctcagaatctgctttttcaatctgtagtttagaaataatcatatttgccccacaaagtttttgttagaattgaggcagaggaaaagaagctctgcaacattatatatccaccttaaatccatgcattggctacagaggttcctccaaaaacactgaacaggttgcttaacttaaaatataattttatatatatatataaaatatatatataaaaggaaattgctaaatcaaaatgaaaaaaaaaaaagaaaagggcttctcactgcccttaaaaaagtcagcagtcgacagcataactcatctgccagcctcatcttttaccatgcctccctggctgtctgtgctttggctgtattggcctttgtcatttgtgagagatgccatgctcttgccagcctaggcctttgcacatactgtacccatgcctggcacattcttgcctcttctctccacctgaccatctcttatccctcttttagaattgatatggtttggctttgtgtccccacccaaatctcatctcaaattgtaatcgccggtgttgagagagagacctagtgggaggtggttggatcatggcggcagtttcccccatgctgttattgtgatagtgagtgggtgagttctcatgagatccgttggttttacaaggggctcttcccccttcactctcttttgactgctgcatgtaagatatgcctgcttccccttctgccatgattgtaagtttcctgaggcctccccagccatgcagaaccgtgagtcagttaaacctcctttctttataaattacccagtctctggcagttctctatagcagtgtgaaaatgggctaatacaaggatccaggttaaattcacttcagtcatttaaatcacaaatatttattgagtgcctactatgtgccaggcacttttctagacaatggggaaagtagcaaataggaaggcaaagtcctatgaatctcgtattctagcactggggagacagagggaaaacaagcaggcaatgaaggaacaagataatgctttaacggtggtattgagaggcaatacaagggtaatcagatgggtcaggccaggctctctggagggtggtggttgggtgggagagggtggtatacattagattagatcacttcttagtgatatgagctgtgagctgaaagattaaaaaaggatactcccaagagaggtagcagcaaatacaatggcctgaggcagagatgagctttgtacagtcaaagggaaaaaaggtcatggttcctagaacactgtgatggagttagagaagcataagataaatcaaagaggtgggtggagcagaacatctagggccttctaggccatgggtcagggctcagatattaagtctaaatggaagctattggagcattttaatttacacttacatttaaaaaatattaccctggatgctaaatggagaatgcctggtagaaatgacagggagaaatcacagggtggcagggagagggagagggagttaggaggagtggcaaaaacttttggatgatctgtacaggatgcaatgtggagatattggtgactcagatgatactacccttgaggggttaatatcaatatcttcatctggtagataagggaattgaagagaagtggggtacactttggaattaaatcctatagatcttgttcatggattgggtggtaaaggtgaagaaaggagatgagacaataggaagagcaaggaaggaaaacacgctggggagaaatgaagattttggcatctgctatattaaattactttcttatggaagacttccctgatccccagtcctggttagagctttacattggttgctcccagagcaatgtgtagctctcctttgtaacactccaaacattttatcatttgtcattatttgttccttcactagacctgatgggaggaacccacctttcttgtttaatgctatctctccagtgctttgcacagtacctggcatgtaattataatataatataacaaaacatattattataataatctgacatctaatataataatattaataacaaacaacacttaaagagtagtttctctgtgtcaggtcctattctgagtgctttacaggtgattttcacagcagtcccctgaaatgggtactgttatgtttgacagatatgcaaactgaggcacagagagagtaagtaaacttgaccaaggtcacacagctagcaaatgccaataagtgaatattttacaaacgatacattgtttatagttcacaccaccacagtgaggtatgtttttgtgttcctattttaggtttgagcaaagtgagacataaatctgtttgaggtgttgatactgggaagtagggttggcaggatttgaactgtccagagacaggctcactcagtttgtgaatgttgagagcgttcactgtggggccaagctgactcagtctgaaatgtgtccctgccacttactagctaggcatgtgagactttggctgaattaaatgctttgtacttcagtttcttcatctgtaaattgacactattaacagtgcttgtcttcaggaggactggatgtaatatttgaagagcccttagaatacatgtagactttatggaaaggacctacagtttgcctatagataaagccaaggaaggaaggtccactgctccccaagtcttctccacgggtcattcatcctggattaagatgttagaactaaacaatcattgtggttacggttgacactcatctaattcactgcctccgttcattatatagataaataagctggggcgtgctgcgagggtaagtgaatgagatgggacaaaatcctggggagcctcccggaaaaacatgataccttctgtatgttcgaggtttcataaagatgagttatataatctccagagctagaaaatcaggcaggccctttttgtgattgaaagaaaaaccttcctaatcatttctaagacaagctctcaattttctttgatttgggaatcaaagagaacagggaatattatgctcttcactgatgttctattttttttccttctgccaatcaaaaaggaggcctaggcagcgttgattttttttttcttttactctttcttccagacctctggtggaggtgttaataaaaagtgaatcagtcaaatcccagcttatcaggaggagacagaaaagggataaaaattcagggtagtcaagcgccacataatagggattacctattttgaagctaatttgacaataaggtgtctgaaaagccagtcttcccatttctttaaagtgctttgtctgagttgtatgcctttctgtcaggcagtgaactaactcaatgacgtcagacttcgtttctacttccaaaacataagtggtaacttacccagtccctggtccactgagcaaatctggcttcaaaaagaaactgtcctgatctgacacaatccaagtcaaaatatttgaaaccctatttgaaactgtggtctggcataatccacatgattcagggctaggttctcataaactgactcaaaaaacatgcaatcttctggtagaacttttgcccagggctggtaaacatgcaaattattgcagtcttttcagaaagtaatttggaaaaacagatcaagaaggtttaaaaggctcatatcttttaacccaggcttgagaaaatattcagagacaggactgagttttatacacaggttcttccttgaagcactatttgcaactacaaaaacaaaacaggaatcaaagaaaatatccaataattaacaaattgcttacatcatatttcaatcattccaatatgtgttttcttaaaagaaatgtttagtggcatgtggaaaacattcccaacatgcacaaagagagagaaaacccagggttacaaattacaaataatatgattttaattttttaaatcaatcccatccatccatccatccatccatccatccatccatccatccatttgtccattctttatctctttatctatctaggggatataggcctagaaaaataactgaaaataaataaatatgttaacagtaattatcccagtatattggcctctttagtatttttcatctttgcacttttccatattttccaaatttcctgtggtgaccatgtcctactttataataaggaaaagaatgataaagactatcatttacagaaacaagacagcccttatctcttctttgaactgcaaaaacacctaacaacatattctccttctccttcaatttgtgtgctacacgagctgccatattgatttttctgaaccattctttttattataacatcctttcccttaaagattctctggctcctcactgcttatataaataattgttaaactacttaacctggctttcccggccttcagaaatctggtcctgttataccatctgtggatttttattagtattttttctccttaaatctccattcaacagatatttatgaagcaccagctctgtgctaggctggcttttctcctcacctcccaaattctccacaagtggcctcttccctggcccagcctcatgtgctcccacctgtaagtctctgttccttggcatgctccttattgcacccattgcaaaagatgcaatgtgtgtgcaccatcctctcagagacttctgtttatccacccaacttgggcacatgctctagggacttaggcaagtgccttaatccctcattgccttcatcttcccatttgtataatggaaactacagtggcaatatgtaatctattcatttgttgtgaagatccaaagagctgatatatgtaaaatgcttaggacagtgtctggcacaatgtaaaagctcaagaaacatttcttatttgtcttgtaacttccttcaaggtaggatcctagtctcattccaatttacaactcccatggaacctaaccaccttgctctgtctctagttggatactgaagaaattcttgttgagtaatgtatgaatgaatggcagctgctatagactgaaggtttatgtctctccccactattcatatattaacaccgaatccccaatgtgatggcatttagagtggagactttgggaggtgattgggtcctgagggtataatccctcataataggatcagtgttctgtaggaaacagcccagagagctccctaaccccttctactgtgtgaggatgcagcaaaatggccatctatgaaccaggaagcaggccctcaccagacactgaatctgtcagagtcttgatcatggacttcccagcctccagaactatgagaagtaaatttctgttgtttataagccaccctgtctatggtattgttatagaagcctggatggactaagacaaaatttatatgagcttttactgaccatgtatatcccttctccttttggacactctgtccctgactataaaccgtacccatatcattcatcacttgtgtggtcaatgttggtgctattcattgtgattatggtcaaaccctctgctgtagctgtacaacttggcatcagatttcttctgttcctgaagcattgtggtggtagatgcttaataatcttgctcacagatttctatactgttcccatttttccatagcaagttgcagaatagctaccttatgttttccaaccttaattttcttggccacaagcctgaaggaaattacattaagtctttcactttaagcccatgcattgcattatcccagatgaatgcactaattcatttgaaaattagagaaaaatagacaaatgatggtataaaaaaaaaagtaactgatttatttagggaccactatttgccaggttctgcaataatccctttcatacagttatcctgttaaaaatgtgaaacacatttagaagctgtgtgaccacagtcaaatcaagttgttccctctaagctttggcttgagctttcccaggctgtactattgcctgcccaaatgccgcttctgttttctgccccatctgtcaacagtcttctagaaaattctatttacaaataaaaagtagagttaattatttcctatttcaaacctattcttccttctatgtccctgccatccattcagctgcccaagtcagaaacttaggagtcacccacccacctttcctacccccacatgactgccctgactacaattcaggccactttcatgtctcatctgctttagggcaacaacctcctaattggtccccctttcataaccccttcttggctgatctaatctacttttctcattgtagccatgatctttgcaaaataaaaaagtggccctgtcactctctggcttttaagccctcaacagctcttcatgaactccataagatatcatctagcccctgcttctctctcaagttttatcttttcaacccatcagtttttcggttatatactttgaattttatgtgctacatgagaggttctcaaagtgtggttgtaggaccaatggggtttccgtgccctgtcaaggagtcttaggtcgaaactattttcataataatactaacatatcatttgctttattcactttcattttctcatgagtttatggtggaattttccaaaagctacatgatgtgtgctattgtaacagatggaatgcaaaagtagatatgagaacccagctaactgtctttgattaagccagacattacagagatttgcaaagatgtaaatctataccagcttctcactatttttttttgaaaaatatacttgttttttataaaagatatttttgttagcacataatgcataatgggtttattattattttaaattaataaatatacagatttaaaaatgtttacagtttcaacatttaatatggtaaataccaagaaatatatcccacatgaacaaaatattttgagggtgcttaataatttttaatattacaaaggggtcccaagactagaaagtttcagaaccactactctagcagtggaaccattcagagcaccccagaatatgttctgtcactttctctcccagcccactcagtgcttctccatcaccataatggtttctctctgcttcttctctgtctgctgaattctcctgcacaagagtcaccacttagtgaaagcattcctttgagctttacaagagtagctacaaggctgacttttgctgaaggcctcttgtatgctaagcaaataattgctttacctgcattttctcctccttttttttttttttttttttttttttttttttttttttgagacagggtctcactctgcctcctggactggagtgcagtggcacaatcttggctcaccacaacctctgcctcccaggctcaagcaattctcctgcctcagcctcctgagtagctgggattacagacacgtgccaccatgaccggctaatttttgtatttttagtagagacggggtttcaccatgttggccaggctggtcttgtactcctgacctcaaatgatccacccaccttggcttcccaaagtgttgagattacaggtgtaaaacatcatgcctggcccactttttttgttttgttttgttttgtttttttgagatggagtcttcctctgtcccctaggctggagtgcagtggtgcgatctcggctcactgcaacctctatctcccggtttcaagcaattctcctgccttagcctcccaagtagctgggattacaggcacgtgccaccacacctggctaacttttttgtatttttagtggagatgagtttttgccatgttggccaggctggtcttgaactcctgacctcaggtgttccgcccacctcagcctcccaaagtgctgggattacaggcatgagccaccgcacctggccttctcctttaagttaggctgaggcaaggccagggagggtcagggaggaggaaagataacatcagttctagtctagacctaagaaaacttaggctcagagaggtttagaagctgctcaggtcacagagctagtgagtggcacagttgatttgaattcatcctcttcccactcagtggttcttatagttctatgtgctatggtgtgctggtgaataataaacaactggctctccaataggacaaagccctcattagtagtgtttggcaatttccatggtgtaaatgctcctgcagtggccagtttcaggccgccaacatgacatcattgaacagagagatcaaaaggggtgtgcagtcgtccacatcatagagcattttcaccacacacataaaaatgatgaaaaactcaagagcacaggtaatagttaagtgtggtaaagtaattgggaattacagtgatgaattctgagtattttgaatttgagcatatttgttttaaatataatttctgtaattataagttgatctaatctacttgtttataattgttaataattgcgtgtttagcaaccaacttgcataattcccaaatatgtaacaattgactcttggacctcagaattaactttcaacctttggacatcacagatgtttgagccctcttccaaacctactgaagccacctctccatgctggtgtccaggcagctgtgtttttaccaagccctccaatctcatctcatcatgcacacagagagtcatttgttcattcttccctcattcaccaagtcagcacacattgactaaaggcctacattatgtcagatactgtttcaaggtgcctacctcatggtccacattcctaccagacggtatcctcatttagagcagggatggagcctatctcccagagcttggtgcagagtctaatgcatcatacaaacttaataaatgtttttgctggaacaaaataataacaagaagccaggttttgcctggctcagctccaatcagcccaaatctctgggattggagagcataagcatcaaatgtgggttggcatgagataggtttgggtttgagtctgattcttggacaagtaagttagtctactacttttccatttcctctgctgtaaaaatactaatacccactttagagggcggttgtaggaattacacacaatcatgtttttatcgcatccttagcaaagtgtcctggtcacattatctgaagagcatccttggccactcttggttccttcatcctgtgttatttttcttcattatgcttatcattgtttgatgttatagtatgtatgtatgcatgtctgatatttaggtattttattattgtgcctcctccccatactacccacccactagaatggtgttctattaagggaaagacccagtttgttacattcatctctgtatcctcagcacctagaaaagtccccaatacccagtaggcttccagtagatatttgacagatagatgaatggatggacagagagcctagtatttgttggttattagtaaaaacattatgttttttaaaaatacctccctctgaggctacagtgagccgagttcatgccactgcacttcagcctgtgcgacagagtgagactccatctcaaaaaataattaattatttaattaattaaataaaaataaataaataaataaataaattaaaaaaattacctccctctggattagggaccctgttgtgtgtctcacttgtactccaggatctagaatctgcttccttcttgtacatgtggcacatgccatggcctcctccagctcctggcctgtcctcatccttgtagttctaagtcttatagtgacatcatcttttctcctattgtgttccggtattgtaagaaggttacttgtgaacttttcttcctgactctgccaggaaattgtttggtcttttactggtacctgatgcccctggaagcttttctgcttcagacctgatgaagtcaaccacaaagtgacaagtttccctgcaacatgagggtcattgcatttctaagcatatgttgagttcttatttttgatatgcacagaaaagtcagttgattattctaacttaaaaataaaattctaccttcatattggcttgccttttctctcctttgggacaggttgggaacttgggaagcataatataggtctatgctcttggcttatggtggttcagagatcagggcttttggaattgggcaaatctaggcttgaatcccaattttgctccttcctagctctgtgccctgggaagatagttaacctttctgagtctcaatttcctctataaaatgtggcttccttccttaacatgtacttattcagcccctagtgagttcatacattgttctagacgttagggatacaccagtgcgcaagcatcacacatgacctcatgcccatgagttgtcttctctatctggttggtaaactattaaacaaacaatgctgcaaaggagaaggacagggtttgatgggaacttacaatggagatataacccagtctggacaatcagagaaggtctaaccgaggcagtgttaacctgagtagcaaagaacagatgtagctgagtgggctgtaaggaaggaggaacgaaggttgagtctttagagagctatggtttagaactagaggtgaaggctctgtattcaaaactggtttggcgagacaaacggaatacaacttggaatataactcctcatataccatcatttaaacccctacttgcctgctatggaccttgagtttaaaattctatcattttaaagatgaaaaaactgcaatccacagaagtttccacaggccaccagctagttaagcatggcagagctgatattaaagttagcaccttaaagtatatccataccatcagggcggggggcattttcactctggtgggcattttcaggcaacaattccaaatacgtgaagaactgccttgtcctcaaatagcccagcttcacagcatggctcatttcacatttaaattgcactgggaacaaatacatttcacaatgttcagcttcaggttgcgaagaataacatgctaatagagagttgcaggtaccagtcattttcctccaaatcagtctcttttggtcccactctggattaatgaccacctttgcaaagaggccacatgagctttcaaagagaaaggagtaaacaggaggacatgcattaacatggcaggctagtcacctcccacacctgaatgtagagcttttagaaatggaattgttaagatgtgcttcttttacaaatatcagataaacataatctctgagggtacagaggtagtgggtgttgggtagaatgatactttagccatggagtgaatatctagggcaagtaaaaagtgaaggagacatctaattcatgtaatgggtggaggatttactaagtgtcaggcactataaacaatgatttcataggtgttttatttcatttgcacaactcactaggtcacacaccaagaaagaggagacatgagattaaacccacgttttctaactctgggctcattttggtgacgtcaggtgatttgggtgagaatcccagttccagcgatctcagcatgactggtacctgcaactctctattataagtaatcttgggttacttatttaactgttctgagcttcatctatttctcatctggtaaatgccacatgcagatgtacaatacatttacagtttgtttgttttaattagaccatgtggttcctcactgggattactttaatattaaataaaattaataaataataatataataataatattcaataaaactaatattaaataatattaaataaaattgaaaagcacatcgtgaatgaagagaccacaaagaaaagactacatgggatatttgggggacagctaattttccaggctggttggggaaagggtatatggagtgacatgctcagagggaactataaaggaagtcttgaggcaggacatgggggactccagtgctgttttgagtttgggaaatcttctctagcccatggccattcactcagaggatagaacagatggcgtttatgaacctacccacatacacccacaacatgtcaaatggttaaatttattgactcaccatttgcaaaattgtgttcatctccacactaggtttctttccaccacttcccagtttcaaatggatggcagctttgggattcagtatcagtaccctgatactgactctatatcagtgcaatggaaatactttcagttttcattcattttcaaccttaccaatgctctggaatcactaaatctgacttttttttttcctaagctctgggcctgtgagcccaggtttatagatgtagcttatagatatgctattcaaattcatttgtatgcaaacatatctcagtggattttgttatacttctgttcatcttgaaattcatgaaattcctcagacatctgacaatgcatagaattttaaatatatgctatcatttttctaagacacttgatttttgatcctgtctaatgtatttaatcaaactcaaattagaaattggttccaacaggcagtcttatagatcagcactgatcagtaggaacataaagtgagtcataaagatgagccatgtatataattttaaatttcctgatggccatattaaaaaaagtgaaaagaaacatgaaagtaattttaaaaacatatttcgtttaacccacagtactcaaaatattatcattcaacatgtaataaatatacaaaatgatgagatattctacatttattcttttcatactaagtccagactgtattttatacatacaacacatttcactttagccacatttcaagtgtacaatagtcacataaggctaagagctgtagattccagttccttagaacagttagttccttcaaagaactggaagagtgatttatatcccccttcctcttgctcccatccaagcagtaatattgcaaaatttctctctcatctatggatttttgggggttagacctaagagattatcttgtcctaaacttttgtattatggtcaatgaagctgagatgcatggagagaaagagtcttggccaattcagccatatctcctcttgtgttggtgcagtctccactccatgaagcatgtccatagtgattaaaaagatgagatagtctgaactgagaattgtaataaggaatggcttcttcggttaatagagtttacagaagtatataatgtagatttgggaggtgtcttgtgacagaaaccgctaactgtatccacatatattctcttcttccatggtaacaaaacccttagcttggcagggcacatatcttctttatcctaagaagataaaggatatatgtgccaacctctctgaagatatgtgcccacttccctgaaacctgaggagaagggcatgaactaaattctgacagtgggacattaagggaagtgatgagtacaactaaaggaaatgtatataaagggaaagaacaatgctcttccattctcccccttcttactgactggaatatgtgagtgatattacagcttcagcaaccttcttgaatcatgaaaagaagagaagcaaagtgggtggagaaagaagataggaagagtctgatccttgacactttggagcaccacacgagtcctagactgactagctacagactttttgcctatgaggaagaaataaacttctatttcacctaagccactgtcattttagatttttccgttactcatagcttaacctatatagccttcaccctcaaagttttccttggttgcaccacatacccctctgtcctactaccataggttgggtttgctgcccttcctctgcattcatagcctgctgtattaccgtcaaaataacttaccacactgtattgtaattatttatgcatgtctctcattttattcattgcatgtgtactgtgtatttattgatcacttgtggcaaattatccacaaaatctctacacacttggaaatgaaacaaaatacttctaaataatctatgagttgaaaaggaagtgtcaaaggatgtttaaaacatacatagaacataataaaattgaaaatataatatatatcaaaatatgtaagatgcacctataacattgctgagagaaaattttatagcaccaaatgcttacattaaaataaaagtctcaaatcaaaaatttatatttttacctcgataaattagaaaaagaataatagaaactgaaagcaagtttaaggaaggaaataataatgagcagaaatcgaagaaattgaaaataagaacataattaaaccaataggtagttcttcaaaaaattcaataaaatatataaacctataataatgacaaagataaaaagaaaaaatacacaaatcatcaatattaaaaataaaaaatggcttatcactacagaccctatagtgattaaaaggatagtaaaggaataatatacacagtttatgcttaaattcaacaacttagaagaaacatacaaatttctcaaaagacacatactgccaaaaatcatctaagatgaaacatatgaatggtcctaaaccattaaatacattgaattcataatttaaaatttccctcaaaataaatctgcaggcctaaatgatttccccagagaatactaccaaatatttaaagaagatttaacacaattttacacagtctactccaaaaaatggaaaaagaggaaacacttcctaagtcattttacataaggccagtattatcctgatgccacgaccagacaaaaagagtaccaaaaaaacctcaaaaaactctgacgcagtatctccagtgtatctcatgaacttagacataaatcttcaacaaaatattaggaaatggaatccagtaatatatgaagagaattatactctgttaacaagtaggatttattccagctatacatggttggttcaacacttaaaaatcaataatgtaattcactgcattaacaggctaaggaaggacaacatgattatatcaattgaagcagaaaaagcactttataaagtctgacattcagcaaattagtaatgaaggagaactacctcaacatgataaagggcatctacaaaaacactgcagctaacatcacacataatggttaaagattgaatgctttccacctaagatcagggctaagacaagaatgtctactgtcaccattcctagtcatcataattctggaatttttacctaccaaaataaagccaaaaaataagtcacaataattaggaaagaaattaaactgctactatttctacataatatgactctctatgtagaaaattccaaaaaacatcctaacactaataactaagtatattagtccatgctcatgctgctataaagaacttcccaagactgggtaacataaaggaaagaggtttaattgactcacagttttgcatggctgggaaggcctcaggaaacttacaatcatagtggaaggggaagcaaacacatcctttttcatatgatggcaggagagggaagtgcctagcaaagggggaaaagccccttataaaataatcagatctcgtgagacctcactcactattacaagaacagcatggggataactgcccccatgattcaattacctctcaccaggtccctcccacaacatgtggagattatgggaactacaattcaagatgagattgggtggggacatagccaaaccacatcactgagtttagcaaccgccgcaggatgtaacatcaacacacaagaatcaattgtatttctatatactaacaacaaaaatctggaagccaaaatttaaaacacagtactatttacaattgctctaaagaaaatgaaataattataaacacaataaaagacatgcaggatttgtatactgagttacaaaatgcttatgaaagaaattatagatgacctaaataagtgacacgacatattatgctcatggatcggaacacttaatgtagtaaagatgtcagttctctcagaaatgagctatagatttaatgtaattcccatcaaaatcccagcaagattttttggaaatatagatgaactgctctaaaatttatatggacaaacacaaaacctagaatagttcaaacaatcttgaaaaaagaagaaattttgtgttagtttcctgtgactgatataataagttaacccaaacttggtgacttaaaacaatgcacatttattatcttacagttctggaggccagaaatccaaattctgtttcactggactaaagtccaggtgtgacagcaatggttacttctggaggccccaggagataatctttttcatgcttcttccagcttctagatgctgctggcctcattggctcatgggtgcattactccaattccactttcatagtcatactgccttctcctcttctgtagtaaaatcttcctttgcctcccttgtatacggacatatataattcatttacgacccacacagataataaagaataattgtcccatctctcaagatccttaatcccctctgcaaagtcccttctcctatatagttgatgcttgaacaatgtgaggactagtgatgctggcaccttgcgcaatagaaaatctgcatataacattttttaaattatttcagtagtttttgggtgtttggttacatagataagttctttagtgatgatttctgagattttggtgcagccatcactcaagcagtgtacattgtacttgtacacctttatccctcaccccccttccacactttcctctgcgttcccaaagtccactgtattattcttatgcctttgcatcctcatagcttagctcccacttatgagtgagaacatacaaggtttgattttccattcctgaattacttcacttagaataatggtcttcaatttcatccagattgctgcaaatgccattatttcattcctttttatggatgagtagtatttcatggtatatatgtaccacattttctttatccacttgttgactgatgggcatttgggctggttccatatttttgcaattgtgaattgtgctgctacaaacatgcgtatgcaagtatcttttttgtgtaatgatttattttcctctgagtggatacccagtagtgggattggtggttcaaatggtagatctacttttagtctttaaggaatcttcacactgtttttcccagtggttgtactagtttacattcccaccagcagcattaaagtgttcccttttcaccacatctacgccaacatctattattttattattttttatattatagtcattcttgcagagtaaggaggtattgcattgtggttttaatttgcatttccctgattatcagtgatgttgagcattttttcataagtttgttggccatttgtatatcttcttttgaagatatgtctattcatatccttagcccactttttgataagattgtttgtttttttcttgctggtttgtttgagtttcttgtagattctgcatattagtcctttgtcaggagcacagtttgtgaagattttcccccactctgtgggttgtctgtttgctctgctgattatttccgttttttgcagaagctttttagtttaattaagtctcatctatttatctttgttttgatgcatttgcttttgggttcttggtcaggaaatatatgcatatagccaatgtctagaaaggtttttccaatgttatcttctataattaatttttatggtttcaggtcttagatttaagtctttgatctgtcttgagttgatttttgtataaggtgagagataaggatcaagtttcattcttctatgtgtggtttaccaaggagctgagcactatttgttgaataagatgtcctttccccattttatgtttttatttgctttgttgaagatcagttggctggaagtatttggcttgatttcttggttctgtatactgttccattggtctatgtgcttgtttttataccagtaccatgctattttggtgactatggccttatagtatagtttgaagtaaggcagtgtgatgcctccagatttgttctttttgcttagtcttgctttgggtatgtggtatcttttttggttccaaatgatttttaggattgttttttctagttctatgaagaatgacggtggtattttgatgggaattgccttgaatctgtagattgcttttggcagtatggtcattttcacaatagttattctacccatccatgagcatgggatgtgattccatttgtttatgtcacctataatttctttcagcagtgttttgtagttttccttgtagaggcctttcagggattcagggatggaacatataaagtcaataaatatgatacaccacacaaacagaactaaaaacaaaaatcacatgattatttcaatagacacagaaaaagcacatttgacaaaatccagcatccctttatgactaaaaccctcagcaaaattggcatagaaggaacataccttaaggtaataaaagtcatctatgacaaacccacagccaacattatactaaatgtggaaaagttgaaagcattctccctgagaactggaacaagacaaggatgaccactctcactacttctattcaacatagtattggaagtcctagccagagcaatcagacaagagaaagaaataaaaggcatccaaatcagtaaagaggaagtcaaactgttgctgtttgctgatgatatgatcatatatctagaaaacactaaagattcatccaaaaacctcctaaaactgataatgaattcagcaaaattttaggatacaaaattaatgtacacaaatcagtagcactgcaatacaccaatagcaaccaagctgagaattaaatcaagaactcaacttcttttatgatagctgcaaaaacaaataaacaaatgaaaatacttaggaatacacctgcatgtaacttttgactcccccaaaacttaactactaatagcctactcttgatggaggccttactgataacatgaatagttgattaacacatattttgtacatttttatatattttattcttacaataaactagaaaaaagaaaatgtcattaagaaaattatttaaaagagaaaatatatttactattaattaagtggaagtggatcaacacaaaggttttcatcctaattatcttcatgctaagcaggctgaggaggaagaagaaaaggagcatttggacttgctgtctcaggggaagaaaaggagaagttgcacttgctgtctcaggggtgtcagaggtggaaaaacaagaggaggtggaaggggaggcaaggggcaggagaggcaggcacagtcagtgtaactttgtagaaatacaacataatttctgcctgacttttttgcttttttatttctctggtaactttgcagaaatacaacataatttcttcctgacttttttgctttttcatttctctagaaatgcttctataataccaatccttctttcaccatttgctttagttttaatgcccattagaaggatctacatcaccaaaaaaagtatcaaaagaggtcttgaataatcagaactgttgtggaagattgtttaatgtcaatttgttttctggcactgcttcttctacatcttcttcctcataatctggcaccagttcagaagcactcatcaagtcatcatctgttaatccctctagtgtagtgtctattagatcttgaatttcaccaagatccgtatcttgaaattcttcgtcctctacctttttaaccgtatccacaatctgtttcagattccgttcactggctctgttgtaaatcctgtgaagtcatgcacaacatctggacacagttttctccaacaggaatttatcactttggatttgatgacattcatggctttttctgtaacaatgatggcatgtttaatggtgtaatctttccagagtttcatgatgttctctctattggggttttcctccatagagttgacagtcctttccatagcgtaccatgtataatcagccttaaaggtcctcatgacccatcttttgaagaatgagttaggggtgttgtgtttgggaggcaaggagaccatttcacaactttcagtgttgaactcatggggttctggtggccaagggcattgtccagtattaaaataactttaaaaggcagtttttaactggtaagggacttgttgatttcaaggacaaagcatcaatggaaccaatacagaaaaagggcctttgttgtccaggccttcttgctgtacaacaataaaaaaactggcaactggtgtttatcttttactttcaaggcttggaggttagcagctttatagagaagaacagtcattatcataaacgcaactgcatttccacaaagcagtagggttagctcatcccttcctgccaaaaatcctggtgttcacttcttttccttactaataaatatcctctgcagcatttttttcctccagaatagaacacttctgtctacactgaaaagttgttcaggcaaatttcctttctcttcttttaatggcatctagaaacttgtctgctgcctcttggtcagcaggagtttcttctcctgtaaccttaacatttttagagccaaatctctttctaaaattatcaaattgttctttgctggcatgaaattctccaactttagatccttcatcttctttttccttaaagttttcatataatgactttactatttctcgaatcacattagagtctataagtatgcctttcttatagcaatcctgcacccacataaaaattggattttcaatatgagaaagatgttttacagaaagtacaggttttcacacttgaagcaatagcttcacaagtgtacttttctttgtttacaacagatttatttatgctggatttatttatcttgaaatggcagattgaggtctcagttgcagccctcaagctatggtacatatctaacaattcaacttttttttttgtaatgtcaagacttttccctgcttcttaggagttcttccagcatcactagtgacacttcatatagttcccatggtgttatttatggtattgcaccaaacatgataaaaaatacatgagaaccacaagagatcactttttactgtgataggcaatttactggaaagacacaaactgctcacatggagatgcttagcatcatcagcactttaagtggatgggtgcaacacttgaactcacaacaatagcaacaggaagtggccacaaaattattaaagtaatatgtactatagttaatttcatgctgttacgattgaatactgttgtattagtccattttcatgccgctgataaagacatactggagactgggggaaaaaaagaagtttaattggacttactgtcccacatggctggggaggcctcagaatcatggtgggaggcaaaaagcacttcttacatggtggcggtaagagaaaatgaggaagatgcaaaagtggaatcccctgataaaaccatcagatcttgtgagacttattcactaccaagagaacagtatgggagaaaccgccaccatgattcaaattctctctcaccaggtacctgccacaacacatgggaattatgggagtacaatttaagatgagatatggatgagaacacagagccaaaccatatcaactctatcttcatgtttgtttacatttctctcaactgtaagttgtctgtttgtatagattttgataaattttaactttttataataaatttgtgtatattttattatagcaaataatcaaatagactagcatttatatgttttatgcatttagtacatgcctgtttcttaattttttttgatatttctaggctgtgtggttcatcttcaatttttttcaagttttcagaaacccccctaattttttcaatatgtttatcttgaaaaatccacctataagtggacccagactgttcaaactaatgttatgtaagggccaactgtataaggaacattcacaggtttcaggtattaggacctggatagttttagggccattattcagcctcccaaaaaagtggcagaaataactctacctaatattaaggcttactatataagctaaataatcaagacaatgtcaaattggtggagagatagacacatagatcaatggtacagaacagagaactcagaaatagacacacacaattatgttcaattaactgtgcaaaagcatgcactaggtgcaaaagcagttcactgtagggaagatagttgatatgtgtattagtctgttttcatactgctataaaaaaaagcagccgaagactgggtaatttacaaaagaaaaaggtttaattgactcacagttcagcatggctggggaggcctcagaaaacttacaatcatggcagaaggtgaacgggaagcaaggcaccttcttcataaagcagtaggaaggagaagtgccgagtgaatggggaggaggcccttataaaaccgtcagatctcatgagaactcactcactgtcatgggaacagcatgggggaaaccacccccatgattcaattacctctacctgggctcccccttgacacatggagattatgaggatttacatttcaagatgagattcaaatcgcatcttgaattgtcattcccagtgcttggggagggacctagtaggaggtgattggatcatgggggcagatttcccccttgctgttctcataacagggagtgagttctcacgagatctgatggtttaaaagtgtgtggcacttccccctttattctctctctgtctcctgtcaccatgtgaagatgtgcctgctttccctttgccttctgccttgattgtaagtttcccaaggccacaccagccatgcatcctgtacagtctgcagaactgtgagttaattaaacctcttttctttataaactacccagtctcaggtagttctttattgctatgtgagaatggactaatacaatagtcttttaaataaatggtttgggaacaattaaacatccacaggcaaaaaaaaacttaaaaaaaaaaaactcaaaaaaaaaaactcaacctaaacctcacaccttatataaaattaacttaacatggatcatccacttaaatataaagcataaactataaatcttaacaagaaataggagaaaatcttcaaaatctaagtgaaaagttcttagacttgacaccaaaagcctaatccttaaagaaaaatttgataagttggacttcatcaaatttaaaacttctgtgaaagaccctgttaaagaatgaaaacagaaacagaacctacaaactagaagacatttgaacatcaggtatctgaaaaaggaataaaatatagagtgtttaatgaattctaaaaactcagaaataaaaaacaagcaatccaattagaaaatgggcaaaacccctaaataagcattttattaaagaggatatatacagatgataaataagcatgtgaaaagatgttcatctttattagccattagggaaacaaaaattgaaacacaataagacataactacacaattatcaaaatagctaaaatttaaaaaaaataattacaacaccaaatgctggtcatcacaatgcaaagaaattagatcacctacacattgcttgtgggaaagtaaaatgatttagctattctggaaaacatttggcagtttgttataaaactaaacatgcaaccaccatatgacccagcaactgttctcttgggcacttattccagagaaatgaatattattttctcacaaaaatctgcatgtggacacttatagcagtattatttgtagtagccaaaactgaaaacaatccagatgtccttcaatggatgaatgattaaacaaacgacagcacatccacatcattcagcaataatgaggaatgaactattgatacacacaacttgagggaatctcaagggaattatgctgagtaaaaaaaaaaccaatcccacaagcttacatacgtcatgattccatttatataaccttcttgatatgacaaaattatagatatactagaactgattaatagttgccagtgtttagggctcaaagtgcagggggagggataagagtgtgattacaaaagagtagcacaagaaatccttctgtatcttaactgtggtggtaattacataaattgcgacatatgataaattgcatagaactaaatacatgcacatacacatacaagcacaaggatatataaaactggtgataatctgaataagattgataggttgtattcatgtcagtttctgggttgtgatattgtactacagttattcaagatgttaccataaaaaatttggaaataactctggagataatgttttaataagaggcataagcacaccttaactataaaatgtttgatcttcagaaaacattctgaaatgtaatagaaatttaacaaatgtggaaaggggagaacatgctgtgaagttattatcaactcctgtgcaaaaatgttagggctctggccaaaatctcaactcagaattgccaactttcataaagtctgcaagtagaaacttgtcacatccataaatgtaaataacacttctttctttcacctaacctgatttaaaattatttacttgcacttttcttatactttacaaagtattttcacatgcaaattctattccattttcctagtcacttgatgtggcagacagagaagaactttttatcctccattataaagatgaggaaattgagtctgagagaaatgatttgttctgacttgaagctaaaaaattgtaaagttaggagtaaaatatgaaatgtgaatcttttgactcctgattgatgatgctacttgaaggcgaggaataagtcttataattcttagagggttagtctgatgtaggggcaaaaacaacactggattattagtcaaaagacattgttttaagcttcagcattgagccaggtccaagctaaagttcaatgtaagttagaggcatgtggtgagagaggtgctaccaagttccattaaggaaagcaaggaaggctttcaacagatttggcatttgttgagtcctgaagaatgccttgaattttaatatatgactttattaagagaaggaaaaatccaggcagagtgtagtaaaaataggggatgggggcagtgagcagcagtatggggaaaagaaagtgtaatgaatccagtgcccctccattacccacctccaccttgacagcagctgtattcccctgtaaattgctcctctctctttcttctctctttctgggactctggtaatatgaatgttggcgcttgtgacactgttaattttctttgttctactttctctctcttgctcagattgggtaaattatattcatctgtcctcaagttcactgatggtattttctctgtcatctccactctactattaagtccatctagcaagatttttattttggttattgtacttttcagtgttatagtttccatttgattctttttataacttctacttctttgttaagattttctctttttttatttgttaaagagaattcataattgctgctttaaaattatcttcagataattccaacaccttggaattcatcttggtgttgcctgttcatttcttttctcatttaagctgtgatttttatttacttatttatttagttagttttggttcttagtttgataagtgatttcctgtggtattctagacatttggaagactctagatcctatgtaatcttttttaccaggcattatctccactgatatgtagtttgagggccgagtgggtgtgtattttcaatggaagtggtgtgctcacactgcctctttgcagaagggtggactgaaagttgaacttccttctcagtcctatagaactcttctcagaaaatgtgggtgcaaactcgtactgccttattggggtattagctcagctccttagtgagccatagtgatgagatgagagagggagggaagtattaactagctccagcttgcatagcctcattcattttcactgacgccactgacacaaacctgtaaagggattcagagcatgaacgacctaatcagctcatttcagatataaggctaaaaaattgtaaagttaggaataaattatgaaatgtgactcttctgactcctgattgatgatgctacttgaaggtgaggactaagtcttacaactcttagagggttagtctggtgtaggggcaaaaacaacactggattattagtcaaaagacattgttttttaaggctcagcactgagccaggtccaagctaccatactaccacttaccaccacactaccctaccagcaaggaagggatagaaggaatctgaaatagaggattagctctgttgtggtgcagaaaatgatttcccaaaatatggcagttgagtatgttgagtgcttttaagaattgcgaggactcaaaaataaaccctagaatcaaggtctctctaacttgtctcatttctccctcccttcaaatgcaagatgggcccctgtctcctccctgctctatgacaaagggtatataagcttctgtgccccattggggggttggagtaaccactctgatatggtttggctgtgtccccacccaaatctcatcttgaattatagctcccataattcccatgtgttgtgggagggacctagtgggagataattgaatcatggggtggttttccccatactgttctcatagtagtgaataagtctcatgatgtctgatggttttataaggggtttcccttttcactttgctctcattctctcttgcctgccaccaagaaagacgtgccttttgccttccaccatgattgtgaggactccccggccacatggaactaggagtctatagagcctcttttttctttataaattacccagtctcaggtatatctttatcatcagcatgaaaacaaactaataaacactctgtgattctctcccatgcacattaataaatatgtatgcatttctggctattagtctgccatttgtcaactgattttcaggaaacttttagaggataaggtgaaagtttttccttggccctgcaaaagttgtcagggccaaaatggtgtcaccaaagttaagagaactctggcaaataagagctagggaaggccatgaagagagggttctcatgcttgtatgcttgataataacaaccgaaaaaaatctctacaaaaaacacaacctggcacaaaggccatcacaatcacacaaaaaaatacttctgcaggacatatgaccagcactgtctgtccaacctcaggctggtgtcatacttgtcattgatctttgtagccaaggataattatttcaagaacaattgtgtaatgctcctcatttcttttttctttagaaacctttgtcttcctttaattcaaatatacaaataatttactattgcatgtatattccctttgcaatactctattcccaaataaacataattttcttttagaaagcctctcactgtcatttaggttgacagcctctatagtttcctattctgtcctgctggtaacagtaccagaagaggaaatcaaatcattagcatctgcgtcttcagggaagagtacagtgtggtggaagacaatcttcctcttggtggaggaagaatagaagaggttttgccattggtgtttaactggagtagcacagatattgccaaaaagactttctcttgttaatttgtcctttcttggctaggggaaacatgcttttgtcagccctgtgtgtgtgtgtgtgtgtgtgtgcgcacacgcatgcacatgctcatgcacgtgtacacctattggtggttctagcctgggggtttctgcagtgtcctattcaggatacacggacacaataaggatacccagagaattcactatcatagcattccttacatgctgaggttcctaaatcgcccacattttcccacctttaagtattttcctttgcttatctgttatgctatttccagggttattttagttgtaagacagtatatgagagaaatgaggcttctctctcttggctgggaccagaaatctctgctgagtatgaacaagactttctaatcctcatattattatttttttgctgtgatggactacatgcttttctttgaaacacatttctctctcagtatttactactgtacattgtgagtttcctcctatcttttggtcacttcaaagtgcccttcactgtttcctctttgtctgtagctcagtgcttctgttctccaagattctgccctaaacactttcatcttacctcctcttctcttcctccacagcctcaccatcaccatatgttgaaaactgacaaatcatggtctcaagtctctaatcccagtccagtttgcactggaaaccttcatctggttgtctcataaacaccttgcaactttgttatctagaatgtaatttattgtccacatgtgcatgtgcaaacagattttctcccaaattgacccttctttgtgcatttctggacttggtcaatgaccccatgacccacccaggaatcccactcagaaatatggcagtcaccttgtttctccctttattctaaactccaacacatcaccaaactttggccattctccctgctaaataattctcaagtccatccccttgtctctgttccctctggcaatggctaaagcatttgttcaaaatctcattcctggatgattctaatagttttctaattggtctacctgtctttctccattcccacagaggctctagaatgatcttttcaaaatgcaagtataatcaagtctgcctaaatcccttcctaattcctcattagctctaaagaatgaattctaactctaatttctccagctcgtcttccacaatttcctccatccatgtctggaatcatgctgtgatctctcagaccctacattttgtctgtgattttgttcactgtcctgtctgcctgaagtatgaaatatcttcctctccttccctcacctgcacccaccctacctaaaccaaccctactagacctacaagattccagtcacgtaatctcttcagggaaaatatttcccactcctcattaaaggtgcttatcttccctgtttctaaaacaccctatgcatgttaaattgttgacttgcttctttgcctcccatctgggattcgggagaaactctgaggaaggttcattttccatcctggcataatatgaatagagaacagaaaggtgagctcctccgccctttgactagtcatcttggagaagaagtgtactacaggcggggagcggtggctcacgcctgtaatcccagcacttcgggaggccgaggtgggcggatcacgaggtcaagagattgagaccatcctggctaatacggtgaaaccccttctctactaaaaatacaaaaaattagcagggcgtggtggcggcacctgtagtcccagctactcgggatgctgaggcaggagaatggtgtgaacccgggaggcggagcttgcagtgagccgagatcgcaccactgcactccagcatgggcgacaaagccagactccatctcaaaaaaaaaaaaaaaaaagaaatgtactacagtggtcaagagccctgacctggagcagaacagttgggttcaaatcctggctctgctacttaccggttttgtgacatttatcagtgtccccccatctgtaacacaggcataacagtaacttttttattggatagttgtgaggattaaagtaagagcatgtcaacgtgtagaaagattatatacgttctacagttcagaaacattggcgtgtagattataaatatttgctatgttaaaatatttttatttgggggcaggactttgagctgctccaccccacccccacctcctgctgcccacgcaagaatcagaaccactgctgggcagagtggctcatgcctggaatcccagcacttgggaggctgaggcagggagattgcgtgagcccaggagttccagaccagcctgggcaacatgcagaaaccccatctctacaaaaaatacaaaaagtatccaggaatggtggctgtaatcccagctacttgggaggctgaggtggaaggattgcttgagcctgggaggtggaggctgcagtgagccaagactgtgccactgcacttcagcctgggcaacaaggtgagaccctgtctctgaatgaatgaatgaatgaatgaatgaatgaatcagaactgtaagaaaacctgctaacctctccacattgtcccgagtccattaatttcccagctgtttgtggcctgaagcctccagccaccacagaaaccaagattttccagacaatggttcctctcagttcaagtatggcagattttcggaagttttttgcaaaagcaaagcacgtggtcgtcatttcaggggctgatgttattgcggtaagtggggttccacccttcagacaagccggaggtcatggggaaaatgtcagtccaggccctggcagctcctctgtcctctgcccacgcttttctgggtgtgggagctccccactgcgggtgagaggtcaggccgagcaggagcccagtccgcacctcgccaccatcgaatgtgatgccctgctgggcggacagggccgccagggcatgatcatgacagaatatccatgggcggcacccaaggctggcgccaagaaccttctggaaatccactgtagcttatttaaactccatgtacctcttgtggagtcgtgtctgagaattatgagagtcggttggtccacctttatcaggagaaggtgccccaggacctggaactcaagatgccagaatcccagttgggaaacttgccgggtgtgagaggcagagagcaggggcttgccgcaacctcacgccctgtggtttggcaaaaacttggatcccgcctttctggaggaggttgacagacagctcacccttgtgactatgtctagtggcacatactccccctgtggtgtaccccgcagctgtgtttgcccaccagatgtctgccaagggagtgccagtgaccgaatttaacatggagaccacctcagccatgagaagattcaggtttcatttccagggaccctgtggtaggatgcttcctgaaccccttgctggtcatgaaaatgaaactgtttcttaagcatcctgggaagaaagaaattatagtatatctaagtatgtctaggtggcgagctgatattggatgatccaaaaatattctgattccctggctgaaatccaacctgttgataagtgtttagggctcagaagtagcaagagcaaaggtatttagaagtcagagaactgtaaagttaatgcatgttatttgatttgaactgaaacataagagacctttgatgtgtttagttggttattgggagggaaaaacgttgtaattagattgtctttaaaaatgtaattattctgattatatttttcctatttgggcaaagatagaagtagaggggtaaaatcctgtcatttagcacaagttttaatggaaaataaaatcattctcaactacctacttatataaaggtgttaccccaggaacaaaaattcttttttaaactattacttgtaacattaaaaacatgttcttccttttctcaaggttagtatttgccacttgaatttaataatccgtttgctcacctattaggagcaacaataaatgcaatacattttgaaggagaattaccctggagaataaccaaggtagagtagtttcttttagaagtagatttactacattaggtacttcagcaaagaattggtttttaggaacagaattcataagaagctatatggtagaaccatttgggtattttccaagtggttgagaataattgctatgaaaatgaatagggaaattttaaaataattatttaaaaacgagccactgaatagatcttctaagcttgaaaatgtctatagtaccatgaaatcatgtttacggccgggcgcagtggctcatgcctgtaatcccagcactttgggaggccgaggcaggcggatcacgaggtcaggagatcgagaccatcctggctaacacggtgaaatcccgtctctactaaaaatagaaaaaattagccgggagtggtggcgggcgcctgtagtcccagctactcggaggctgaggcaggagaatggcgtgaacccgggaggcggagcttgtagtgagccgagacagcgccactgcagtccagcctgggcgaaagagactccgtctcaaaaaaaaaaaaaaaaaatcatgtttacgattccttctcaacaatgtgcttctcgtctagaaacacatacattgttcaatagatatttgttcaataatattttgtggggaaaaaaatcactagattaagagcctcccctgaacctctcccaatttaaaaaaaaaaaaaaaaactctcaaaagcaaggatatgtatactttattccctcgctcaaaaaattatgttcaaatataatctctttaaaaactcccttatgggggagtctctcaaatatcattcctccccttgtctttcattctgctccctattgcctatatccagtatttcagaatataggaagaggcagaaggcagaggcttgcttttcacccgcttcctctgagacagcaacactgtgaccatcttcctcaaagatgcctggagttcttcgggatgtcagttcaggaaagacacaaaacagctctgtattgcagagacctccctaaaacacccccctcccatattggataatttcaacatggcaaggacatccatgtgtgaagttcttattggaaacttttaacagatatggtttaaattttaatacaatgggcaatgttttgttttctggtgagacaaattcttacagctgattgcatgcaggaaaagctttattaagtcaataagctgttacacttttacaaactgctatgcagaatactcaaacatttttaaatgacatgagaaactactaacatctttagtgagagtcactttcacaattttctctgctcccacacccctaatgatcaacatattcatttttttatttagtatatgtcacgcagcaatttatcaaaagcttttgttgtgaaaacacttttcttaaatacacaattaaaagatatgattaagcacttacaggatgtgaaatatttaaaggtaatacacaataatcgggttaccaaaaggacgccttccaatttttctttctattcattttgatgttttgttcttttcaaaacattttctctcattacattcattactaaaggccttactttaaatacatcatgctacattttgttctcctcttcaaatgccaatgttttaacaatttgaattctctggcctgggaaaaagaaaagttatccacttacaaggtatacgtattgacaacatggatgttacagtccaaacaacagcacaaaatcaaccatgtacatgtaacatagtgaaatgagtccacgttttctacacgctacaggataggaagagctggctcttaaggcccagggctcacatgattatgcacttgtcaagcagcttctcagtggtgttgggcatctgggatttcttctcgggctcctggaggccggtggtgggctttttcttgtaattcagcagcatgtggaacagctcctgcacattcacatcggtcttggctgaaatctccatgaaggcgcaattccactccatcgcacaggtggcaccatcattcagggccacctcccggtgggtgtcatcacttttattgcccaccagcacgatggggaacttatgcaggttgttacctttgatcttgcagatcagctcatagaaggccttcagctcttccagggtttccttcttggtgactgagtagaccaggacgaaggcgtggccccgggctataacgtggcgctgcagagcgcggttgccgtcgccactcttgctgtcggtgatgtgcagggaaagcacaccgtggctgcagcccagcaactggcagtaggtattttcaatggtcggcaggtactcatgacggaagttgccgctcgcccacttgtgcagcagcgtacttttccccacaccagcggtgccgactaccacgacgcggtaatctctgatcttcctgtggggcttgaaggcgcggaggataagcagggcgggcagaagccgcaaccgcttcagcagcttctgttccttggagccaaagctggcgttacccatcgttgggattcggaggggagatacgtgcacaagttctcccacacttagctggcagcaggagacccctaggaagaaagtgagacggtgagagatggtagtggtaacctacaatgttgtcagatcatgtcagcctggccagctgctccactaggactctgaagagagtccaccctgtgacgtaaaggggtgcacacagcgagaagaaaattcccaggcacacagttcagcctgctagaccgagggaccagcaggtgatatatattaaacagacatggtggtttgctttttaccatctagaaagtgcagcaatactaccttttgttttctttccttaaactgttttattaaattctcactacacccctacaagaaacactctcatttcctcgcttgtaaaattaagattttaattgaagaggactgaacagtcaaagagaaacaggtgagggaattttccccactctatggggctgaatgccaaggtgacatttagagtgacaccgccgccctggttaaagctacagagtcatcagtacaggagaaaggagggggtttttggtatcagtggtgtgggatgtagagaggggaggtacctgcagtcagtgcagccccagaagaggcatggggagcacctttgctctgagcatgctgtcaccatgtgccaccaagagctgagggaggggtcttagttcatgaatccttagtcacaatgacagtggagtaaaaaaaaaaaaaaaaaaaaaaaaaaaaaaatatatatatatatatatatatatatatatatatgaacctttctcttcaggatctaatctctgattagaaaagattgtaaatattgaatgagtttttctacagaacagtggtttttcttttgccatggctactacctttaacaaagtacttttaattcagccttatggaaatagagaaaatttcaggatttgaacagtcaatgaactttttgagttcaggaataaacatagtagattaggtttgtaagaaacttttctcacaggtatatcctaaataccagacagctgcccagggggactgcttcagaagcatcctaggtcagatggaaaaagttctaggcaccatgcagacagaccacatagctggcctctggacagaggtaggaatagtacaaggcaatgtcattcctgtggcactaggtatagaaatttatacatgtttctaggtgatgatggtccttaaaatgcacttctcttcaggtacagctatgattgtgtcatgtacaataccagaaagagaagagaggctttttgtgaatagcacactccctatataaactagcctgtcttgctggctgcgtagttgaacacatactctcccagtactggggaaaaggaccctttttagaatgtgcaagtcccatgagagagtaatatgtccatattagagttttggtggtggtttttttttttttgttttttttttttgagtcagggtcttgctctgtccctcaggttggagtgcagtcatgcgatcatgactcactgcagcctcaacctcctgggatcaatcaatcctctcacctcagcctcccgagtagctgggactacaggcatgtgacaccatgcccagctaattttcttattttttgtagggacagggttttgctatgttgtccaggctggtcttgaactcctgtgttcaagtgatcctcctgcatcagcctcccaaagtgttgggattacaggtgtgacacaacatacccaccccatattagagttttcatttgaaaaaaaaaaatgttgttgctggttgttatatcttcagacttaacttgcttctaattctagtctggcttctttaagatagtgtgattctaagagtgttctaaacttaagtggcaaaatttaagtagatgattttatattcttgattaaagggggccagggaggttaatacagtaaatatttgaaattgatataaaataaatacatacatatatctaaaccattcatttttgcagctttcaggtaaaatctagcactttattccagtctatgagatgtggttagttgatatcatctaatattaagtaatgacatcagctatccaaatcctgggcacaattcctttagcaatgatgacctttaatagaatttagcttaaaaaactaggagatttctgctacagtgatgcaatctttcacatcttatttattaacaaaaatcaacaatccagctttccttaggtcttcacgcactaagagttctctagtcacagaaatcctagccttgtctgcactctccacaactattataaactccatgttagtatcaagagttccagtaaagaccaaatatctcttggccaccaacatcccacattaggaaatgtgcattactaattattctgttttacattacttcctgctctaggggatgtatgtacaaattcattcatagaaaattggtaaagcagccgggcgcattggctcatgcctgtaattccagcactttgggaagtcaaggtgggaggatcgcttaagcacaggagttcaagactagcctgggtaacatagggagaccgccgtctctatcaaaaagaaaataaaagaaaaaaaattggtaaaggacacacgtgataactgaagtttccagatgtgaagagaattctcattctcaggcagtggacccccccccccactcccctccacactccttccaccttcccaggccacctggcctcaggctgagggggaggtgaaagtttccaggaaccagagggcgtccaaacccagcggccgtgcggagctcaaggtcccgccgctgctgttgcggcaccagcctggctcatggacatcaccacgcacctgcaaggtcaggtttctctctggtggctgtggcggctgctaccctcctcgcccatttcaatcttactttcacactacatgactccactattacttcctgaacactagctacctacgcagctgtaatagtggacactgtgtcaacctttaagctcgcacacttatcaaacctcgttcttctatattaaaaagtgctagcttcccaacgggactatccaaagtgcagttgcaggacctgccaggagcccgcagggctgcgggtggttcttgcgtaatcgcgccaagaaagacctggttccagtttcagggacaactcgcccataaacttctactgcgcaacagcatctgctgctttgtctgacacttgttgttttcaagtacccctaaaaaagcgaaagaaagacttacctttctcggaggcacgaaccaagcagcctagaagacaaatgcgctgctcggagagactgccgcggcaaccaactggacaccccaagagctcactcctccgcggttttatattccgacttgcgcacaggagcggggtgcgggggcgcagggagtgtgggtaacaggcatagattccgcttgcgcaatacgtggtaagaaaccagctgtgaggggctggcccaacgcagagcggcgcgaggtccgcttggcatctacaacaatcgaggggctagtccagaagttcaaggcggggttacaggttggggaggaactgttaaactgtggactttttctcacctgttggaataagcttcaggcaaaactttgccaacaaaaaccggtccaactgattttagacgaaagtccaaaagcagtttaatgcaggacagataatcttttccacaaatgatactgaaaagacaggacatctatagattcccccccgccaaaaataacccttacataaaaattaagtggctagatataactgtgacgagtaaaattacaaaacggttttaaaaaacaacaaactattgtctaaggctaggcaaaaggttcttaaattgacattagtggcaagaccggtaaaaagaaatgttgatgaattagactccataaatttaaaacttttgctttgtgaaagaccctgtaacgatactgaaaaggtttacctaggagaaaatatttacaagccatatatctggcatacaaccagtatctagaatatgtaaataactcaaaaatcaattatttttaaaaatccaattagaaaatagtcagaagacataaacagacacttcactgaagatatgcagatggcaaataaccatatgaaaacctttaatgtcattagccattagagaaatgggaatacgaggctttcgttgttcttcgcctcccactagggcgggttgagggtctggctccagtagccccgggtgcctctcactccttgggcgcaatgctactatcctggcagaaccctcgccgaaccctcgcaggacgccccatcgggtccgccagcggctaggaagcccgattgtgtcgttcctttttccctctgcgcctcccaccgccagtcccttttccaaatgcgcctgcgtctgccctccacatctccgagctccgtctggcttctttctcccttgcctgtgagcgcctggcggcggatgcattgaaagctgcgcaccaccgcctaccgagcgttttggggagtgtgtggaagttgttggcagcaggttttgacagcagtaccctatgggcctagtcgttgacggtagcacctggttttgtgtgccccagccagctgaggccagggtgtgtggtgtgggccactggtactgctcttctgccactataatccctccccctaccaggtacctggtgcgtagaagtctaaagacctgtgaggtctagcctggcgcctgtaatcctagagaataaggaggttgaggccaggagttagagaccagcctgggcaacatggggagaacttgtctctactttaaaaaaatttagcccagtgtggtggtggccgcctgtagtcccagctatttgggaggctgatgtgggaggatcacttgagcctcccacatcaaggagatcgaggctgcagtgagccgtgatcacagccactgtactccaatctgagcaacaaagtgagaacctgtctcaaaacaaattccaacctgattctggtatagcatcacatgacaggtagcagccctaagggcgatcaaagtattttaccccaaaatatatttctgacatattttggaatggtcctgtgcaaagctatcttttgcgagggaaatttgtgttctgtggacaatctccttccctttccaggtctttctctgatccgggagagatttaactaagagtctgacaccgtttaaggtcatttaccttttgaggtacatatgccatctattctttctgaagcatattacaggcttcacatatgtaacaagaaccctggcttccacaacctccctcctgccaccactggccaaacccctcctcctccaaaatgtaccggctttccaggtcaaaccaatgtataccttacatatattgactgatgtttttgcctgtatcttctgtcttcctaaaatgtataaaagaaaactatagtccaaacaccttggacacatgttctcaggacctcctgatgctgtgtcacaggccgtggtcactcatatttggctcagaataaacctctaaatattttacagagtttggcttttttcactgggtttccccactcattttattggcattagctcatactctttctgtccaatcatatttctacattgctgtctatattttattaatcctaagttaaaaatagacaatttcctctatatgcttgggtcatcattctgcaggctcccatgtatacatattaaatacatttgtatgctttttctccaattaatctgccttttgcaggttgatttttcagtgagccttcactgaagtttccctttggtccctgcactggtaattaactcaaactgttttaccaaaatttgattcatagcctttatctcattttaccagaaaaataatttggatccaactgttctctataaaccagcaagtttatatgttttactatctcacaactaaaattctaaaataaaagctagaagacctttatgtgtatatttgtttaaatatatttacacatatgtacatgtattatgttgtatgttatgtctacataataaaattcagtgtggtaggccaaaaatcccttaagaaatgttaatctgattggtttaaatagatgggcactcacacaaaaacatagtaattaacctaatttttttagttcatgtaacttaatctttaaaaaagtaattggttttaaaattgttgataaaataaaattaaaaacgtctttctaattgtcaatatatatttttgcctgtgtttactggtgtgggggctatggctctcagccccccaaagatttgctggaaaatcactgacatgggccacattgattagtaagagaaaagacatacaaatgtatttaatgtgtatacacaggagctttcagaataaagacccaacttctcaatgagttatagaagtttatacactagtcttgaaattacagaaagaatggggggcttggattctggtaaaacagattatgggaggagaagaggaatttattgaggggcaatgaatgattggtgagagaatgattggattgagcaacagatattaacttgtaaatagttttctttggaatttaaataatccttggaggcagtcattgtacttctataaaggtctgcttgggtgtggttacattttggtcttcttttctttaacagatgagataacaggaggaggagaaccaacaattgctctccttggtgggtctggttgttaggcagataaaggaacttcagcttctttgggaaggatggtggggttggaggaaaagtcagagagaccttgaggcttctttagtttagcgtgtcaaataccatgttttggcatatcagtttctgagcaccagcactggtcagttttatatttgcctgtgctattaaggtcatgaagctataaaccaggcctaaagcaaagtgatatatatttatgcaattctttgataaataagattaatttaatattatttaacaaaaacagctgtggctgggtagtgactcccacctgcaatgctaaaacttggagaggccaaggtgggaggatcacttgagcccaggagtttgagatcagcctgggtaacataacaagacccaatctccataaaaaaatttaaaaattagccaggcatgtgcctgtgatcccagctactcttaaggctgaggaggggggatcccttgagcccagagttcaaggctagagtgagctatgatcacaccactgcactctagcctgggcaacagagtgagcctttgcctgtaaggaaaaaaacaaaagttgtattttctgagttatctacagatacccatgtatttaactttatggctcttatgtgggtaaacacctcatgttaacaggctatataattatttaatttaaaaaaacttgaaataatgaccagctccatctaatatctcaatttttgtaagaaatataggtataattgttaaaaaataaattaactgtaaatgaaataaatgtttataaatgaactcatgtaatttaaagtcttaaaattttatgttaaatcatatatacaaaataaatgtctgtatcatagtcagataagataaaatgattggttatcccacatttttaaaaaaagaaaaattataggactaagaggtaggggttaggaaaataaaaggtctaaagttgaagaggactaataaaggatgagctaataaaagaagttttatgtgttattgacttggctggaattaaaaacaaattgtttgtgtgtttttctaaaaattaaacgttctcaggtaggggaccaggggacaggcactgatacagaaccagagtctggttccttatatttaaaacaacaagatttcttgaagtattatctgattttaataaaattttaaggggttttgatttttaaatttatactctgtttttaaacaggtatcttctccttgacatctatttaattttcctagttttgggttaaaaatgttgtcttcttgatttaaagtggtaatttcattccttgaggtacagttgtttttttttttttatttctcaaattcatattgcagaagttcatcttttacagtttcttgctgtacatgatttgcaggtcaatatgtcatttccttcatttttttctcccctggagaaggcctgagatgatcattctcctctttggctttttttggttctaacattgctgttttggcctgacattagaatatttatcttgaaggcgtagaaaagcagcgtttttctccagtataacttaattttgtgctcttggcttttcttgatatgtctgaatttttccatataaccagaaaagttactgtggtaagtaacagcatgctgttactaagaaccatgtagttccctgctcaaggtactagttttcttgtttatattcctctataatatagtgtatacttataaccttggacatattcttcctgtgtttcatgacattcaagttcccttttcatcaggttcaacttccacgttatctgaatgagcttcccataatgaaaaacaatcacaccgaagagggctttctttacgtttttggtagcgagtctaagaaacaaagattttatgttttagcaaactaactttctatgttacctttattaggcttttgattacttaaaaaaaaatgagttttaaaagggttaaggtttctaaatccatgtgactttcttattgcttttgaagtcttttgattatgacactggttaaatgaataactgttatttcacagcaacctgtgattctgttttgaaccttttaacatctttgacaaatgtctcccaggtcaaatcctattttaagactttttgacctaaaattaactttgagattttttcagttaggctcctggaaaaccttaaaagacatatttctcattttgtagagatgactaggcttatttggtgaattgtataaaaacatcgtcaaataagtgatactagattttcttttagttacatttatgtacatgttgacatgaatgtttcaaaaattatataaattcatagaaatcgagtatgttttcagtcataattctaacataatcttttgttcaaattatactcatcgtccctgttgtagagctggacattctctgctgtaattcaacccagtcataaaattttacccaatggctacaacaggactcaagactcaaccagtttcctacatggtcttttgatttctttagttggttaccttcaacagtaggttcatggtttagcaccagtatttagaccagactgattatattagtgggtttttttgtgtgtgtgtgtgttatgatttttaaacttttttcttattacttgactagtctttgtaaagccagctctcccaacaagataatgttagcccagcaagatgattgactagacatagccaggtagaatagcttctaccaagggacagagacagctggtatactcctaacagattttcagagggaaggctgcccctaccacttccctccaaaaatgatgtagggaagacacagaagctgggctgaagtggggagaaacctgggaacactctatggggctaccgtgcacccggactctttccttgaccccagtggctctgagggcatgggtgagttgaacttgcaaggagcaacacattcttgccataggcctctggaaccccaccaggaggagacccctcaaccaccatggacacttgaattggcaggaagggctacttagagaactggtaggggcagcaagccagctgatgtggagcacagagggtttggagcaggaacatctgtagtggagcatggccagggacacccatcccccttggatcaacttacttccataggagactttagccccaggggaactgttagtcctgaactctgtagggcaatcttgcccatcagttggggctggtccaacctgagcaccccttgctctgctggcctcccccaaggccctagcctagccacacctgcttgcagggcaatctcaggcacgtgggggcccacatcatagtttctgtgctggcggactgtgcctgactggaaagctctagctgggtggccctcacagcccacatactccctccccacattgcagcttccctgagacccacagcaattcccaacattgcttcgctggtgcatatctttgcagacaggttttgctttccttgccctgccatctcaccagtatgtgtgcaccttaccctgccactgcagcgcgagagtgcagtctgaccctctctcactgctgaccatcattgcagatggagccttgatgagcacagagcgaattctgccccgacggtgccctgcccttgcactaacactgctgtgggagtgaaactaggtgcagaaaacaacagatctctccctggcctgagcaattactcatgcttgtgaggcacagagaaagctcacagacctgcacctgccagcatccagctcccaagccaacaccacaaccagtgcagccatgcacaccctcaccagcaggggcccctgctccccctagctgcattgcctccaccactatggtgaataccctcagggaggcaggcaccctagtaccctgccgcagttgccactaccactgctgctggtacctgtgaatgagaatggatcccactataactgcactacaaatgctttggctgacactgtgggcagcaagccacccaggtgccaaggcaagagaccaagggcacgagctgttccagtataataaaatatataaaataagaatagttatactagatatagatcttagatacgattttatatgaatatcattaatcattagtttgtagtaattactctttattccaatattataataatcctcactctacaatcataacctaggaaaaaccaggccatacagagataggagctgaggagacatagtgagaagtgaccagaagacaagagtgtgagccttctgttatgcccagacagggccaccagagggctccttggtctagcggtaacgccagcgtctgggatgacgcccgttaccaagtggaccgtggtctagtggtagcattagtgtcaaggaaaaacacctgctacttagcagacaaggaaaggaagtctccctttccctgggggagtttagagaagactctactcctccacctcttgtggagggcctgacattagtcaggcccacctgcagttttctggaggcctaaccatctccctgtgatgctgtgcttcagtggtcatgctcctagtctgccttcatgttccatcctgtacacctggctctgccttttagatagcagtagcaaattagtgaaagtactaaaagtctctaataagcagaaataatggtgtaagctgtctctctctttctcctctctctctctgccttggctgccaggcagggaagggcccccgtccagtggacacgtgacccatgtggccttacctatcactggagatggttcacactccttatcctgcccctttgtcttgtatccaataattatcagcgcagcctggcattctgggcactaccggtctctgcatcttggtggtagtggtcccccgggcctagttgtcttttcttttatctctttgtcttttgtctttatttgtacgctctctcatctctgcacatggggagaaacccaccgactctgtggggctggactctatagacaccacgcactggaatgtagtgaccagtggtctcggagtctgggagcaccttgaccaccaccaccccctcaatcccactgcagtgggtttctaactttgaggagccagaaaacgaagttggagcccaacacaagtcccccagagttagaacacatagtacaggaattggaatctgagcctcggctctgtaaaatcttccagaaatgaaaccagtcagctgaatataccttatactatgagcaaaccctcaaggacatcaaatagaataaaagaaaaaaaaacattcaaaggtcagcaacctcaaggattgaaagaacataagcccacaaggatgagaaagaaccagcataagaaccctgacaattcaaaaagccagagtgctttctttcctccaaattacctcatcacctctcaagcaagggttcagaaccagaagagatggttgatatgacacaaatagaattcagaacatggataggaatgaagatcactgagctacaggaatatgttgaaactcagtccaaggaagctaaaaatgatgataaaacaatgcagaagctgacagacaaaatagccagtataaaaaagaacataaccaacctgatagtgctgaaaaacataccacaagtcataatgcaatgacaactattaatagcagaacagaccaaacagtgggaaaaaaatctcagaactcaaagactggttttctgaaacaagagagtcagacatgagcagaaaaaaagaatgaagaggaaggaacaaaacctccaagaaatatgggattatgtagagatcaaatctacaacacattggtgtccctgaaagagagggggagaatgaaaccaacttggaaaacatatatcaggatatcatccagagaacttccccaacctagctagagaggccaacattcaaattcagagaacccccagtaagatacttcacaaaaggatcatccccaagacaaatattcatgagattctccaaggacaaaataaaagaaaatgttaaaggcagttagacagaaagttcaggtcaactacaaagggaagcctaccagattaacagtggacctctcagctgaaaccctataagccagaagagattgggggccagtattaaacattcttgaaggaaagaaattccaacccagaatttcatatccagaaactaagcttcataagtgaaggaaaaataagatcctttcagacaagcaaatgctgagggaatttgttaccaccaggcctgccttacaagaactcctaaaggaagtactaaatatggaaaggaaaggctgttaccagccacaacaaaacacactgaagtacacagaccagtgacactgtaaaggaaccacaaacaaatctgcaaaataaccagctaatatcatgatgacaggagcaaatccacatgtatcaatagtaaccttgaatgtaaatgtgttagatgccccagttaaaaggcacagtgtggcaagctagataaagaaccaagacttatttgcatgctgtcttcaagagacccatctcacatgcaattgcagacataggctcaaaatagagagatgaagaaaaatctaccaagcaaatggaaaacagaaaaaaagcagggattacaattatactttcagacaaacagactttaaaccaacaaaaattttaaaaagacaaagaagggcattaatggtaaagggttcaattcaacaagaagacctgactatcctacatataggaggaggacccagattcataaaacaagttctcaactttaaagatatttacactcccatacaataatagttttggagaatttaacacctcattgacaatattagatcattgagacagaaaattaactaagatattcaggacctgaactcagcactggatcaaatgaacctgctgacattgacagaactctccacacaacaacaatagaatatacatttttctcatcgccacatggcaaatactctaaaatcaatcacataatccaaagtaaaacactcctcagcaaatgcaaaataactgaaatcataacaaacaatctgttggaccacagtgtaatcaaattagaaattaagactaagaaattcactcaaaaccatagaatcatggaaatttaataacctgctcctgaatgacttttgggtaaataatggaattaaggcagaaaccaataaattctttgaaactaatgagaacaaagacataacataccagaatctctggaacacagctaaggcagtgttgagagggaaatgtatagcactaaatgcccacatcaaaaagttagaaagctctcaagttaacaacctaacatcacaattaaagaacttgagaaccaagtgaaaactaacctcaaagctagcagaagacaaggaataaccaaaaattagagccaaactgaaggagattgagacacaaaaaaccattcaaaagatcaccaaatccaggagctgatttttttttttgaaaaaaatactaaaatagaccactagctagaataataaataagaaaagagagaagatccagataaacacaatcagaaatgacaaggaggatattaccactaactgtacagaaatacaaataatcatcggagaatattatgagcaaccttatgcaaataaactagaaaatctagaagaaatggatgaattcctggatgcatacaccctcccaagactgaaccagtaagaaattgaatccctgaacagaccaataacaagctctgaagttgagtcagtaataaatagcccaccaaccaagaaaaagcccaggaccagatggaatcacagctaaattctgccagatgcacaaagaagagctggtatcattcctgctgaaactattccaaaaaattgaggaagagaaactgctctctaactcattgtatgaggccagcattatcctgataccaaaacctggcagagacataaccaaaaagaaaaataataataaaaataaatttaaaaaaacacttcatgcctatatccttgatgaatatagatgaaaaaatcttctactaagtaatggcaaacagaatacagtagcacatcaaaaagcttattcaccatgatcaagtaggctttatccctggaaaatcaataaatatgattcaccacataaacagaaccgaaaccaaaaactacatgaccatctcaatagattcagaaaagagtttcagtaagattcaactccctttcatgttaaaaccctcaacaaactaggcattgaaggaacatacctcaaaataataaggaccatctccaaaatcccacagccaacatcttactgaaggggcaaaagctgtaagcattccccttgaaatgaggaacaagacaaggatgccctttcttaccattcttattcaacatagtactggaaataccagtgggaacaatcacgcaagagaaagaaataaaaggcatccaaataggaagagaggaagtcaaactatccctgtttgtagacaatgtaatcctatatccagacaatcttatagtgttggcccaaaagcttcttaatctgataaacaacctcagcaaagtctcaggatacaaaaatcaatgtgcaaaaattactagcattcctatgcagcaacaacagtcaagctgagagccaaatcaggaatgtgatcccattcacaattgccataaaataaaatgaaataaaataaaataaaataaaataaaaacctagaaatgcaactaaccagatatgtgaaagatctctgcaatgaaaactacaaaacactgctgaaaggaatcagaaataacacaaacaaatggaaaaacattccatacttatggatagactcaatattgttaaaatggtcatactgcccaaagcaatttatagattcaatgctacttctattaaactaccaatgacatttttcacagaactagaaaaaaattattttaaaattcacatagaacccaaaaagatctcaaatagccaacacaatcctaaggaaaagaacaaagctggaggcattacactacccaacttcaaactatactatagttgggcaaaagtatactatagggctacagtaaacaaaacagcatggtactggtacaaacacatacacatagaacaatgaaacagaatagagagcccagaaataaggctgcatatctacaactatctgatgttcaacaagctgacaaaaacaagcaatggggaaagaactccctatttaataaatggtgcttggatcactggctagccatatgcagaagattaaaactagaatctttccttataccatatgcaaaaatcaactcaagatggattaaagacaattttaaaatctaaaactataaaaatcctggaagacaacataggcaataccattctggacatagggatgggcaaagatttcatgatgaagatgccaaaagcaactccaacaaaaccaaaattgaccaatgggaccaaattaaacaaaagagcttctgcacagcaaaagaaactatcaacagagtgaacagacaacctacaaaatgggaaaacattttttgcaaactatgcatctgacaaaggtctaatatccagcttctagaaagaacttaaatatataagagaaaaacaaacaaccccactaaaaagtgggcaaaggacatgaatagacacttttcaaagaagatatacttgtggccaataagcatatgaaaaaaagctcatcactgatcattagagaaatgcaaatcaaaaccacaatgagataccatcttacaccagttagaatggctattattaaaaagtcaaaacataacagatgctggcaaggttgtggagaaaaaggaacgtttatacactgttggtgggagtgtaaattagttcaaccattgtggaaaacaagatagtatggtgcttcctcaaagacctaaaggcagaactaccatttggctcagcaatctcattactgggtatatgcccaaaggaatataattgttctctcataaagacatatatgtacatgtatgttcactgcagcactattcacaatagcacagacatggaatctatctaaatgccaatcaacggtatactggataaaatgtagcacacatataccatataatactatgcagccataaaacagaatgagattatgtcctttgcaggaacatggatggagatggaggccattatccttcacaaactaatgcaggaacagaaaaccaaatacaacatgatctcacttataagtggaagctaaatgatgagaacacatggacatttagagaacaacacacaccagggcctattggagggtagaggatggaggagggagaggatcaggaaaagtaactaatggatattaggcttaatacctcagtgatgaaataatctgtacaacaaattcccatgacacaagtttacctatatacaaacctgcacatgtacccctgaacttaaaataaaagttaaatttaaaaatatttttagaagataatgttagcccaacacttcaaggtgattgctgttgtccatggtattgataagaggaaacttgatacttcccagagaaaattaccctgagaaaatttttccttctggactttttgttattcaaatgtggcccaagcccctgacatagaccctcatgccttctttccgacatgggacagagacaaccaggacaggcttaccccagcactgaggaacaattaagccaaattcaagatgattgatcagtgatgctttcagagaaagatcttgatcaaaagaagaaaatgggaagttgatcataccagttgggtcaattttgtcatcctcaactaaatcatattcaagggatcgaaggggaaaatcactcagaacatataacattgctccaagaatataattttctgaaatcttggcttatgaaactgccagttgtagcctgaagccagttttatctaatagctactgaaacatcttgctgagatgctagactaggtttatccacaaccatcactcaccaatcagtacttgccagctccctaaaaaatgttactagtgccaatgaactttctttcaaaacaatataaaacatttctccttcttgtggaaactccaacctttttttgcctccacacaaaaaagactgaagatcaaccagtctgtatgcatgtcccaaattgtaattcttacttccctaataaaacattttgaatttagaaatttgtctctatattttatttgacttcaacatattcatattatgggatgctactcaggaataaaaaagaattattgatatatgaaactacttagatgaatcacaaaaaattatgctgagtgaaaaaagccaatcctgaaatataccgtatgattctatctttgtagcaatcttgaaatgacaaaattatagaaatcgtgtattattagtagttgccaagggttaaggatgagggaggaggcatgggatgaaggtggatatgtttgtaaaatagcaatatgagaaattattgtgttgagagaactgttctgtatcttgaatgtggttgtagagatacaaacctacacgcatggtaaaattccatagaattaagtacatacacaaatgaatacaagtaaaactatctgaataagatcagtgggctgtatcgatgttaatattctggttgtaacattgactgtaattttgcaagatattaccatcagggaaactgagtcaaagttaccagagagctctctgtattatttcctacaattgcatgtgaatcttcaattatctaaaaattttttaaaaaggtaaattttagaaagcacttgcaaaaaaaataaaagcagcccaactctgatggctgtccattgcctacagaattaaagttcaaactctttagcttcatactccttgttccctgcaaaccaactttaaattccctttcgaatcttaccttccaaaagccttgtgcacaaactggctattcttgggaggtccttgtggcagcttgaccactcagcttatgcattcctgctgccctgctcccttccccacccccatcttcatctcctcatccacttaccccaatcctactctccttcaagccttgcctctaaatggcacctccagctggaaggaatttctcccttcttggagttcccacagcactattccaccttgtattgcagttatgtgtgtattgtttcatgttctccacaaagctatgagcttttcttggacaagactgaaattcatttatctctgatcccctcatgctagtaagtgccagcatgtgtcactcagaggcagccaagatagtggggaacatacattccacccagaggggtggagatctctgaaggaaagccagctttggatctagcctgacttcctcttcaggcctggttccaccacttctttacagtttggcctttgactctatcctaagtttccgcaattgataatagcagtgtgtgaaaaaaacaccttcctcaatacctagcacatagtagacactcagaaagtgcagctggagtttggggacttggtttccagttcctgtttggtcacgtactaattatataggcttaagcaaacaacttgttttccttttatattcagtttctctgcctgtagaatgggcacaaaatatttatgtctgaagtaagattgagttatgtgtgtaaaactactttagaaatgttagagaacaatattcaaggagagtactgattgtggagtatgaatgagctaacagtcacttgagtgttgaccacaagccaggcactgctctaacaattttacatgtgttcactatttaaatcttactatgattgtgtgaggtggagaccactgctatccctattttataaatgatgagactgggtatagaaaggttaactaagtggcagaggccaggagggctagctagctccaggtgtagagcattttacaccatgctgcctttctattaggtgttgttgaaagggcgttgttggaccttcataattataattttggaaatctgtttcttttcatttcctacaaggttctccttacaaacacctttgcttaagctctgtagaaaactaacagcagttgtatttcacacccttcacaacgagttaagtatcttctttacaatttttgacttcctggatcagggttacctaagaatcccttccctaatcccattcaagtgttttctactccctccaagtctgttcccaacctgtctgcttttgcctagcacccagctgcttcaaatagctcctcattggtagagatattatctcccacttcttagagaaaggaagccaccaggcaaaactcaccagctcctggaccatgcacattcttgggcattttctctttccttaatccatggctactagcttcatctgagccgtggattgtttttcaatatgtagtcctagtatcacctgtattggaatcaccggggatgcttgctaaaccacccagctccagtctacagaatcagaatctggaggtggggcctgaagctgggtgggaggggtgtctagattttaataaggcccctcaggtgactctgatacagaggcaagtttgaggcagctccttcagaactttgcttaatcaatcgtgtcttttctaacctaccagtctctctcactgtcaattagattctttctcctggcctgtaaatatactcaggtctcgactattctaataagaaaaaatgttacatcatggggttgtggtgatgaatagtgttaatatacataaagccaacagcacctagtacatacaatacatatgttggctatctttttttcttaaattttttttgtagttaactaaagcccatagtttatttggatttcctcagtttttacctaatgttttttctgttttgcaatctcatcctatgacatgtaattgtcatgtctccttaggcttctcttggctatgacagtttctcagactttccttgtttttgtttatcttgacagctttgaggagttgtagttaggtactttctaagatacccctctattgaactttgtctgattttttaaaaaatcataattagaccaggattatgggtctttgggaggaagatctcagaggtaaagtatagttttcattacatcacatccagggtacatgtacatactattgacatgatttataactgttgatgttgatgttgatcacctggctgacgtgttcgtcacatttctccattgtaaagttatgcttttcctgctttgcatactctttggaaggaagtcagtacgtgcaggccacttgaggggagatttatgcttacctctttgagggcaaagtagctacataatttttaaaaattatttggaattcttctgtgtggaagatttctctctaacccatttattaatcatttatttatatcagtatagatttaaggatacatattttgtgcttggggttataacccaatgctactttattagattgtaatgatttgttcaaattgtttcagctttggccattgggagttctttcagctggttcttatgctcctttgaccttctcattaatagactgcaggttttttgtgtgtttcagcaattcttggcattataagatgctccagactcatcttgtatattttctaccccattgctagaattaaccgtttctcaagtggaatggtatttttttttttaaaaaaatctattatgctggtttgtactgggaagtcattgttctcagactccctcaactgagagggcaaagaaatatatgtgtgtacacttgtccttgtctatacgaatatctataaatatttctatctatatctatttgcatctatattaagttaaatatgagttcttactgatgtctttgactatacccattactatatgcatcattctagccatcctcttgcagatctagaaatttccattccaacagtgagacatctggctcccatcttctgccatgtttacttagtcatccaatcccagtatatatgtatagtgggctcagaattgttaacttttcttaacttcatttccctgggaaatgtctttatcaactagtacaatgtttatgtatagttccttgactgttgtcttacatactccatttatttccagaatgacttcggttggtgttttccaaccccttcggtggagttataacagagtctctggttacagtctgcattctttcctagaggaatgtagtgattgtcacaatcttaagtaacacatccattgccacccatgatgtacattagatcttcagaatatagtgagtcttgaaatctagtcagtcctccaacattgttcttcagtacagtaagttattctggtttctttgcccttccacatgacttttaaaatcagtttgttactatccactaaatagcttactcagattttgatagggatcatgctgtacctgtaaatcaagtagggaaaaattgacaacaatattaagtcttctaatccatgaacatggaatatctctccacttgtttagatcttctttgacttctgtcatcagagttttgtagttctctgcatacagaacctgtacatattttgttagatttatgcctaagaatttcaagtacatctaagtattttgatgctaatataaatggcacggtgttatatatttcaaattccaatggttcattcttggtataaagaaaagcaatagggttttgcatattaaccttgtattctgcagtcttactattgtcacttattagttttagaaaggtttttgtgggtttttaaaatttattctatgggactctctacacagacattcatatcatgtatgtcacatataaacaaaagcagtttaatttcttccttcccagtgtgtacactccttgtttctttttctttgcactaactgggacttctagtacaatattaatcaggagcagtgagcagggacattgtgctttgtactcaattttagggggaaaacattcagatttttttttttttttttggtgagacagagtctcgctctgtcaccaggctggagtgtagtggtgcaatctctctgctcactgcaacctctgcctcccaggttcaactgattctcctccctcagcctcctgagtagctgggactacaggcacctaccaccacgactggctaatttttgtatttttagtagagatgtggtttcactatgttggccaggatggtcttgatttcttgacctcgtgattcacccaccttggcctcctaaagtgctgggattacaggcgtgagccaccgcagctggtcaacattcagattcttatccataagtacatcaggtgtgagtttttgtagatgttctttatcaagttgaagttgttttttctttctagtttgctgacagtttttatcattagttaccatgaattatggattttgtcaaatgcttttgctgaatcagtggtgatatggttaggctttgtgttcccacctagatctcatcttgaattataatccccataatccccacatgtcaagggagagaccaggtggaggcaattttatcatggggggtggcttctcccatcctgttctcataatagtgagtgagttctcacgagatccgatggttttataaagggctcttcccccttctctcaacacttctccttcttgctgccttgtaaagacggtgccttgcttcgcctttcccttccaccatgattgtaagtttcctgaggcctccccagccatgcagaactgttagtcaattaagcctccttcctttacaaattacttagtcttgagcagttctttacagcagtgtgaaaatggactaatacaagtgtttagaagaatatttttcttctttaacctgttgatgtgatatattgacttaaaaaaaattaacccagccttacataactgtgataaatgctatttgtgacatataattctttttacacgttgttgcattcaaattgctattattttgttgaagatttataatcacaggtggtctgaagttttcctttcttgtaatgtctttatctggttttgttattaaagtaatgctttcctgataaaatgaattaggatattttctctgtgcttctattttctggaagaaataatagaaaattggtattatttctttcagtatttagtagaattcatcagtgaaaccatctggagttgttggtttctttaatagaagattgttcattattgatttaatttctttaatagagacacattcatattattcttgtatgagtttttgtagttcttgtctttcaaggaatttatctatgaaacataaaatttgtgggcatgcagctgtttactgtaaggctttgttaaccttttaatgttcattggagcagtagttataacccctatttcatttctgatactgtcaacttgtgttttctctctttttttcttggttagccaggctagacgcttatcaattatattgatcttttcaaagagcaagtgcctggttttgttaattttccttattgttttacatttttaaattttattgatttttattgtaatttttattatttaattctgtttgcttaaggcttaaatttctctttttttcccaagtttcttaaggtagaactttaaatgattgatttttagagtttttcttttttccaagatggcaattcaatgctataaatttccctgtaatcactgctttcattgcacccaacatagtttgataacttttatttttattttgttttatatatttttaatttttcttaagacttattctttcatccatgtgttatttagaaaagcattgttacatctccaaatatttgggaatattctatcattttgttattgatttccagctcaattacattgacacttgaaaatataatttgtatgatttcttatcttttaaatttgtccaggtatgttttgtgacccagaatgtgatcctggtaaacattccatttgagaagaatgtgtattctgctgttgttgggtgagatactttttatatgttaattaaattgctaattggttaatgatgttgttcacttcagctgtattcttactgattttctacctcctggagatatcaattactgggagagttttttttatttaagtcttcaaccataataacagatttgtctacttctcttttcggttctattagtatttgcctcatgtcttttggtgctttgctatcaggtgcatgcacgttaatgattattatgtatcttggaaaattagcccttttatcattatgaaatgcccctgataatttatccctgatgattttccttgttctgaaatctgatttatttgaaattaacaaatctactccaactttctcttgcttagtattattatggtagacatttctctatcactttacttttaacctatttgtgcttttatattttaaatgggttttttttgtaaacaatatatagttaggtctcctttatctattctgacagtctctgtcttttaatttacatattcaaaccattcacattttaatatgattatggatatagttggtttaataactaccatgtttgtaactgttttctattaattgtactttttattttttattttttccctctttttctgccttctctagttgtagaacattttatgtcattttatatttcttctctcttagtacaacagttaccacaatttaaaaaaattttaatagctgctctagaatttgcaatgtataactttatgttcacctttaaataagactatgccactttacattcaattcaagtaccttataacatagtatttccagttcattcctgccatcctttatagtattggtgttattcatttcattcattcatatgctataactgcttgatatattgttaatataattacattgaacagttatctattagatcaatcaagaataagaaaagattttattttaccttcattccatctctagcattcttcctttcttcatttcttttttcctttttttcatttcttttatttgtttatttttttaatttttattttacgtttggggtgcatgtgaaggtttgttacacaggtaaacttgtgtcttgggggtttgttgtacagattatttcatcacccagctattaagcccagtacccaacagttatcttttctgttcctctccctcctcccaccatccaccatcaagtagagcccagtgtatgttgtttccttctttctcaagttcttataatttagctcccacttataattgagaacatacaatagttggttttctgttcctgcattagtttgctaaggataatggcctccagctccattcatgttcccacaaaagacatgatctcattcttttttatggctgcatagtattacacggtgtagaggtaccacatttgctttatacaacctgtcatcgatgggcatttaggttgattccatgtctttgttattgtgaatagcgctacaatgaacattcacgtgcatgtgtctttatggtaaaatgatttctattcctctgggtatataccaataatgggattattgggttaaatggtaattctgctttttgctctttgaagaattgccatactgcttttcataatggtttaactaacttacatttccaccaacagtgtataagtcttcccttttctctgccacctcagcagcatcagtttttaaaattttttttttaatagccattctgactggtgtgagatggtatttcatggtggttttgatttgcgtttctaatgatcagttacattgagctttttttcatgtgcttgttgggtgcgtatatgtcttcttttgagaagtatctattcatgttctttgcccactttttaaagaggttgtttttctcctctaaaattaagttccttgtagatgctggatattagacctttgtcagatgcatagtttacaaatgttttctcctattctgtaggttgtctctagtctggttggtagtttcttttgctgtgcagaagctcttaaatttaattagatcccactggtcaatttttgcttttgttgcaattgcttttggtatctttgttataaaatatttgcccttttttatgtccaggatggtagtgcctaggttgtcttctagggtttttatagctttgtgtttttttcatttatttttaatattttaaaagtttattactgttcaggggtacatgtgtaggtttgttatacaagtaaatcacatgtttcaagggtttggtgtatgttttgttttgttttttcacccaggtaataagcataatacctgatagtctttcaatcctcaccctccttccaccctccaccctccagtaggccccagcgtctgtagttcccttctttgtatccatatgtactaaatgttaagctcccatttataagcgagaacatgtggtattttgttttctgttcctgtgttagttcacttaggataatgacccccagctccatccatgttgccacaaaggacatgtcattctttttgtgactgcatagtattccatagtgtatacataccacattttctttatccagtctacattaatgagcatttaggttgattctatgtctttgctactatgaatagtgtgctacaatgaacatatgcatgcatgcatctttatggtagaatgatttatattcctttgggtatatacacaataatgggattgctgagtcaaatggtaattctgctttgaattatttgagaaattgcaaaactgctttccatagtggctgaactaatttgcattttcactagcagtttgtaagcactcccctttctctgcaaccttaccagcatctgttgttttgactttttaataatagccattctgactggtatgagatgatatctcattgtggttttgatttgcatgtctctaacaattagtgatgttgaacattttttcatatgatttttggccatgtgtacatctcttttgagaagtgtctgttcatgccctttgtccattttttaatgaggttactttttgtttgtaaatctttttaagttccttatagactgtggatattagacctttgttgaatgcatagtttgcaaatattttctcccattcagtaagttgtctgttgactctgttgacagtttcttttgctgtacagaagttctttagtctaattaggtcacatttgtcaatttttttttattgcaattgctttgggcatcttcatcatgaaatctttgccagggcatacgtccaaattggtatttcctaaggattttattagtttttacagttttaggttttaattttttacagttttaggttttacactgaagtatttaatccatcttgagttgatttttgtatgtggtataaggaaggggtatagtttcaatcttctccatgtagctagctagttatcccagggccaatggggactcccttctccattgcttgtttttatgacgtttgtcaaagttcagatggttgtaggtgtttggctttatttctgggctctctattctgttctagtggtctacatgtctgtttttgtatcagtaccatgctgttttggttactgtagccctgtagtatagtttgaagtcaggtaatgtaatgcctccagatttgttctttttgcttagtctttctttggctatgtgggctcttttttggtttcatatgaattttaggattgttttttctagtcctgtgatgaatgatggtggtattttgatgggaattgcattgaatttgtagaatggcagtatgatcattttcacaatattgattctacccatccatgagcatgagatgtgtttccaattgtttgtgttgcctgtgatttctttcagcagtgttgtgttttccttgtagaggtctttcaactccttaagtatattcctaagtattttattaattttttaattttttgcagctattgtaaaaatggttgagttcttgattttattctcagcttggtcacagttggtgcatagccgggctactgatttgtgtacattaattttgtaacctgaaacttttgctgaattaatttaccagttctaagagctttttggatgagtctttagggttttctagatatacactcgtgtcattagcaaaagcaatagtttgacttcctctttaccaatttggatgccctttgtttctttctcttgtctgatcgttctggctaggacttccagtactatgttgaatagaagtggtaagagtggacatccttgtcttgttctgtttctcagagggaatgcttccaactttttcccattcagtataatgttggccgtgggtttgtcatagatggcttttattaccttaaggtatgtcccttctatgctgactttgctgagagttttaatcataaagggatgctggattttgtcaaatgttttttctgcatctgttaagataatcaagtgatttttttgtttttaattctatttatgtggtgtatcacagttattgacttgcatatgttaaactctcactggtgtgaaacccactcgatcatggtggattatcttttttatatgctgttgtatttggttagctagtgttttgttgatgattttttgcatctatgttcatcagggatattggtctgtagttttctctctctctttttttttttaagttatgtccttttctgggtttgttattagggtgattctggcttcatagaatgatttatggaggatttcctctttctctatctttcggaatagcgtcaatgggattggtaccaatttttctttgaacgtctgacagaattcagctgtaaatctgtctggccctggactatttttccttggttactttttaattaccatttcaatcttgctgcttgttgttggtcttttcagagtttctaattcttcctggtttaatctagaaaggttgtacatttccaagaatttattcatcttctctaggttttctagtttattcaaatagaggtgttcatagcagccttgaatgatcttttgagtttctgtgttattggttgtaatagctcctgttttatttctaattgagcttatttgtgtcttctctcttcttttcctggttaatctcaaaaatggtttatcgattttatttatccttttaaaaaaccagctttttctttcatttatctttttgtatttttttgtttgaatttcatttagttatgttctgaacttgtttatttcttttctactgggcttgtggtttggtttgtgaccttagattttctatttgtgctctttcagactttgatgtaagcatttaatgctatgaactttcctcttagcaccacctttgctgtatctcagaggttttgataggttatgccactattattgttcaattaaaagaatttttaaattttccatcttgattgttgactattattgacccaatgatcattcaggagcaagtttttaatttccatatatttgcatggttttgaggattccttttggatttgatttccaattttattccactgtggtctgagagagtacttgatataatttcagttttcttaaatttattgagacttgttttgtggcctatcatatgggagtgtgtttctcaggccaatggagttatgtttccaggggggattatggctgccttttctgtgtgatgcaggtcgccagggaagtgggggaaagctggcagttaaaggcctcacccagctcccatggagcccaaaaggccgatctcactcccactgtgcccgcccgatggcaccaagtttatttccaagtagtgggtgagcagggctgagaacttgccccatgttcccagactcccagttgagaaagcaaacagggtttttaggttttgtgcctccctgcctccagcagcttctgtgctgtgtctgcactcctgattcaccccctcccctgagttctgtctgggaaactttgcgtccagttgaaattgttacaacattcaactggaagtttccttctccctgtggtcttttcccagttcctctggcagccctccctaaagatccctctgagacaaagtcagaaatggcttccctagggaccaagagagcccacaggctcttcctgctgctgctgcttctactcctgtattttgctcagctctctaagtttgtctcagctccaggtaaggtcaaatccttctcctatgatctggaccttcaggttccccagtgaaggtgtgtgtttgggggaggatggttcctctttcacacttgggacactcgcagttttttggctgtctcccagggccagcaggagcaatccacttccttcaaagggtctgtgaattctcttagctttcctggtatgttctgtagtagttcttggaacaaaagttcatgatatgagtctctacatgctgctacatccacacgagtgggagctacaatttagtcctgccttctatctgccatttttctcctcctgcctggcttctagtgcagagcatgagtggaattacctgcactgccatcagggcatttcccaggacagtaggagactgcactctctgacttagtccacacaaaagtgggaccactctgccaaaagctctagcagatgttgccttcctgggtaccagtggcagaagtgggtgcggtcacacaccctgacatccaggtactacccagatcaacaggagactgcaccatccagctgagttcagacagaagtgggaccgctgagtcagaagcattgcccacctggctgcccacttcagactgaagtgggaccactgggccagaagtcgtcagcctgttctggcaaggtgtggatggagcaatcttactgttcccaggcaccatatttgtagcctttactggggctatggtatcagtgcttgtctgctctggggcccaaggcttgtagaggccccctggactcaagcattgacccacaaaacatctaggtggctctctgcctcagtctagaagcatggttgggggatgcagtgggggaagggggattctcccattcccagccttgcccgggtccctgtggagagtgtgaatcccctagagggctcccattcactcaccctttcccatgttaaagagggtctcctggctccctgctgagtccagacaggctggcacccagcttcactcctctctgctctctgtatccctggttgccttgctggatctcaacgtggtttctcagatgattggcctgcaggatcggtgttcacaagcccatccgtttttcttcatgagagcagcatacacgagctgcctttagtccaccatattggccccctccaccaagtatcctttctttatttaaatctgagttctgagctatatcatttttcttctccttgaaaaatttcttttaacattcctgcagggcaggtgtgataatgatacatttccattgtgtgtctgagaaactatttttctccttcacttttaaagaataattttgctgtatataaaattctaaggatggtgagtgtctttctttcaatgctttaaaaattgcactgaattatttttttttttggtcttgtttctggcaagatgtctgatgtaattcttattttgttcttctgtaggtaagattttttccccttccatcttcgtttaagattttctctttgtctttgggtttctgtagtttgaatatgatatacctgggttttaattttttggtattaatatttatcctctttggctttccgtgagcttcctggatctgtggtttggtatctgtgattaatttttgaaaactctcatccattgttatttcaagtatttcttttcctatatttgctctcttctatttctagaattcaaattaaatatatcctcttctatttctagaattcaaattaaatacatcctcttctatttctagaattccaattaaatatatcctcttctatttctagaattccaattaaatatatactttttttttgtaattgtctcacaattcttgaacattctgttctttttattatcattattcttttattttgtctttgcatttcagtttgtgacattgctactgatgtatcttcaagctcactaattcttgtctcagctgtgtccagtctcctggtgagcctataaaaagcattctttagttctattacagtaagtcctcacttaacatcattgataggttcttgaacactgcaactttaagtgacatactgtgtaaggaaaccaattttcccgtaggctaattgatataaacaagagtaagttcctacagcatagagtaccttgttttgcttaaagctgcaatgtctgagaacctatggatagcataaagtaagaacttaactatatggtgtttttcatttccagcatttcttgattcttagagtttctgcctctctacttacattacctatctgttcttgcatgctatttttttgaatagggcccttcatattaaaccattgattttaaattccctgtctgataattccaaaatctgcatcatatctgaatctgattcagatttttgctttgtttctttatattatgaggtggtttttctttttacctttttgtgtgatttatctatttttgtttatagatatattgagtaattatatataattatattgagtattatatataatgtatgtaattatattcagtattatgaagccagatatattgagtaattataactcagataatcaggcctctagtatggagattcactgttcatctggttacaggttgggctgtgtttaatgtttcctatagctataggtgcccaaggctttagtttcctctagaatccttgttttatttttctactccattttctttgggtttccctaagaaatccttctaaaatagtgtggtagttctttcagttataatctacttttattaatttgtacctctgttgatgtaccgataaggtatagtagaggaaacggttctacaatctcatgtttaaatctgttttttttttagtgtgcctgagtctctaagcttcagaagtgtttctttgcctttatttttattttttgttcatctaggtgaaacaggaatgctacagaggtctagagttggctcagtgctttcaccccaggtagatacaactttggtaaagttgtttctctatcctgggccacaaacatattctcctacttttttcagtttaactttagtttcacctttcacaataaagtctttaacttaactttgtatgtaaaattaatatttacgtacaattccaagccccctacatgatccaatcacctcctaccagggccccatctccaccattgggaattacatttcaacatgagatttgggtggggacatagcaccaaaccctatcagacattaaccttggtcatgcagctgaggtaatgtttgtcaggtttcttcactatataatcattctcatcatgtattgagctaggtttatatttcttatgtagtgaagcaggtttctcagtgctatctaccaattagttagatgtgtatttgtaatggaaaaaaagtattgagagatttctcccaatgttgggggatggagtttggggtagggctggaggaatgagaaaaagcttcacagagaccatgctgtgccatctgaagtgaactttgaagggaggagaggacaatggggaaaggcatttcaggcagaatgatgccaacagagctaagagccaataaagcatctatgagtgaaatagtagttgaattggaatccaccctggaaatcatctgtggcctaattacctcatttcctaggtgagtactataatttgcccaaggttacacagctagaaatttgtagagctgggattcaaactcaggagagtgacttcagcacttattttcccaacacagaaggaggttaagacctactcagggtggcccagccaatcagatgcatagccaggacaaagccatcagttcctgtctcccagttcctctactttcacaagtatacaccttgaaacataatgctcagaaatcctatgggaattttagtgatggagttaacatagtcctctggggttaagggaaataaggttctgtaggaatcagaaatcaaatattctcaggaggcagagaggatttatagagtagcactaattacagttttgaatatgctgccagcatagtcttcttaattaaatgagccagaatacttctttggaaactttcctagatgatcaggtctgtgtaagtgaatacttatgccttatactcaaaggaatgcaccaaccacctaaagccagctctccccttgaagaagagagtggtgggaggagagtaggactagcagagaagggcctttccaggagtgatatcattatagcaattagaagtagattagatgttcacacaacagtacaaatggatgtgaaaaacatagtgtttactgaaaaacagtaagaaaaagagatgaggtatatggcacttcatcatttatgtaaattaaagaggtatgcccacaaaacaatattatacattttgcaggaacacattcatacaacatacatactaagcacattagagcagttgtccacaggaggcagggaaagaacatgactaagcaggatatgcatatatctttatatacatcgattgtgtttgtgtgtctgtgttacgatcctgagcaatgacaaggacagcagcattaaatgactttttagaagccctcatacttcttggcactattcagatttcctcattttctttttttctagcgtcctttttctgtctcaggatcctaatcatgttaccacattacacttggtgatcatgtctccttagctgcttcttggttctgacagtttctcagattttccctgtttctaatgatcttaacagttttgaggactactagtcaggtattttgtagaaattggtattggaatttgtctggtgtttttctcatgattaaactgacataatacatttttggaggaagaccacagatgtacataatcattctcatcatatcatatcaagagtacatatgatcaatgagacttatcactttcatgttgtattactctgttcttacactgctataacgaaatacctaaaactgggtaacttacatagaaaagaggttttaataggctcacagttctgtggactgtacaagcttctgcttctggggagaccttgggaaagttgcaatcatggtggaaggcaaaggggaagcaagtacatattcacatggctggcaggagagggagaatgaaaaaggaggtgctacacacttttcaaacaaccaggtctcctgagaactctattataagacagcattagggggatggtgttaaaccattagaaaccacccaaatgttccaattacctcccaccaggcctcacctccaacattgggaattacagtacaacatgagatttgcgtggggacacagagccaaactatatcagatattaaccttgatcacctggctgaggtaatgtttatcaggtttcttcactataaagttactcttctttttctctttccatatcatacttacagattacttactttaaaactttaaggctaattaataggattacaatagccaatgtttacaatgaagtgttttaaattattaataacaaaaaggtttttagacaagatggacaagatgcttcctttttcctgcactaacagtgggagagatgttttcttctgactcataaagcttgtacagagaatctgatttcttaaagtcttgagttgacatttacaaggatgttgatcttgttttccttcataatttggagatgtaaatatttcaaactttcctattggttctgctatttgtaaatatacagctgtccttggacacataaggtgagaataattatagcatatcacagtaacaatgtaagaatcaaggggactgataagcaagggactgagaatgttggaggaaaggaccttgttaacgtggcaactcaaggacagcttcatgaaagtcttaacatacaagtgttatttgaacaagtagaggaggccaacagtacaccacatgcactaaggcaggaaaggaaagaacatgacgtataggcaaagtctgccatgtgagagcatagggtgtgtagaacttatgcaacaggctaaagagtttgcacttcattctgtaatcctgagtgtggaggacaatggcatttttgggcaaggagagtaatatgatcagatctgagctttagaaaaataactggcaactatctaaatgaaatttgaaggataagagcctggagagaaacatagaagttattattaaaaactatgaaagaatatatacaaaagaggggatattgaaaataggagtaaaaatatgtagagagattatggaggcagaatagacaggccttggggccaatttcatagctaacagtggcagagactggcaagatccttaccaaacctgtatcttcctcttcctgggcacacagctggactacatttcccagcctctctggcattaggcacagctatgactgactctccagccaaaatgaacattatgggtgaaagtcatgtatgccactttcagacctatccttctaccataagactggaatggagagaactttcaagaccactctgagagtcatgcatagaatataatagaactatggggtagaaggagctgtagctcccaaattacttcctggagaattactcagcctgcaatagactttgagacaactgagaaataaactatttccctactgagcctttatatgcttggacttttctgtaatcacagcatactgtggactaccctaaccaaattaaacattgatactttgaagtgggtgctcctacaacagaaaactaaagcatgtgacctgggctggtgaggagacaaattattagagactggaatggctgaggagccctgttttgctatgccaaactatttgacaaaatggttgcctgcctaaagttctagaaaagtgattgtaagtcagaaagatagtgtgtgttggccactatggctgctttgagtaagatattacaagacaaaggtgtgcttgggcaaaaattgtgtgtggcaagcacaggtgaaaggaaacagagaatatctaatgttgggctttgaatagaagaggaaaaaactgcttctagatcctgaataaaaagaaaaaagatacaggaagccagaaaagtccattagactcacttggtagtacagatgagatgaagggtgttgatgtctcatgagcctgctagcttcaagttagtaagagaggcatggcgggtagttagacagagaaagaaaacatatttgaagggtgcatcagaaaagaagtgctgttaatgacacaggaaacagattagcaacaaatgaaacaaaaacctactactgtttgaggcaattttactaccaaagaaaccataagccgggtctagaaaagtctgtattatggagagttgctttttaaagaaaatctcaggaagaaagtgagtgtacttgggtctactctaacacccatgttggagatgaacaaatatgaaaatgaacagggaagagcttcccaaagaacaagactaggggcctcccagaacagtgagtgagaaagatcatcccatagagcagatcacagcctaactaaggacttcctcgtttagggtagagagcctttacaatgtctgcctagtgggatttctgaattgccaaggtccagtgaccacagtgtgcctcacattcttcctctgttttctaatgggcgttcattatgattatcttattcttcctctgtaatcatgtgcatggtgagtggccctgggggtaatggggaataactttcctttttcattaataggtcaccaaactcgagaagcaaaatcagcacctgatggcaattgctgcccatcactcagagatcctggacttgaggctgaatgctgtgatgggataggatttgagggaagggcacaagtgtgttctttgtgtgagaagcagagtgaaattgctttttgacaaccagtagggcagtctgtgtgaaaaagtgactaagggctcaccaagcctgattcctcttctttctaggcacacatgaagactgcatttcccagccttccttagagttatctgaggccatgtgactgagttatggccaatggaatgtgagttatggccaatggaatgtgaatgggtctgtttgttaccacagcagaatctagcctacctagactaacacactagcatttatagatacaagtatttgctacgtgctccatgtatattagctcatttaaccaacaaaaccaacccaatgagataggtgcaagtataatataatctccattttacactgaggacactgaaactgagagaagccccaaatcatacaaataataagatatagaccattgtacttgggagggtcctctctaacacccactttggagatggacaaatacgaaaatgaacagtgaagaacttcccaaagatcaagactaggggcctcctagaacagtgagttatagagatcatcccatagagcagaatcacggactaactaaggaagttatcttatttatctaagagcacaagagatagaaactcttcaccacaatgctctatcacttcttgaggccaaagataatttctatgttacttggaaactagaacaacagcagagataataatataatcctagaatattgggaaggtccctggcaatcttggtgaggaaagcacatgcagtattggagacatgagctagtgtgcaagggactggggtgttcacaggtggacatccacaagctgcatgcattggtggctccagaatttctgtgtcagtggctaaagggccgtcattgagttggcatgaggcttgaaatgcatatgcatagtactttccattagttacagaaaatgccaatattctttacttgaaaatgggacaaggaaagcaacagagtttgagggcctaaatcccacttatgccagccctgagtacttcctatatgcttgtggtcaagcccagcctcatctctcccagcttctcttcacacactggaagcctcacccaatccaaaccctgccaccctaccctttctcacttctgtgagcagctaggtggccgagtggtgagcgtgtcctaaatattcatccagagccgagtttgaattctggctctgcaatttattgtcactagtataacctcgggcatgtctataataatacctacctatgaggattgtcatgaggtttcaatgaaatcatgtatatgatgtgtttaacatagtgcctggcccataatacgcacttaaagtaaaaaaaaaaaaacttttgatgtgtgaaattccagtattttcagcttcaaacaacatctcctagatagctgctcacacccataagtgggagacagattctctgcagaccatgtattctgatttagggtgttgaaaagagagtcaatacatagcaattggagtccacaggaaagaggactcatcggggcctgggatggtcagcaaagccgtctggaggaaactgcacttggatgcagtttgaaggtggagttgattcatccaggaagaagtgagtgggcgaggcatggacaaatgcttaaaagcaggaagcacacggtatttcatggtggtgatttttattttgctaatataggctctacccagggtatcaatgagagctatgttaaaaaggtagcttagggaaagattataagggtcttgaaatttctccctcccttcttttgtttcttttcttttctttttttaattacacttttaagttctagggtatatgtgcacaacgtgcaggtttgttacatatgtatacatgtgccatgttggtttgctgcacccattaactcatcatttacgttaggtatttctcctaatgctatccctcccccatccccccaccccatgacaggccccggcgggtgatgttccccaccctgtgtacaagtgttctcattgttcagttcccacctatgagtgagaacatgcagtgtttggttttctgtccttgtgatagtttgctgagaatgatttccaccttcatccatatacctacaaaggacattaactcatccttatttatgactgcatagtattccatggtgtatatgtgccacactttcttaatccagtctatcattgttggacatttgggttggttccaagtctttgctattgtgaatagtgctgcaataaacatgcgtgtgcatgtgtctttatagtagcatgatttataatcctttgggtgtatacccagtaatgggatcactgggtcaaatggtatttctagttctagatccttaaggaattgctacactgtcttccacaatggttgaactagtttacacttcaacaaacagtgtaaaagtgttcctatttctccacatcctctgcagcatctgttgtttcctgactttttaatgatggccattctaactggtgtgagatggtatctcattgtggttttgatttgcatttctctgatgaccagtgatgatgagcattttttcatgtgtcttttggctgcataaatgtctttttttgaaaagtgtctgttcatatcctttgcccactttttgatggggttgtttgatttttttcttttaaatttgtttaagttctttgtagattctagatattagccctttgtcagatgggtagattgcaaaaattttctcccattctgtaggttgcctgttcactctgatggtagtttcttttgctgtacagaaactctttagtttaattagatcccatttatctattttagcttttgttgccattgcttttagtgtttagtcatggagtccttgcccatgcctatgtcctgaatggtaatgcctaggttttcttctagggtttttatggttttaggtctaacatttaagtctttaatccatcttgaattaagtttcgtataaggtgtaagaaagggatccagtttcagctttctacatatgcctagccagttttcccagcaccattgattaaatagggaatcctttccccatgtcttgtttttgtcaggtttgtcaaagattagttggttatagatgggtggtgttatttctgagacctctgttctgttccgttggtgtatatctctgttttggtacctgtaccatgctgttttggttactgtagacttgtatagtttgaagtcaggtagcatgaagcctccagctttgttctttttgcttaggattgtcttggcaatgcaggctcttttttggttccatatgaactttaaagtagttttttccaattttgtgaagaaagtcattggtagcttgatggggatggcattgaatctataaattaccttgggcattatggccattttcatgatattgattcttcctattcatgagcatggaatgttcttccatttgtttgtgtcctcttatttcgttgagcagtggtttgtagctctccttgaagagatccttaatatcccttgtaagttggattcctaagtattgtattctctttgtagcaagtgtgaatgggagttcactcatgatttggctgtttgtctgttattggtgtgtaggaatgcttgtgatttttgcacattgattttgtatcctgagactttgctgaagttgcttatcagcttaaggagattttgggctgagacaatggggttttctaaatatacaatcatgtcatctgcaaacagggacaatttgacttcctcttttcctaattgaataccttttatttctttctcttgcctgattgccctggccagaacttccaacactatgttgaagttccctgtcttgtgccagttttcaaaaggaatgcttccagtttttgcccattcagtatgatattggctgtgggtttgtcataaatacctattattttgagatacgttccatcaatacctagtttattgagagtttttaacatgaagcgctgttgaattttgtcaaaggccttttctgcatctattgagataatcatgtggtttttgtctttggtcctatttatgtgatggattatgtttattgatttacgtatgttgaaccagccttgcatcccagggatgaagccaacttcatcttggtggataagatttttgatgtgctgctggattcggtttgccagtattttattgaggattttcgcatcgatgttcatcaaggatattggtctaaaattctcttctttttgttgtgtctctgccaggctttggtatcaggatgatgctggcctcataaaatgagttagggaggattccctctttttctattgattggaaaaatttcagaaggaatggtaccagcttctctttctacctctgttagaactcagctgtgaatctgtctggtcctggagtttttttggttggtagcctattagttattgcctcaatttcagagtctgttatttgtctattcagggattcaacttcttcctggtttagtctagggaggatgtatgtgtccaggaatttatgcaattcttctagattttctagtttatttgcatagaggtggttatagtattctctgatggtagtttgtatttctgtgggatcagtggtgatattcccttcatcatttgtttattgcatctatttgattcttctcttttcttctttattactcttgctagcagtctatcaattttgttgatcttttcaaaaaaccaactcctggattcattgattttttttttttttttgaagggttttttgtgtctctatttccttcagttctgctctgatcttagttatttcttgccttctgcttgcttttgaatttgttttctcttgcttctctagttcttttaattgtgatgttaaggtgtcaatttttgatctttcctgctttctcttgtgggcatttagtgctataaatttccctctacacactgctttaaatgtgtcccagagattctggtacgttgtgtgtttattctcattagtttcaaagaacatctttacttctgccttcatctcgttatttacccagtagtcattcaggagcaggttgttccatttccatgtagttgtgcagttttgagtgagtttcttaatcctgagttctaatttgattgcactataatctgagagacagtttgttataatttctattattttacatttgctgaggagtgctttacttccaaatatgtggtcaattttggaataagtgcgatgtagtgctgagaagaatgtatattctgttgatttgtggtggagagttctgtagatgtctattaggtctgcttggtgcagagctgagttcaagtcctggatatccttgttaacgttctgtctcattgatctgtctaatattgacagtggggtgttaagtctcccattattattgtgtgggagtctaagtctctttgtaggtctctgaggacttgctttatgaatctgggtgctcctgtattgggtgcatatatatttagggtagttagctcttcttgttgaattgatccctttaccattatgtaatggccttgtctcttttgatctttgtttgtttgaagtttgttttatcagagactaggattacaacccctgctttttctttttcttcttctttttttttttttttttttggctttccgttcgcttggtagatcttccttcatccctttgagtctatgtgtgtctctgtacgtgagatgggtctcctgaatacagcacactgatgggttttgactctatccaagttgccagtctgtgtcttttaactggggcatttagcccatttacatttaaggttaatattgttatgtgtgaatttgatcctgtcattatgatgttagctggttattttgcccgttagttgatgcagtttcttcctagcatcaatggtctttacaatttgcatgtttttgcagtggctggtaccagttgttcctttccatgtttagtgcttccttcaggagctcttgtaaggcagtcctggtggtgacaaaatctctcagcatttgcttgtctgtaaaggattttatttctccttcacttatgaagcttagtttggctggatatgaaattctggtttgaaaaatcttttctttaagaatgttgaatattggcccccactctcttttggcttatagagtttctgctgagagatctgctgttagtctgactgggcttccctttgtgggtaacccaacctttctctctggctgcccttaacattttttccttcattttaaccttggtgaatctgacaattatgtgtcctggagtttctcttctcgaggagtatctttgtggtgttctctgcatttcctaaacttgaatgttggcctgccttgttaggttggggaagttctcctggataatatcctgaagagtgttttccaacttgtttccattctccccgtcactttcaggtacaccaatcaaacgtagatttggtcttttcacatagtcccatatgcctgggaggctttgttcgtttctttttactgtttttttctcttaacttctcctcttgcttcatttcattaatttgatcttcaatcactgataccctttcttccacttgatcaaatcggctactgaagcttgtgcatgcatcatgtagttctggtgccatggtcttctgctccatcaggtcatttaaggtcttcactactctgttaattctagttagccattcatctgatcttttttcaaggtttttagcttccttgcgatgggtttgacatcctcctttagctcggagaagtttgttattaccgaccttctgaagcctacttctgtcaactcgtcaaagtcattctccatcctgctttgttccattgctggtggggagctgcgatcctttggaggagaacaggcactctggtttttagaattttcagcttttctgctctggtttctctccctctttgtggttttatctacctttggtgtttgatgttggtgatctacagatggggttttggtgtggatgttctttttgttgatgttgatgctattcctttctgtttgttagttttccttctaacaggtccctcagctgcaggtccgatggagtttgctggaggtccacttcagaccctgtttgcctgggtatcaccagcggaggctgcagaatagcaaatattgctgcctgatacttcctctggaagcttcatctcagaggggcaccttgctatatgaggtgtcagtcgtcccctactgggaggtgtctcccagttaggctacacaggggtcagggacccacttgaggaggcagtctgtctgttctcagagatcaaacactgtgctgggagaacctctgctctcttcagagctgtcagacagggacgtttaagtctgcagaggtttctgctgcctttggtcagctatgctctgcccccagagatagagtctacagaggcaggcaggccttgatgagctgtggtgggctccacccagtttgagtttccaggctgcttcgtttacctactctagcctcagcaatggctgacgcctctcccccagccaggctgctgccttgcagtttgatctcaggctgctgcgctagcagtgaggaaggctcagtgggcatgggacccactgagtcaggcgcaggatataatctccttgtgttctgtttgctaagaccatggaaaagtgcagtatttgggtggcagtgagctgatttttcctggtacactctgtcacagcttcccttggctaggaaagggaaatccgccaaccccttgcacttcccgggtaaggcgatgccctgccctgcttcggctcaccttccgtgagctgcacccactgtccaaccagtctcagtgagatgaaccagatacttcagttggaaatgcagaaatcacccatcttctgtgtcgatcgttgtgggagctgcacaccctctttcctttcttttataacaacagcagcaatggcaatgacaacactcccctccccccaccagaaaaatggcccagttattaaactgtgctctcagattaaaaattaaaacccaaatctgagtacccacatgtaggtgagggggcctttggccacacagaagagttttaacaactgtgttccttttatgataaggtgtccaaggactgcattcacctaggatgaatcacagcaatttgcagctctgtattgttggagacacttcaattctgctattagccagccagagctcaaatggttctgccttcatctggtccaggattaagaaaaaagtgtctctgggactggaagggggtgtaggtggctttgtgaactgtaggtgagaacagagtgtgattgaatgccagtgaagcctaaagtcttaagtccagttaggggtcctctaaggagttttgtcttcattgagctaccttcttcaaacttttcagggtatattctgcatgtagattttcttcaatgagtaaaaccttattcatttactactagttataaaccatagatgatttcttcctattgtttcatcaatgttgcttataaattgtcacatcaactgttacattagtttaatagtgtaaaaaaattctgtgagcctagtctgattaaggtattgctgaattttttaaaatattgaaatatagtacacataatgtatacatcattaacacatagctccatataatacatcaccatcatgcataggacattatcatcatcccaaaagccaagctcaggttccttccccaaaactactcccaatttatttactatacagtcttctaaaactatggtttagtttcgcttgcctttttttttttttttttttttttgagatggagtctccctctgttgcccaggctggaatgcagtggtgtgatatcagctcactgcaaactctgcctcccgggttcaagcagttctcctgcctcagcctcccaagtagctgtgactacaggcgtgtgccaccatgcctggctaatttttgtatttttagtagagaagagattttaccatgttggccaggctggtcttgaactcctgatgtcaagtgatctgcccacctgtttcccaaagtgttgggattacaggcgtgagccactgtgcctggccagttttgcttgtttttgaccttacgtaagtgggatcatttatatatcatcacacagtatatattctttcttgctgaatttctgtgctcaaaataatgtttgtaaatttgttcacattgtatagttttattcatcgtaattgctggtggtatttcattaaatgaggacaccacaatttatactatgaatggacatttgagctgcttccattcaggggccattacaaataaggctgttatcaatactcttataaatatctttttgtccacatgtgcttgcacttctgttggtataggcctaggaatggaattgctgggtcacagggtaggtgtttatttcaatttgtattttcttgattactaatgaggttgagcacctttcatagatatattagctatttggtatcctcttttttatacaggaagcatcttgaattgtctgtatttttatgtttgtataagtttttcatgtgttttggacataagttgctcacatttacatgtgttgcaaatatcttctactctttggcttactttccctctcttttaataatgtcatttgatgaacaaaagctcttaatttaatgtaatgtatccaatttattcatattttcctgtattgttagtgatctttgtgtcatttaataaatttttttctctagcctcacatcatgaagatattttcttattttatctaatagaagctctattattttaccctttacatttagagctaccatgcactgagaattgatttttatgtgtggtatgacataatgatcaagtttctctttttctccccagacagttactcaatagactgagcactatttactgaatgaccctttctctgctgctctacagtgctagcttgcaagatcgaatgtccaagtatgggtggatctgtttgaaaactctttcctgtagtctatttgtctatccttacatcaatatcacactgtcttaattactgtagtttaattacctataagtcttgatatctgatggagtaagtccttaggctttatgctatttacagtcctttgtatttctgtatatattttagaagctgctcagaattttttattaaaaaacactgctgtgattttaatggggattgcatataatggagtttgtttcataaagctttcttcattctaccaagatgggatatttctctgtgtatgtaggtcttcagtaatttatctcaatatatgttattttctgtgcagagatcttgtacatatttgttagatttattcaaaagtatttggtagttttgttgccactatgaaatgatatctgctttaaatttttattttctaatttttaatgctggtattaatttcatatcttgaccttgcatctggcaaccttgcaaagctcacttatttatgatactttaattgtaattattatggattttctttgcatatgtaaataacatttgcaaacgatcatagtttttctattccttatacccttggtttaatttctgttattgttgtaattactaggatttccattagaatactgtgaagaagtggtgattctgggcatacttggcttattcctagtctcagagagaaagcattcaacatttcaccatttattatgatgctggctttttatatggccctgatgaaattaaagaaattatcttcctttcctagttcttagtcttttttcatgaataggtgttgaatttaattaaatattttttaacctattgagatgtcagcgatttttatctttcatggtgttaattcagtgaattaccctgcctggcttttccaatgttaaactagaaattgcatttctagaaattatccaacttggttttgatcaattgcactttttatgtattgctgtattgagtttgctaatattccttttagaatatttgcatctatgtttgtaagtaatattggactgtaattttgttggtatcaagttgatggtgtcaaaattatagaactttataaaacaaataggaaaatttctcctttttccctattctctggaatagtctgtgtaattgtcctatttctcgtatgtttggtaaaatttaccagtgaagcccaacttttctttgtgggaacaaaattgaatataaaatttaaaaaatattcatagagattattcatatactctatttcttcttgtatcaattttagtaagtttttttaagaaatttgtccataacatgtaaaaattcaagtttattggcataaaattgttcatgttatcctcttattaactttgtagcatctgtgtggaaactttgtcgtctgtgatgatatccccctttttatttatttatttatttatttatttatttatttatttatttattgagacagggtctcactctgttgcccaggctggagtgtagtggtgcaaccagagctcacagcaacctcaacctctcaggctcaagcaatcctcccacctcagcctcctgagtagttgggactacaagtgtgcgccaccatgcctggatatttattttattttattttttgtagaaatgagatctcattatgttgtctcaaactcctgagttcaagtgatcctgctgttttggcctcccaaagtgttgggattactggtgtgaaccactgtgccccgacactttttatttttgataatgggtaatttgctcttgctgtcttgctgacttgctcctgctcttgcttttgatctcttttctttttcttgatcagtcttgccagtttatcaatcttattgtactttttaatgaacaaacttttggcctactggttctctttattgtcatctgtattatatttcattaatttttttctgttttaattttttacctccttctcctgtcttttttatttaatttgcctttcctcttctaaaatcttgggtggtatacttaaaccattgatttcaactgtcttttattacatgcatttcagtcttacatgcatttcttttattacatgcatattctaagtatagtttagctatatcccagaagttttgatattatcaatgtttacattcaattagtttcaactattttaaaatattaattgtgaggggtttttgaaatttgcaaatagttttaaaacttccaagcatatgggtattttacagttacctttgtaaaaattaattttagcttatttccactatggtccaaatttattggagattttctttctgatctcggtcctgcaattcagcactgccttagtacttctcaaatgactgtatgaagctgggaatcatacagctgaagaaggccattacatgtgctgggaacatgcacctttgaaggcttagctagtggttctcaacctatcagatgcaacactaccattttaaatacatatatttgcaatattactttttctatcctgaaaaaaacttacaggtaatctaaatttttagaaaaacaatacagtatcctgttacatggaggataaataaataaaaagtaatttgtaacaaaataatgtttttcaacctggaaatgttcaggcatgactacactagagacaatgataaagttggcagatgttttcttctacatacattgagttaatatggatgtaagagaagtaagacaatactcaaagaatatttattgttgacgcttttttccttatatttaacattttgagataaaggctaaatgagtgtatttgtgtgcgtatacaagtacaatcaatgtgactgtgacaactgcaaatgcaaagctgataaacatgtgttgccttgttgactcaaataccagaagctgcgttgtcattgatgaaggaatatttcgaagcgctgaacaattcttgataaagttccgaaacaaacaaagcacaatcttccctcgatttacatgggagttgcattcctggaaaattcagtatattttaaaaccatgcaaaatatccttttaaaaaaatatgtaacatggagtttaggaccaaggctcaggtaactataaaaatttttacctacataaatttctagtggagtgtttgaaatttgtttaggactgtgtccttcattgtgggacatttgcagatttctcccttgcccactaaatctcaatagcacctcctccctcaattattgtgacaatcagttcctccacattcaacaaattttccaacacctcccgagcagcactgccatccttgttgagaacgtgtatctagttcatcttaagatagaactgcccccctcatccccactttctctcccaaatcctgtgaaagcccagcacaggcactgggggatacagcaagccacttaggaggattcccagcttgtgtcattgaatcatctttaaatttatttttatttttttttatatgtcttatcatcttccaaaaaggatgttttggtgaactgcaaagagatatactcagagacaggaaaaagatctggtagggtgaagaatgaaagaaaaacaggcaggcagaataaagctgaaagctgagcctagtatctaaaacgcacactcccagggcttgtatactcaataaagttgagaagtaactgggttgtcaatttaaagaggaatacttgatcagacacacaattctatgttgataagattaaaaacaagctctagtcatccttccgtacctgtaggagattggctgtaggacctttgtggatgccaaactctgcagatactcaagtcccttatgtaaaatggcataagggaccatttgcatgcaacctatgcccctcctcccatatactttaaataatctttagattacctataatacctaatacaatataaaggctatggaaatagttgttatactatattttttcatttgtgtcatttttattgttatttttaattttttagaatatttccaatccatggttgggtgcggaacctgcggatacagaggactgactataatatcaaggtaaggacatggattctggacccagactgcatacattcaacttggcttcacttttacaaactgtaggaccttgagcaaatcaccacatgcttctgtcttgttacctataacaggataatatcactacctacaataccacacaagtctattgtgaggattagataaattggtgcacataaagttcttaggagagtatacagtagttacttgtaagcactatataaacatttgccaaataagcagaaaaagttctcagagaaaacagtttttaccagcagtttttctcactaatagatgtggaattgaattacctagattgaaaactcagaggaaacttgacattcatcaattctaatctgtttgtgttacagtgcaggaaactgcagccagacactgaaagtctaggggccaagctcacatattagttgaggatccacaagttagttgaggatcctggtcccctggttcttttctgctgctcttgccaatatctcggcctggagctggcctgtggaggggtgcagagaagcagcctattgtctctccttcccagagtgtccacaggttccaaaattctaccttctcccaactgttctataacaccccaaactctcatttcttcctaaaggacagagagcaaagaataaatcaggtgtgaatgacccctaaactcaaaccctcaaggaatatgcaaacacatagtagagttcctttaaatatagtaaatcttcaactttgaggaagagggcgaatgggtaggtgggaggcaaaggttttaaatttagaaattaaaattgaattgtctaaactggcaaaagtctcaccactttccagttgtgagactgcacacaaagttacttgagagtctccaagcctcatttttctcttctgtaatgtcaaaacagagatcataaggctgtcggaatggactctttgtggcaataagataccatattataaacaggacccaaggtcatgccaggtaagaatgaagtcacacacccttcctcttaaggaataaactatattgtaactgcctcaaggttttttctttcactctagcagttaaacaagcactgataagtctccagcccaccatgaacatgggacacatgcaacatgcatgtttgctttactatgtatgcgagcatcccccacttcctaaatatttattgccccctgtaacctgctgaatatgtaaacataaacgtggccaaaccgttcagcataaattcctgctttacccctctctcccttgaagtgcctgcttttggtgtctgctggaggctatgcttcccagcctatcaggatggccacctgcaggctgtaaccttttgttagaagtaaagctctcctctccaagtttctgaaccttgtgattcttcagttaacagtaacatggggatgataataatcaacacctcatgggttgttgtgaagaagaaatgaaataatacaaagcacctagcaccatgcctggcagagaggggccaataaatgttcatcatatttgctattattattattattattataggcatcagcaacctatcagaagagaaatagttttcctttgctctttgaagaaaggaggccgccccagaaaggctttattcgtgtcctcttactccatgaacttagttaccttgtagaggggaacgggaatgtctggaaagaaagaacctgaagctcagtcccgataggatcacatgaagcgtcacaaagacagaagggttgcagggctgaatccaattcaaccactcactctagtgtgttcctgagagtgctgtcttctctctctgacccttaaacaaatatgtctacgttcactgtccagaatataatataagacagggcttggtattattaagatgctgcttactaaatgaggaactctgagatattgcacaagaaatctagaaacttcatgaattgggggtgagtctcccaatggtgaaagttcaggaagactggctgcaaggggctttgcaaaatacacgcttataaacacactttctcttcctttaacaaggaaaatgataaaacttcatagttacagcgagaaatactgggaaacaaaaaatacgctcttaaaatttcaataacttcatatattcattctacttagctgttacgggagagaaatcaaatatcttactgttgattttcattttccaagggactttgaactatgtgtgtaggtggcagtaaataccttcgttatagctgctgggagctgcagactctgcacacacaggtgaaggtggttagacttgtgtttcctgggaagcaagggcaagtaaggagtgtctaccatgggccagctatatgcctttggtattccattcaacaccctcctccctgtgttagaggaaacatttctcctcctgcattcttcccagcctgtaacaggactttctgtcctctgggggattgggaagttatttcctgccccttcctctttttacttcttcccaagggaaagaatgacttctcttcttagggaggttggagaagggtcctaaacagcgggctctcttgtttaggctgactgtgagacaattttttcattgcttctgctttcctatggggagaaccgttgaatcgtagcctgggatctggaggttgatgtctctcttcttgctctccagaattcattgatttgaggcatgcatctgacctccatgtttctgcaccacagactcaattctcctcatgtgcaggtccagacccagctggggttgtatcattttgaaggtcatctgattgcaggtccactttaagggctcctactcaacaaccaataaaggtcctatattcatctgtatttgctgaaatatgactatttctcaattggttcagaatcagagaagctctactacccagaagagttggaacgggccttgaaatgtaacccaagcatcttattatacaggtaaaaagccaaaaatcatatgcccctcttgccagctgaccttcccagaccccacccaggtctggccacataataatgtgcattgcccaaggtggcttgattgcctggtctggcagctggaggagtgggccctgcacctgacctcactgtgtcttggctttgtccaagtagaccccttgccttcgattgttttgtgcctaatgttttcactcatttagaaacacctgcatctttcttcccctggcagtgctctgaacccttttttttgccgggggcactgtcaccagtgtcttgagatatgttcctgttctgtatctgaccccagtggaccggaacctgcacgtaggtctgctgcctccctgcctagcgctctttctgctcccaccagggtgcatacctctgtgaattacatggctggacttctcttaacatcagactctattaactagaacaatagttttatctcatcctgtgattcaaagacggttgctagggaaaccagtggggatatgtttaatctgtaaatcctgtaattgccctaaagtagcaacaattcatgtgcttgcttcaaaaggatttggactgaactgactgggaagcaggtgagtgaagaagaacaatcacaggttggctccccttgtgatctgttcacattcctcataaggtgttttttcctgctgctttgccaaaaagctaaagggattaaagagggagcactgcggtgcccttctaatggaccaggaaagctagaaagacaaaattatgcagttcttctcttcttatggattcaagtggtcagagctgagtgattggaggctgtactggtggtgatggagagagataagaggataaatactccattttattttaaaatggattcagaatcctataattgtagtttgtagggggatactaactccaaatgaggagaagcaaggtatttgggaagtcttatcagaagaggccagggtggtctaagcataggagcacagagtcgggtttggaggcgtgcccagcatcatccccgccaagcctttccttaatccacagcagtattcagtgggtcacccacatgctgcttgggcactgccaaaaatggagaacttgctccttcccagagcagctcattttgtgtttaaacagccctgattgttagaagatctgccttaaattgaactgaaacatggggtgctgggggcaggggacaattttcctccttgacttggctgtctggcggagctcacagaggtttcttcataagacatgccctacctctgtcacagggcccacacccagcaagccacactggctcaagggcccagaactatccagaccgttgaagagtcccaccttgaggcacaggacagaagcagtagggagaaaactaaacattccttgatgtagtgtttgattaagaataaaatgcacagcttctgtctctcggggccctgcaatgtttgtgatttaaaaaaaaaagcaaaatctaagtgcagaccctgtttcccaggagaaaagtcacacgaaactcttctttatacaaaatggttctgagaatcatcactaccattatcggtggagatgactcagtattctagacttagctagttatgcaaagtccagggaggtcattgtgctctcttttggaaacataatagttccattaatgcagctgaatatcacatttgctctgagcagctgcatcccactgctgactcatgttgagctctacaatcagtgaaaacttggagggtatttctcctttgtaggtgcaatatcatatgatccctcctaagcccagctctattgggactatgggtgtccagggtccctcctagctccttgcctgcttttgctgtcaagtttgtgagttcaccttctgtattttaaaattcaggattgcagcctggtgcgatggcttgcacctataatcccagcactttgggatgctgaggcagaaggatctcttgagcccaggagtttgatcaagaccagccagggaaacatagggagacctcatctctactaaaaataatttttaaaaaagtagccaggtgtggtggtgcatgcctgtagccccagctactcaggaagctgaggtgggaggatggcttgaacctgggaggccaaggatgcaggtagccatgatcgtgcctctgcactacaacctgggcaaaaaagcaagacacctgtctcagtaaaataaaatttaggattgcagggattgcaccctcctgtctctggttctttgttacctatcctgatctgtgaagtcttaggcagtcactgcctgtgcatagttgatgtatctatgtggtcccattctcttcagctctaatttatccagaccagcatgtttaataaggttagatgtctgatctaccctttattaatgtctattctcttttccaattcattgacagaaaagttggaggaaagccaggagccagggagttttgctttctttgatctgttgaagcagcataagtagtttacctaagagtatactgcccttgtgagaggtaacaatgcaagattttggaaaaagacatctaacctgagtgcttatactttgcataacccttttgcattgtttagtactactggtttttatgctacttaattgttttaaaacagggatttataaaaatagacacaatttgctaaattctcattcagttcagtcactcttaatggaaagtctagttttatatgccacaaagccataaccaaggtgccacctcattgtagaaaaagaatccagaaagaaagaaatggttttgagtagcaactttgaaaattccaaactatgaaacaaaggcagaaatcactgttacaaggtccttggctttccaggaagtccaaaacccaaatgaaaaaggcatcttgattttctctctgaactctgctcaaggtttactaagaaactacctaccacgtataaatgggaaacacacaaaagatgtatttcttggaaggtgaggggtgttagtgattttggcctcacattaagggagccagaacctgcctgaactgctagaaataaggggtggaaagacaggactgggttctggggctgcatccagggaaaacatgtcagtaccgtacacctaacaccagatgagtggacagagacatgtcaggagaaaagaggaaaaaggaatgccccgggctccaaaaagaaaaggatatgggattggtgtaagggtctgagggatgagagaaaagaaaagatggtgatacataatcacttctcttttttccttcagaatgatgacctaaaactaaacattggtcactgcaatcaaagtgttaatatgaaaaatcaagtacctcgctctgaaatttcagaatttcttggtggggagttaggactaggaagaatcacagccaaaaacaactaacagtaactcccatagcaatgctctatatttaagatgtagatacatccataatatatatactctggagtggtttattaaaaggcacttcgagccattcataaagaaataaatgatagtgcaaggcagccggactcaatggccaggaggggagttagcagtgagtgctcttgaggagatgccgaggctgggtgggcagagggtacttcgaggggggcctaagggagccctcagtgggcctgggtgatgatgtcctcagaatttcccagtgtgtgtgacctctgcagcttgagtgttcctaagggaagtttggaggataaagacagcatctctgggacaccagaccagtgtccttcaggtctgggagccccacagagcaacagctgggaaagtatacggttattggaggcaaaacaatcaaaattccattccagaaacgtgtcccttgcaaacctaggtacctgctgctcactgttcaatggtggcagacatttcagtgtaggcagctcagtgcttctcatgcatagacagactgcttcccacttccccacccaaggggcacctggaaacgcgtgtgcatgtgtttgtcactgtgtgtgtgtgtgtgtgtgtgtgtgtgtgtgtgtatgtgtgggtaggtgggtgggtgagtatagaggctactggtatgcagtgtccaggacaagagatgcttaatgtcctgcaacacgagatcagttcctcagagcaaatatggaccccattataaaacaatgtgctttggacactgtcaagaggaaattcccttaaaagaactaaatgtataccttactgaaaccaactaagtcggtatgcatttgaacgtgtatattccaatgttttctgcttttaaatttaaaagctcttaaagttagaaaatacagattagcataaagaaaatgatcaaaataatcctcattcctactatttaagtaattaatatgttggtatcgattaatgtgtctttccatttatttatgaaaataagacaaaattatgcatactatatttttagtcagctctttttaattactatattgtgaatcttcattgacttaaatagatccttttgtatataatttttagttgctgcctcatactgtattttatgtctgtaccattgttgaactatcctccattgttgaatagctagattttttttttttgctattaacacaatgtggcaatttatctttgaacggttttttattgtcagagagcaaaaggatgtttaacagctggaaggtaggaggatagatagagtgacaagagtttaggttctgcaatgagaagacattgcttcaagtcccaactctgccacttactagccatgtgaccttaagccattcagctcaacctctttgcctcagtatcctcatctgcaatatgagaataacaatacttacctggcaggatagcacaggagattaactgaagaaatacatgtgaaagtacctttcaactgtacctcactctgagagagaagggggaaaaaaacatgatcttccatttactgtgaatctctcatatgccaggcactttcctgcgttttacgtgctttattgcatttgatcctcatggcaaacctgtaaggcaggggctatttttttattacccacatgttacacagaagggaaatgagacatgtggataatctaccccatcatgggcacaacggtagaagcggcagcacagagattcagacccgggtctgcgggacacaccccaggctctgaggtggatacaatgcagaagagaagcacactccccagtgtggcaggaggccagttctagagccttccagacccagctccccgggagatgaatcaccagctagggacaatcccgaggccaaaaagctcatgatagcctgctcacagtcttgaatcaataggtcttttattagtctttaaaatggggaccacaatctttatatgtatacaatattcgtgcattccagagctctttcccatccattctctcactgttctgacaatagctctgtgctgtgggtggggcaggaatcggcttgtgaagcatcatcctatatgttaggacagggaagactggaactctggatgcctggtcccaaatcatttgaaatttgaataatcccagcttattggaaaaggaatcctgtcttttctacttggtatctgtgtagctttgggtaactcatttcatttctcagattttcagtttcttcatctcttaaaagagaccaaaagcaggaataatgtttatgtcaaggattgtcctaaaatccaaatgaagtcatggaggatattaaaaatgcctaccactgtgtccctcccacctctaaggcagtgtacccactccagccacccagcccatagtgtgctatggtctacaccagatgcccccttcccactccactgtgggtgattggactgaggtgggcaatgagctcaaagagtagttcactggccttaaaggaattcatcaaatactgaactgaatcaccttgattcttttgagattttttttcactgataattgaatttttaattctacttagttttaattaattttaatttaatagccacatggagctaatggtgaccataatgtacagctcaaggctataagtttattatctggggaaagtaaaacagaagtcaaagaacattaaaaaattgagagcttttcttatggggaaaattggcacactaaagataccacggacccagagaaaggccaaaaaatatatatatgagggaaagaaatggtaatgcctggaggggcccgtgttagtagaattcaatatgaaagtattaaagagcacttctggtactataaggaatgaaatattatgaaatgcttagtgctataaaataaagacaacctgacaaagtatacttttaattttattcctgggcttgcaagaagttatgtaccacttatgcactaccaccttcacccccaacaaagacctgaacacacagcaataagtgctaagcataggtgaaaggcagggttgccctgctggcaaatgctgatgttaaaactgcaatcaaaagccagctaacaagatagagagattaagcctagggtcccagcagtgggctaaagtttctataggtgggtaaccctctggctctcaacaaaaacaaatctctctggagaaaagcttcctcaatttgggtccttagatttccgtggattaagcaacaatatatgagcactcaataaaatatgatcaatgaaatataatcaaacacacaagaaagcaaaccactataagcaagaggtagaagagatgaggtatgccagacttctacttctaagaactttaaatgttggaatgagaatatttgaaatgtataataattacaaaattcattcaaaaaatatgaagtcacagaaataggcatgcaatgctagactataaaaagtgaaatggtagatttgaaaaagacttaaacataacttttagaaatgaaaaatgttattaaaacagcagaggaaagaattagtgaagtggaaaatagagttgaagaaattaaacagaatatagcacaggaaaaaaagattataaataagaaagaaggatcaataatcattataggttccaagtaaagataatatattgaacacatacagctcattttactaccttctccaaacttattaaaactacagcaaagggattttaaacaatcatataaacccacaagaatgggcaaaatatgagatgagataccagcaacaaacttctggaaaatggaatataaatgaagaattgataacaatgttaccagagctaagaaaaccaaatcctaaactgatggtggggaaatcattgaatcaactgaatttgcactggaacacaacacaaaaagtaaaaaaaaaaaaaaaaaaaaaaaaaaaatacagtaagaggcataaattagtaggaattaaagataaaatagaagaactaccaaatcaaaaattctttaaaaagactattagattaatctttagtaagattgagaaaagtgaaggtataaatatgtatgaacaaaggaatatatctacagataggcaaaattaaattttaaaaagatttttaaaaaatttaatttaaaattaagttgaaaaaatattttaagtgccaaaagagatagcaagaataatctacactactttatgtctatacattggaaacaatttaaaatgcccagaaaaatataacttgtgaaaccaattgaagaaatggaaaacctaaatagccttataatcattaaataaattaaaatggtagtctaaaatttttctgcaaagaaaataaaagtctcaataatttcagtgacatattattattgcattaaataaaaaaccaaatgtccaagaagagccaagacattctgaggacaaacaggatgaaggaatgtgcttttctagattgcaagccttattaaaaagctaaagtaattaaaacagtatggttttgaggtaaggataatcaaattagccagtggaacagactaagaagcccccaaaaatctctgtctctctctctctctctctctctctctctctctccatatatatatgtgtgtgtatgtgtatgtatatatatgtttgtatatatatgtgtgtatatatatatatatttgctcgataaaggatattgtgttgtagatcatgagtggcttattcaataaatggtgctgagagcattagttatccatataggaaaaaaattaaagaggctccttattctcttacatacaaaaattaatttttgatggaacagaatcttaaatatggaaggcaaagtcttaaaactttttgaagaaatttagaatatttttataatcttgaaatttatttaaagaatttttttgaaagacacaagtacccattaaaaaagaaaacattggtaaatcaactacacaaatcatcaaagataccataaatgaaaacataaggaattcatatctagattaatcttgaccgtggtcttaagacttccagcctcctgaatagtaggaagtaaatgtctgttgtttaagccactccatctatagtatttttgttatagtagcctgagctaagacagctttatataagcctttggggaccatagatgaactacatcacttggttctagcatgttctgtggtttcaatgcagaaacctagagaataactaaggctgggagaaagaaggaccacactggtgggagaagctggtgacaagtggtaaggagtgggcaacctgggtactaattcttgttttttcttccccagccttgtggtcttggccaaatcaccgggcctgctgtcttttctgtagagagaagggctgctcggttctcatttggattcaacctttccaatgcagcatttaaacacggaggagggatttttttggttgtcacaaggactgggggaccctgctggctaaatatcctccaatgtgtgagacagttgcaccctaaatgccagtgtgcccctattgagaaacatcctctctataacagtcctttgaacgagccctttacatctctctacacatacatgatgtttgctggtgggtcgggaaacatttggatactttatgaagcatgcaggtctccacccaaacccacaggtcagatggctgctgtccaaactttaggatctttagggctgcagatgagatgctctgttctggtgtatgtcctgcttggggggctgcccctccttgccagaagaagatttagttgaattcaattgaagtgtactattaccaaccatttgctcccttgttctgacagccagcaggagcagaaaactggcttgctctggtactaactgcattctcagaaccgtgcatgcagtgctttatcgttctgttcaaagctaagcagtgccctccttgggacactctgggaatgtacagtattcattgctctaagaaaatgccttggccacaaggagaaaacattcgctggctgtggcttgagccaactgggtcagcgccagcctgtgcagatgtctttgtggacagagaagaagtccctctgggagaaggcagcccatgctagggtgcatagattgatgagaggagtgacaactgtatttctgtccttacttgctctcctggccaggtgctcttatgcagtgcactagctgtacaacagtacctactggctggaccctctcattctctaccaattcagcagtctcctcttggcttcattcaggaggctgtctccccatggttgcctgaacccaaaagcaaaatgtgtgggtcccacctacttctcacgctctagttctaaagaatgggcccaggtgtccagcctccacggcctgacattcaatgctgtgtacactccggttccaagttgcttttctactcactgcaccccagactctctgctaaacaggctactttagtcattgccacccaaataatgcttgtgaagttgcatctccacactctcatactcttcccttaccctcaccttttatccaactctttcaaggctcggctcattttcagtcttctgggaagccctctcaattgcccccaatcaggagttactgaaaagtgtccttgtacctcccattggtcaccgactgcacggttcatgtattgggaaccttgattgttaagaagattttaagttccttgaaggtggaaacctaatgagaagacttgcccttcaggctcctctacttaagaatcattccaagcaattaccatggaaacaaatatcttctcttcctggcctcttggaccaaaacaaacagacaaactgttaaagagcaaggaatttggctccctgcctaggttggcagtgagagcgtcagaacaaggttgaggccaaatccatgaacctcatttagttagctgcccacgaacttggcttggaacgccttggccccatcttaaagaaagcccttcattctggggacgctggtcagcctgaggcccatgctccttagtcccaccacaggaagccttctctctccatctgtcactctgagaccatattggctgaagctctgggcttactcatatcctgagtcatccaacctcgcatgtccgtaaaaatatccgtatccttataggtggaggccttatagataggttgttgagtcagatttatgagtttgagaaagagatgctttggatgcaaaggacctttggtgagtttgcagaagccctggactcaaatctaccaccactcagaacagtgaatgccagaaaattcctggaaaagggcatctctttgctgaatgaccctagtaatctactcattccccaggtaattactgagccactctgtgttccaggcacagttctagtttctggaaatatacctgagaacaaaacagacagaaattctgcccttatgagcctccacttcagctcctggccaagtctgtttttcatatgatccaagcactttggcaggtgttagggctgtaaaagggatggcatgggacccccttgggtaggggacgtggcagacacatctcttagaaatattgccgcaagcctcactgttcaagtctggtgtgtggagcagctgcatcagcacctccagggagcatgttagaaatgcatcgtctcaggcccttcccaagcccttctgagtaagaaactgcactttacaatatgctcccaggtgaactgtccgcagggaaaggcttgaaaagccttgctacaggacagcaaatcccacaagctgtcctacagtgaaagggagcagaacgataatgtgcatttgagaaagagtacatcccatgcctcagatttagaaaggtggcgtgttcaagactgagatctcctcagaaagaaacatgcttaaaaatccaatgctactcaactgtatttgatggctcaacaacaaatcaccgactgtaatcactcaacagaaccagcatcctgtgaaacacaccttgagaaaccagtagtggaccttctggcattcccggattcaactttcttggcttcaatgactgcagatggagtgagcccatggggtgataactggcagttttgctgaggaacaaatctgaatcatgcctactgccaggctgaggctctgggccaaggtctcagcttgggatagggtgaggatcagaaggctggaaagatagagggactcggagactgccagctactggttaacttgtggcataaggaggatatatacagaaaacactggattctatagctgaaatatgtcatttggagaaatttaggagccaatataagcattccttatttgtcatttcatgggctatatatattccacaggtgtcaagaatctataatgatgatgatgatggcaaagacaatgatagatacctttttaaaacttactatatgccaagcactgtcctaattcatatgttcccaacagcaatgctaagtggtataatcctcatttctgcagatgaagaaattgaggcacagagctggctcctcgttttaatccgtttcatgctaaatgtgacttctgagacctaggtgacaggcatctgactggtgcagactaaactggccagatgatggagtgaccactggtcccctttatccctcgagccagcccctgaaggctgagagacttgctcagagccccgtcccagaagtgggcaagattcatatttgtgccttagcaaaactgccagttatcatactatgggcttattccttctggaatagggtaaagcaagaacagagaaccccctctgggggtgccacttaggtgtgaagcagccctaattgggcaggtataggctggagtgacctcagtggtaggcctgggaggggacacctggtttgctctggggcagtcgtagaaggctcagcacagtgctggactgcaggtaggactaagcttggattataaggcctgggatcttctcataatgctggtctgcagccactgtgtggcctgtgacaggcctttccctgggtctcagtctttgaaaataatgatacaccccccaccacacccggtcatgggttgcaccttgggtttcaactcaatgactgcttttcaggaggtccctctggggctccttagggttatggctgctccaggctggcaaatccagatcatgcaagaggtggcttaaccctctccctctcagggacacgaagaagatctgttgcttccagattgcaccaacacacatgcctagaaccccagtaatgaagctggaacctctgctgtgtggtcagacaaacccaaggataaattgcccctgcttcttgggatgacactaggaattcgccattcttcacgaggcagtccctggggcctagagccaattcattcagtttaacattccctccctttgagacaaagtatagggtggtgataatgaagtcagtcgggcacagccttgagtgctggctgtgtgacacagggcaagtcactcaacctctctgagctccagcatgctcattggtaattggtataaatgaaagtacctatatcatgggactactgtgaggtgccagcacattatcagtgctttgtaaagagccgctattactcttgttgttgcttggacatttgttatgaggggggaatactttttaaaatttgctttttaaaaacatcaacaaatttctgaaggcattttcaaatgagactttaaaatatgtttttctcttcttataaagttaaaatttttgtatgaggttaggcataatttttttttgttttaaattaacaaatagcaatcaagggcttctaagcaattccaaggacccccttgctgctctattccactagtcttccaccctctccctcctggcagcagtcgttggcatttttgtatgtctcaccctggaggctggcaagctctgcacctcctggtcgggagcttccagctctcccctgcagctgtcctgaattcctcttgctgtaggttgtccctttgtcccagagcactcaccctaacagggaagtccctcatttcttcattaacttccaggttgctccctccccattaatgctgagctggagaagcagggttcacaggaccttacaatagggaccaggagcagcagctcggagattcaggccgcctttggcttccttgaccctcctgtacccagggccagcatcagggagggaggaagaggacagggacaacaatcagcagggcccgtgtaagcatacacttcttatggatgactcctctgacaaccacacggggtaaggccaggctcacggtcacacagtggctgagccagaagatcagtgtttttgcttttccatctaataatggctccgtctatacaaaattttgggcaggaagggcaatgcatctatcagaactcattggtgacaggcgcagcaggagctaaattggctgagttgaaccaggctgttacttcctagctgtgtgaccttagggaaatcacccaagctctctgtgccaacaattgtgcctacctcataggattcatttaaggattaaagaagttgataaatatcaagtgattaaaatcctacctggcacatccatagcagggattctacatgctagatattttaattgttgttaagcctcatgaaggcaggagtctttgtctatgttggttattggtctgtgttagaacagtgcctggtacttaataggggctctataaacagttgttgggtgaatgaatctatttctttcaagataaaaactcttttgcaatgcagccattgtttatcttggccagcagagggcagcaaatagctgtggactgattaattgtggacaagggtggttttaattttgaaggctaacagaactgtccctcctgagccagttagggaaataaaaggttgccatgaacctgtacgactggccccgacccctcccactcacctttgtgcaggttagaatgattgtcaggcattcaactcacaaaaaatcttggttccatttcttctcaacttactttcaatttccttcctccctccctccctctatccctgcttttcctcctttctccgttttctctaatcatatttccccctgcccccacactcactcctctgcatcaagctagtatactgtacacactcccaaactttatctgtacaattgcagcttgtactgcaaaccatgacatctagagtggatccttatacagtattcttcccaaccaatgaatgctgctaaacctagtataattttttaaacaacatgtaatttgataactagacccagagaggtactatagcttggccaagaacacacagcaattaggggtaacgttagagccctagccaaggccttctgctgtccattatacagcctcatcacacatgttctcttttgccaacaggaggctcgtgtggtccctgtttgtcatccagtcaatacggccatcagcttctggccccagacacctttcctctgcactgtggcacagaggagcagactgctttggagggcagcttcctgggagctccagggaccctggccaggcggccactgccactgacttcctcggctcactgagcccgtgcctgcagctctcgtgtttcctctgtgctgcagtggacgcttatcttcccccgatggcacatttctttgtcacagacaggaccctcactggcagtcggaggtgagttcccggggagcttctgggtcttgttggtgccttctggcaccacttgtggatgggatggctctgacacccaagcctcaccactgctccgggggtaacccaatgacatgatctccccagcttgctagatcctgtccttcccaattatgatccaaaaaatcatgctaggataactgtctggaaaaaatatttaattggtcttccagctgggaaacaaattctatatgaattgatgagaaaaaaaaaacagaatttttaaaactagaaaaaatgtgggtgacctattatcttaggggatatttctttaagcatgaaagcaaaactagaaactataaaagaaaaaatgtacaggttgactacatagaaaaaagctctatatcctggtaaacatccaaatcaaaataaaagctagtgacaaatggagaaaagttgagctacccgtgtaacagacaaaagataaatatactaaatcagactctcaagaaaatggataaagaatctgaactgacaacctaaaaatatcaagtcataggaacatgaaacatgctcagtgttactggtaatgaagtaaatgcaaaattcaatttctgcatcttgaagttgcaaatttcaaaactacgtagtgtcagtgaggatgcgggccacagcctctctcattctgctgttggcacagttctggagggctctgtatgcttacaggtgtccatgataaatgcttttctgtgtagccttcatcgctatcaccttactatctattgcctcctccctcccgccttcctttaccacaccaatatacttcacaatgatagggatattgtttactgatctgccccaaatgcttacaatagcacctggcccggctggttgtggtggctcacgcctgtaatcccaacactttgggaagccaagacgggcaaatcacaaggtcaggagttcgagaccagcctggccaacatggtgaaaccccatctctactaaaaatacaaaaaattagctgggcgtggtggcagatgcctgtaatcccaggctactcaggaggctaaggcaggagaatcactttgaacccaggaggtggagattgtagtgagccgagatcacgccactgcattccagcctgggtgacgagcaagactctgtctcaaaaaaaaaaaaaaaaaaaaaaaaaaagcacctggcccaatattagatgttcaacatatgcttattgaatgaataattgatctttaacccagtagttcttaggaattgatactaaggcaacaatcagtgatgtacaaaaaagatttatatccaaggatgctcatttcaacatatattgtaatagtcaaactttgcaaaccactgaaatgtccagtaaaaattatgaaccatcctttttagagactataatagtaaagtcatgaaaatcatgttatagaagacaacacaataacatagaaagatttcctagatatattttgaaaagggcaggttatataactgtccagaaatttattttctatgtataatacaatcttaatgtatataaatctacacatatatgcatggaaaaacttgtgtaagaacatactgacattttaacagtatttatctttggatagagtaattgtaaaatgtttacatgtttttctttactctttcatgtatttttgcagagtttctgtgataggaccattttgtttttgagactggattaaaaacaatgtagcagaggccatgggtgcctcacccatattcctcaagctggccctagttccaagtagctaagagcctggcggtggccctctacctacaaaggatgggagtggagtggctctctctcacagcttcctcagccccaggggacaactctgcagcatgttcctcacagcttgacagaggccctggccgtgcaccttggtggctgttctttgcattcccttcttctcagccttgcttctccatgccacctcagtgcttcctggaatcacctttcaagccagctacttgcacacaaatccttgtcccagagtctgcttttaggaggagcccaggctaaaaggcacaaacgctgttttaaaaatcctgcccactccgtgtaaagaacatcagccaagcatggtgctatagaaataactcctatcttggctgttcctgtgtgtagttcactttcaatctctcagcatccctgagttgaagagagatcttgcttaactgggagggaaggccaaggggtttctggatacaggagccaccttggggatcttagagcctcagaagaggcaaggatgtacgttataagaaggggctgtccagatgataaatgaaattaataaaccacccctgtgatgccagcacatggctcacagcagatctgcatcaggcgcctaccattgccctaggatgccattaacacctactcttccttatgaggcttagaatcagggctgctgaggacttcagaaatcatctcattcaggtggggtgaagggggtgggtagcttccctgagggtcccacagcaagagttagagacacagccaggaccagaacttactgaaaagcaataatccaaggtctgacttgggttctgaggatttgctcagttatagatgtcattctcgatttggcctgaagagggcagacacttgccattcatggaggtgaagagcttgtttttaaggctggactaacatctcccaataaggtcatttggttctagtgagagttgcagctcacaacattcttgactcttctgctgcaaatatgctactggaaagacactgaagttcacagactgaagttcctttagttccaactctggcactgtaataggtgaccttgcacaggtcacttcacctctctgagtctcacttcttgtgaagtaagatctctactccgtgactgagaaggtggtattggggagtgatatgtaacttacaaagttgcatattacaacacacatcactgctgttaagttctgtgtgtgtgtgtgtgtgtgtgtgcgcgcgcgcacatgtgcacactcgtgatggagagagcttgataaaggagagaggcctaggccaaaggagctttttctggcctcaggtgaatatatatttgtaaattctctagcaattggaaccaattcactttgtacttggaaaagacttaactgcttttactttatatttcgaactgtacttttttaaaagctaaagatgtcccttaacctaactggtgtatgggaaaaaatatacataacagggatatatgtaaagttctaccattaagtcaaaaatattgctgaatacagagaaggtattggtaatacaaatttttaaaactaagtatttagtggttgcttggtcatgagaagcaaaaaagtaagaagtgagtatttttaaaaatcctgtaccattttcctaggacatcaagccctagtacaggaagggacattttcacactaatctgtgccagctggagcagtcctgccatctgaacatcatattttggaaccctgagaagctaggatgcagttaacaggtaagtagtaatgggagaactttctagaaaccatgtctggaggaggggttcaggagctgagatgctgagcctggggtagggaagacttgagtggggcaggccctacaaaaaggggttccatcaatccaaataaggaaaagtcacaaaggaaaggtctggtctcaatagtgaagggcattgttccctgagagatcagtgtgttgtcacaggagacaggaagctctgaacacttcaagacatgcttagaaggccccccgatgtcagcagaaaaggggctgctaatgtcatctcagaaaccaagttatccccatgcaacaaaatcaatcacgtatcaaaacatgatggagagacagcctgcagaagtcagatggttcccggagcactacaggataaaaaggaccttgaaatacagaagacaaagtacaggctcatgaatgtctggacacaccagcaaattgagcctgaccaactgcactgacatcctgatgagtcagcttgaatcaagaagatgggtcccaaataactcagggtcacgcagcagagagagatggggattagtcaagtgtgttcactctctcaccgactcttcctgattgaattcccacactatgctaggcactttttagggagctgtgtatattttctttggaggcacagggttaggccattatctcttccaaggacagcagtttctctgtgaatttattccttgtccaccaaaaaccttctatttcctcttttagcctccatggttacctgaaaataggaaggaaggaagtctacgatgatggagccataagatatatgcattctttactgtaaaagatcacacagaaattctagtttatagattccccaatgttaccattcagcctttggaagcctgattcaatttgaaagagtagataaaatatagtttctagaactgacaaggtgaggatgagacccaagaccagggtgtggccactaccatgtgaacactgggaggtcctccaacctcccctgacatttctcttgaacttctcaaagttacctgcttggaccccaggggtatgagttccaagggcccgatcagctatgagattataggctgaactcaggcatcagaattgttagagctttatctcagttctgagaaatggttaaaaccacccttgggcagtcacacgtggaatcacttatttcattactatggacattttcttgtaggaacaatacatagtgaaaatccactgggataaccaacataaaactgattttgttttcagtttgatatagcaattgcattttatttgtttgttgtaagtattggtaaactttcttattttttaaaaacagacatctgtaaaattatatacttttttcctataatatcctttaaagctgcttgaaaaatgtttattatgacaatgtataaaactggtatacatggccaataataaattttttctctaggttgatggtccttactaaaagcattttctcacctcttgagtttccacttctctttccactgattgaaatgggttgcatccaacctgcattcttgaaatggagacttctttagtgaaactccaacacccactacacatcggtggagaaggcagaacagccaggggacatactgcaacccctctcctctggacctcaagtttctcctccactgtctatttgttatttctctcctgtctcaggatgaaagtgtcttttcactccttcgatgctaactcatcaacttgtactcttggtcccaaaactctgatttggcttgtggcttacattagctcctcaacatctttccttcatggctggatctcacccttcaggtttacaaacttagttcacttccctgcggactaaaaaacacaagtctccattttactctggctcttctcggagcaaccattttacctccttccttcccaccacaattgcccactgactctgctacacttctctgtctaccttctgcccttgccacttaagaaggttacacacatccaaaccaccaaatccaagagacttggatccttaaatgctgctgaacctctgaggacatctaacgttgtttctttcgtcttttttccttatgaatctggttctttctttgaaaccccacatttctctgatttatccaccttatcttcttcccctttcctatagaatatggccatgtctggctcaccactcttggtggtcatctgcttgatgttttactgctctgcccagttgtccttcttcctctcaatggtggtggctgcccaatctgctggacccctcagttctaattgttagctcatttcctcaaagagatggcttttaaaacctagcccaggcaaacccaaactcatcatcttgcccactgtgctagatcttttctgattgtttgcccaattcaaaatggattctccattctttggagatggacaccgatctataaggtaggccccaagcagccatttgacctgacttcctggtcacaggtgactggcacagggacagccacctgcctaagactcctgtttttaagtgagagaaacaagaactggataaagactcagtagtgaatggtactgctctgagagaaaggtgcatggattcctggtgctaggggcccttagagctgccccacttcccatcttcctggttaattcaactcttccatggatctctcatatatgctaggaaagttctagtacagtctgtctcttagctaagcttgctagagttggctcctacttagaaaactttaagtagtgaatccactgacatttgtcatccaagaatctctctctctgtccgaaaccccacccattcccttccccagcgagggcttgaaatttgactctgatcgatctttctgtgcaacccacatccagaacattcaaaccttgtgcattttatctccaaaataatcctctcctccaagtcctctgctactgtcctggttccagtctctgtgatctcttttctgggcttgtccagcctctccaggctccagtgatcattctgatcgtatcacttttctgcctaatatctgaggctaagtcttgtaactcttaccacagcattaaaaacccttctccatctggctcacaggtgcacagggctcatcatctgctatttccattcctatgtgccagccaggcctgatcgccgaccttatccaaacattgtccatgctttgcatctttcttctatgatttttgtactgctgatccctttgcccgttggctctggtaaaatctttctcctttaaggtctatctaaagtccttttcctaacccaggggatagagaaacgttccctctatcttctgggacaggagttccctgctggactgggaggcacggctccctttgattcctggcactgcagtggttgattggtaagtggatattgagtgcacaggatcgtacaccatcccaatgtccaccaggttaggaaaaggcctagagagaatagccaaagtcaaagcattttctactgtcactgcttaccacgctttaagccaaagtcaggaaaaggcaggctaggggtgctgagtggtgaattacatggactgtgccccagacctccagacctcagtgtctgaaaaacaagttactcatgaaactggttttagactccaggaaaaacacatttatgtggcttgctgttcataaaacacttccatatatatgaactgattgaaattttcactgtgaccccagtaagcagttaaagtttatcgatataagtgaggaaatagccaggtcagatgtaaatcacagaccttcaacaggaaacagtgttccttctctcggctatctccagtgcaagtgttaaaatacaacgaaaaaggctattggggaaagtctgaatagggcagaggacggctctgcttctaaagcacgtgatgttctccccacctttgttgtcacgcatatgagcatcccttgccagcctagggaggctaaccacacaggacagaaaatgtcactctttctccaggaataggtattatccccaaacactttgatttgatgataaagtatatcagtttttcagaaacctatttcccccatcaactccccacctctaggttcaacctggaaaataatctgcacgcatgtgtatgagttttagcaggaggggatatgcatgtacacatatgcatatacatacaggtttatttaaatgattggatctacacttttggaggctatttgaagtatcttatcaaaataaaacgcattttaagcaagaagttaaaaaagcttttcagacccgaaggccatttaatacagtaaatcttacttgggtagtttagcaaacattttttaaaacccacatccaacagattggttagtattagatacacagatttggtttcaaagctgaaatacccctggtggaataaatcttctcatgaaattcagttatattatgccacaaaacagggacacttatctattgacaacttaaatattaactcagtgggctacctggtgatataaataggaaaaaaacagtggtcatggattaggagtgagaagactatgacaccagcctaccttggactgggaccgcaaaggatgttaaaatctatcctagaatttaaaacaggaaaaatgtcaaatattccactccccattcggcccaaaccatcccccaaggaatacacccccaccccacccccacatgaggtttactaaccagctgctacagatgttactatgtcactaattaacaatgatcacagaaaatgtgtcataccagagtttttgttatcatacacaatgcattagtggctgcaggaatcttcctccaaaagctaccgtcagaaggcaaactgacaaatgtccatgccgctggtccaagaaaccacagctaagagccatgaggcattcatttgtacattgagctctctctggcatgctccccactctagttagaggggctggggtatggagagaccgtcccagccgggcgctgcagcctcctactcctgggcctccttgcgggtcaacttgtagatctcagtgggtccgtccacatgggtgatagtggtggtgagctggagttcttccccactatggacacccagatcgcctgaaacagggttttcggtgttagatgcattcaaggaggaaggagaagcaagctggggttcatctcatggacaactgccctgatgctagccctctttgacattctgagcacacagagacacctagggcacacaacattcagaacaaggactaactccaaacctgttcacttggactttgcagaactttttaaaataccatttttggctcctagatgacagtcattaagatacgtgagtcagctcactgctgatattattcatagtaatcattaacatttaatgagcatttactttgtgcctgacgctattctaatcactttgtaagtgatcttctttaatcctcgcagaagccctctgaagtaggcagtatgaacgtgccagccttacagatgaggaagctgggaggtaggcaaggtaattgtcctgggtggaggagcaggcccacaagagagctggcaaaggaacatctgatgccaagaccaatgtgatgggctaaaccagcataacacccctcccaacggatgggtcagtcaggcaccaacacatttgctatgaataatttacaaaataggagccaggtgcagtggctcaggcctgcaatctcagctactcgagaagcaggggtaggaggactgcttgtggccaggagtttaagatcagccttggcaacagagcgagaccctgactctaaaaaaaaaatttgttttaattacctgcgtgcagtaactcacacttgtaacctcagctactcaggaggctgaggcaggaggatcactggagcacaggaattctaggctgcagtgagctatgattgcaccactcactccagcctgggtgacagagtaagactttgactctaaaaaaataaaaaaataaactacaaagcatctatgtcacgtgaaagcaaataagacctgcttatatctatccatagattggggaaggagccatgtctaacacatctaggaacaatgaggggctttattctccaggaaaaaagaagtgccagaaacgtgctgtgcatttccttctgccctcaggattgtcctaagtgttctgaactcattatcagtggacagtgttctgctaaaatggaataatttgaacttttctaaattagtaggagaaaaaaattttctctaagttaaacctcgaaaactctgctacctgccataagacaagtgaatgtataaacaacaaagggaaaatggaaaacgcaaccacgctcagtctgactgtgtgtgggggtgcacgtgtgcacacatgtttgtggagaggggtgctggggaatagaaagttaaacttgtgtcagtgatttttatattgtgcacatatcatatgataagttttctggaactgaagtttttctaatttaaagcatagaattaagtaactaaatgctgttttccattgaaatgccataccataacttagaagcagccttggccctacccttaggactagtaatcttatcactaatttaagaactgctaggcatcaatgaatctggtggccttagaaccccagatgtcactcccacccactggcccagcaggctgcttggctggttcccttcacgtgtgccacgcagtattagtttctcatcgtagacccatttctctgtggctgcacagcaaaatcagtcctattattaaatgccaccctgtaagctctctacccaggagattccctggcctcagaagcagactcattggctgctgcagaggactgctgaagacatttggggctgttttggcaagggtctaatccacaggactatgggtagagaaggcattaaaggggcatcagtccagcctccagcacatccacattcatctgccctcaagccagagcatagatgccaagtaaggctggtgagaggctttagctgggctactttgggccaagctgaaccaccacttgtacagtgagcaactactcccaggccaataacttgtattctcactgctgcaacatctagtccacacctcagtcaagcacaagcagtctaagcttcacatttctcagtcaaagctatttctggatttgcatatctgggctagccatcagaacttcaaagccagtttcatgatctgcatgtctgtgtgagtcatcaaaatttcaaagagtcctgaccaccccagtggacccattagcactcataaccgtttacctaaggaatccctttccctgaggacttcttagaaatagatgctagagagtaattctactcaggctttgaaccaaagatgttaattctttaaacttaaaatatgactccaattagcagatcttagaatatgcatatgatcctacagatcacttgaaaaaacagccaaaattgccttggcttctttatttaaatggatacctatgtcataatgcttaacacgtgcctgacacagttctaaatactgtacaaatattaatgcacttaattctcatagcagtcctcagaggcactattatcatcactcccattctgccgatgaagaaactgaggcacagagaggctaagtaacttgcccaaggcccaagctgctaaatagtgtgtgggattcaaataaataggtgccaggatgcaggctctcaacttttgggttctgctgcctcttcttaaatattcaagtttccagcagccagtgagactgccagtgaggtatgaagtccacacacacagcattacagctaaaaatatccgcatacagccgggtgcggtggctcacatctgtaatcccggcactttgggaggctgacggcggcggatcacttgaggtcaggagtttgaaccagcctggtcaacatggcaaaaccctgtctctactaaaattaaaaaaattaaccgggtgtggtggcgcatgcctgtaagtcccagctactcagtaggctcaggcagaagaatggtttgaacccggaaggcggaggttgcattaagtcaagatcgtgcccttgcactccagcctgggtgagagagtgtctcaaaaactaaacaaaacaaaaaactacacataaaataatttgaataaattgtttagcatatttactttgcttttgtatctgataaatttatagcatataaatcagtgcactgacaggagagctgttataaatttatgagtattggccatatgcactgttaggggtttagcatgccctgtatttccttgtacgatgtgaagctactgtggcataattaatttctctactgtgctggatgaggacccagataatgggactccatgcaccaaaatctatgtttcacatgtgattttattgtaccttgaaggccaactgttcccccttggggaatgggtgtgtgaacgtggcagtaacatagcacgagtggagatccctccacttgcctcctaattccatcacctcctacttctgccaaggtcttgctccatctgttagtttccccctctcttggctcctgctgttcagtgcacaaacatgctcaaaagtctcttcccatctcagacaagaaaaaacccttctgaaaatgtgatatgtgtcttggggtgaaaaagagtgagaaagaaaaaagaaaagaatgctttagtttgcagtaaatttctctccctggttatgatgtcaaattcatcacagctcattaacaattagatgacggtctatttcttcctaaccttgtgaaatgagaccaatctctggcacagatttcatcccaaaggactacggcaatgcatccatatgtgtggagtcacatccacaggtgtgtaagcggctgcttggttgtaactgcctggaatgcctaatgaggatgaagaaagccatatgcactggagacagcttcttaggaccggcagcattttaatgacaattgtttgtgtatctgtgcccacttcaataaaaatgacaacagctactctcattctgaggatgtattacagattccgggagagatcggaggtaccactagaggtcttctaatattaataaggcctacgtacttccatcctcaccactaccaatgcaaattaacaccccactgcccaagtgtgaaagccagggagctcccataccatgagttcatatttgttctcaaggtcatacacaatgtgtgccggagccaagattccaaaccatctgtgtctacctccaaagcttatgttctttccagaacattcatgacctatccttttttgtagaattttccctaggcccacaccaacctctctcctattcaccttcaaagctaagttcaaatgataactttttgtaacgaagtctctggttcacagcagaatgagaaaaacagaaaagtgtagtattttaaagccaaattattttcatgcaaagaactgcttaagaatatgtctgccttacatttttggtgttaatatgattgttatgttaaagaacaaaatagtgtcgctggtgcagtggcttacatctgtaatcccagcactttgggagacagaggcaggaggaccacttgagcccaggagctggagaccagcctgggcaacatagaaagatcttaaccaaaagaaaaaataataataaaatggtgaatggtaggtttcttcttctttttttttttttttttttttttagatggagtcttgctctgtcacccaggctggagtggagtggagcgatctcagcactgcaacctccgcctccagggttcaaagagattctcctgcctcagtttcctgagcagctgggactacaggcgcatgccaccatgcccagctaattttgtgtgtgtgtgtgtgtgtgtgtgtttttaagtagagacagggtttcaccgcattagccaggatggtctcgatctcctgaccttgtgatccacctgccttggactcccaaagtgctgggattacaggcgtgagccaccgcacctggccttttttttttttccaaagaaagtaaatacccaggacagtatgtggtatatagtaagtgctcaaaacacccatgaaagatttgcctggtgcaggcaagggcagttcctctgtactctgcatggctgggtctagcctagcatatcggcactggtgttcttccccactggcatttaggaaaacaccctcagttagaaaacaagtgtgccttgggatagctcagctttgaggatcccttctgggagatggggcagagtggctttggtggacagggttaagagccctgggtccagttgtctctcggtgcctgtcaaccccagaggtcatttattccaggcttggagcgagccattgcccatggacctccaaagcacctcctgacacttactgccaggcagtaactgcaagtgggagaagaacacaatagaacttattagtttgggggtaaaatcttggtgttacaggctgaattgtatctcccccaaactctcaaattcatatattgaagttctaacccctagaacctcagaatgtgactgtgtttagagatagggccttcttaaagaagtaattaagttaacaatgaggtcaattggggatgggccctactccaacagactggtgtcctttgaaagaaaaggagattagaatatagatatacacaaagggaagaccacgtgaagacacagggagaaagtatccatctacaagccagacagagaggtctcggaagaaacccacgttggtgataccttaatatcagactgtgagaaaacaagcttctgttgtttaggacaccctgtctgtagtattcgtatagcaactctagcaaacatttaggaagccgaaggttcttcccaagaaggtaactgagatgtccctatcatggtggggtgacaagaattctaagactcagaaaaaatgattttaattgactgggccaggaaaggtcaggtcactggcacagcaatagccctgggagaggcagggggcagaagacacctgattacaaacagctgagcaaggggtgccaggctggtgacggtccatcagttggttcccaccttcactggggaatgggaaaacgcttttaagacctgctttagggtctgggtccagcccgtgtgacaagaccaatcccatcagtgctcacagacatcaagaagctcagctggccatgggcagatcatctaatgtacaatcagggagatggcgtcaataaaagggggcaaccaatgtcagggcctcaggacttaatccaacgctttaccgaggcaacaaagccaaagccatctttcctatgaaacaaggggcaggagacctcagaaacctccaggagtaaaactgacatcacactgtagctagctgccaagacgcggaaccagtgttgccgcttttgctccccgcagagtgggtgcattagacagaaaatgcttagcgtgaacagaaataggagggaatggtggcagtgagggcatcttgtgttccctctgccacagtcatctagttgggaattctgtgtctcacttctttttttaaaacattctgacaagaattttataatcaaaagaacacaaaaatcaaagctattatcaagaattgtctgacttcataagcagctccaacttcttattcccacctgaattgtggttgagtgggtttgcacagtttttcatgtgtgcagggctttgctgctggagccccgggaggtggtatttttgctctgagaagaggattcactttagcctgctgcaattcatatctgcctgggaagacatccagaatgattcacaaattggttatggcaacaggtaaaaagaacaactgtcatgaaaaggcagcagcagcaacagcaacagcagcagcagcagcagcagggcagaaaatataagtgttccttgaaggaaaggtaactaaaatatctttgctaaatttaaaaatctatatgtgcacgtgtgtgtgtgtacactcagacacatatgcataaaatgattacacatataattctatgtacataaaaataaaatgattaatgtgaatgagtttgcacattcactgccgctatggtccaccagccaataggaaggaacccaggggaagtccacgaaagcctgtggctataaagaatgtggcgccacactcccgcagcacctatctgctggtgagaacactccagtgtggagttgtcctgccacctttcaagaggtagatgaggaaatcttgtcccccagaccaggctaaagaccccttgagagcaaggactatgtctctgtcactccttcgagcttcacttcactccatctcattcaagatggcacaaggctaagtactaaggaactaaggtatgaggtatgagctaagtactgaggtgctccgtggttcatttgtaaagggtcactttctgatccatactatgaaagagaaacagaaatatatgagaaaatgctctttggaaagtgaccttgtcttgaacctgtggcccactttgttcttctctgtccattctatgaccaaaagagagaagaaaaagtctatcgtgaaatgctcaatgattccatttccttcctacccacttctacttcctcctgacacttggcatgtccctccaactcacataccaaacaacctccatcaaagattctttcccttttcttattgcctttggcatcagaaactgcttgtctgtgctccgtccaggatccatctaacaaaggctgaagccccacacacctgggattcactctctgtagcaagatatctgaattcctagctctgaagcttcaaagcaaaggagagaaagaaatagggagggaaaggccaaagccaacttaaagacttcccatgagaatggaaaaggagcatgggaatgctggaggtggagagagaatgccatccagagactcagagaatgtaaagacacatgtatccttccttgcaagagttcttctttgaggtttccacataatattccaaactaggtctttccaaggaacttcgaaatcttggcaaatgctccgtaattcctaggatacatcgtgtgatctggtggcagatgaagagatgaaaagtgaaacaaaatagagaagaaaaataagcagaatgcccaacatggaagagaccccttccaaatgcacaaggtcacagcaccatgcaggaaagggaagggcccacaagctgccaggggttcccgggggtgctgggaaatcacagatcatgttaccaaaggagaactgctaaatcttatgacttttgtgtttaggatcagcatatggtccccaaatagtttgcccactaaattgcctgaagaatgttttttcacagagggtctacttggcatttcacaggcaggacatttctttatgacatgagccttgttttgcctattgaacaacatttagtagcacccctagaatctggacactaaatgccaaaggcatgtcccagttatagtcacaaaccaaaacaactgtgaacatttaaaaacacccacttagcagaggattcaggggatatgacctcttgttgagaattatttgcaagttttccatgaaattacagatcaagctgtctttgatgaaaaactctgttgaggaagagtgaagtgcttttctcaattgcaacatttcaagcctaggagactggctactgtgtagggtgggaagtcctgatgggagctgcctaatatatggctcaaatctcaagaatctgtccaacatggtggtctgtagtcatcctgcctctgcagggttggccacagctctgggctcccacttgctgaacagtgttaaagttggacacgttctcaccagtgtttggaaatcccttacctatgacagatatcactctctgggctgccacttagtggcaagaagtgttcttctgccccttccctgctaataggaagaaagacaaccatggactttcttttcttttcttttcttttcttttgagacagggcctcctctatctatcacccaggttagagtacagtggtacaatcatggcttactgcagcctcaaactccttgggctcaagggatccttctgcctcagcctcctgaatatctgggactacaggtgcacaccaccatgcctggctttttttttttttttttttttttttgtagagatggggtttcactatgttgcctaggctggtctcaaacttctgggctcaagcaatcctccagccttggcctcccaaagtgctaggactataggtgtgagccattgcacccaggctaaccacagaaattcgtagttcaaaaggacttttaggagatcacttacatttgggagcagtggtgcacagagggttaagtgttttgccaacagtcacacagtaaaaacaaccaaaagaatttatgtacataaagtgctgtagcacacagtcagtacttgataattatttcccaccggtattatcattccatcatccaggaagtccagccattgctttaagtggtatttctctggaaggtagaaactctacctactcacatcaaggacaaggccacatggtttccttcagtgtcccccacaggatgaccatggaatgaaatcaagattcttgtccacaagcccagcagtgcttgctgctcgtgttgtggaagcccactgcttgacaggctgaatgctcccattttccacatgtacagtaaaaacaccgagtggtgtttttactagaaatggaaaggaagaaggctgcctagctcacaagccttctagcaaaacagtcagtcaaaccaaagttgggcagggggtaggtaagtaaatattctgtattctcacctcagaccagagatgggcttgaaactgattgtaacatgtctactccaaagaggtcaaggggtgagggaaactcatgtccagcatgctctcgcatggacatggcaaatacaggatgaagacagacagtggctgagaccactccacgtcccttgacccccagcacagatgccttcctctcctgctccacttcatctcatctctcaagtaactacccccctcccttctccccacaagatcactgaaggctaatctagaactcttacttctaagcattaattcactcaatattttaaaagtatcctaaagaactggtccttgccctgaaggagtcgatgatccagcaggagcataaaggcacagatgactcatcttccacctctacacaataaatgtcatgtggaaagtagactcatgatcccctaggcatattccttaggacaacagtttcaagagatacactgcctaaagaaagggtgccagggccaaatgatctaataattctggaaaatgctgttaccaccccccgctttgtaaagactgacagtacaaattaatgtactaaaggcattaacatgtattgcagtgaaaagccttattagtgctgatcaactcaatcattctcaagcatgtttgactacctaaatttatcaacatttcatggagacaatattccattgaatgtcatttgctggattctaattggggtgattgggaataggtgttaaagaagatgctgcattttgactgggcccaaaagatgagtagagtttcattagtcccagatggaggcagaatgtgcaatccactcatgcaacacacactcactgagtacttcctaaaggtgaggccaacccttggctctggggggctgctaccctggtttccactgcaaggcagagtgaaaggcactagagcactgatttgagaaagggcttcctatgtttggggaatagcaaatgcatggctagagtaaagcaggtgtaaaaagagacagaatgaggaataaggctgaaccaaacagaaaaagcatctattagatcagttgtttatcaggccacctgttacctgttaacagcactggcctagacagtgttaatcatttctgtctgctgtggctagtgaagaaaccctgagcaagatcttcccttctctaggcctcagtttctttatctataaaatgactggattctctaaggctacttgcagcatccatgtctcagtgttctgtgattataagatataaaaaggcagcagcacataccagcactaaaggacaggaagaactggggacaggagaatagctattggtttagacatacatcgaaaaatcaccttgaagaaaaatgagcagaagaaaaatgaagcctattccatcttcagctctcagggcccagactccctccacctgatatcttaggattctgcttctcaaatgggaagaataaacatggcatagtttccaacagtcaattgtgctcaaaaatgtaaagaagaaaatttgactcttgttctaaaatcaagacatattttagacttagcatgcaatattctcaatgtattttagagatttaaaaatgaggacttaaagaaagatctggcttgtgtgggctttttgtcttatgggtgagtcccctgggtgctcattcaccgtctcccagtgtgaggagtatacttggagggaaagtttcactgggcatctcagagctttagccatttaaatcttgtaaagacagaagcctatttatcctgacttaagctgttctaaagagacagaaactcaccattggactggtcttctccatagtttttatgggatggtgcatacaagaacatcagagcaaagacatacagattccacatcccatagatgcctgtgaaaaaggcactgttcacttggactgtgacgccgccccatttccaatggccttccgttacctgcggagaaaggatggtgatattcaattgaaacagagaagaaacagaagaaacataacaccaataaaggaaccaaccaacatgaaaaccaagtctcttctacatgtgggaaacatgaagggccatgtaagactccatcttttaatctgaatcatttcggtgtaaattaaggtcaactgaaggttctctagctttctgtcaggcacagtcagtggtccttaccttgcccacagattagtatcacctggggagtgtctcttcctaaaaacagcaattcattgctatccctaagttaaacaaactgtgtttgagcccatcacttattcacaattataattcctcctctgctgtctgtcttcccagctagatgtcaattccctgcaggcagagaccagttctctgctgccatgtctttaaggcctgatgcaccatagattaattcaaatccagtgtctaccactcactcggcttaatgtaagacaagatgaagactccagacttcagaacttcagtgtccgtaagtgtaacataaaagcttgcaggttatcgaagagaattaagtaaaaatatttctagaacctgcctggcaggtactcagtaaatattagttatttctataacatcccttgaagtaagccactcatgaaaataattatgaagctttcatatgcttcaaaattctgcaagagatgttttgaagctgcttttgtctgtgttaatgatttggtaattgtcttaagggctgcctaaagatatatggattacactaagaactgtcaacagagctgctgagctaagtgactaatttgtgccagctctgagacaaatgaaatgattttgaccacttctgcttactacgggacacttaaaatggaaatagaagaaagtattgggtaaatattcctttgacagctgaatgaggctgcgttgtataaactttctctaggaatcacttttaaattgtaagatggcaggctagattgaaatgttaagaactttaacaagcaggtggatttcattgcctgtttatgatacagtgggtctgtgttcattatcttctgtataatccataacccacttggggccctaggccaaattaaggtctaagtataggtatttttttctgaaagaccaggagtgtcagttaaccacattagccaattatagacttagcagttttagtttggccttggtgatacataattcttcactttttgtgactcataaacaaaccactattatgaactcttatttattttggaaaataatgcattttatataaaatgcccagaagtgttttctggcaaagatggatttcataaccattactaattttaggacaatgtaccagcattcaagctacttaggacttcttagaaatgtctccaaatgtcgctcttctttaagtgcagaatatactaactttataaaaactatattacttagagcatcttatgatgatttttattgcatataatggaaaggaaaagaaagcattaagatagtttccagaaatacaggtacctgctgtcataacacagagaactcttctgtatgtgattaaggaggggaggctaggctgtcacgcatcctagctgcaagagagaatatggcaatatggcagctcttctactctgttaaggcagtggacccttcagctcagggaagggccagtaagagaccctattcctgcgacagaagctggaaatactcaatattgacaattttagtgacattgattcttgctaggattgacatgactgacccatctaaggaaacaccaacctatgtgccttgcacacagtggtgctcgatagacatatgttgaatgaacagaggtaaagtacaggtatgtgtagggactccaggacaaatacatggaggtagaaagtggagatggaaagaaccactcttaaaagtacttgattgaaaagtaaagacaaagtattgcagtccacaagtcataataattgaatttaaaagtgagaggagatgccaatgtgtgacaagtgttattcatttaaaacattgctttccgttatacttatttaaaataagtggttaacacaaatattagcaaagctaagattcttttgtattcataacaaggataagcatatttattcaatgctaatgatgtgccagatacaatactaaatccttttacatgaaacacattatttagtcttattaatgacgctgtgaggtaggtaggtaatatttccattcaacacatgggtaaactgtggcacagaaagatggagtatcttgcccaagattgctcagccagaaagccatggctctgactccaaaagaaggtattcttaaccattatacaacacaagggtaggaatgctatcttaaacaggggttgatctctgaaggtagcacatgctctgaaggtagcacatgaggcaacgactatgtaaggtcaaatttccttttgaaattcacttcattgcccataatgtacattacaaatacaacatacatgcacacatttgtctattcaaatctgtatagtatgcactatatatcctggacatagtaacatatggtataaactggatatataaacaaaataaaaacttacagtagaaccactggaatgagatgcccatagtatgagaggcacacaccaagcctgacaggaaatatcagactcatgctcccgtctcgtacttgctctgggacacatgcacattgtttagagtggagttgcagaattacacaccctactgaatgtgcaatctgtaaatgtggtgtttcctgctgtgggcaaagagttgaactgcagaaataaacggtatagatagtgtaactctgctctttggtggctggcttgtttttccctctcctctcccaattattcatgcctaagacatcctcagctctgagcacattcccaccaatatgtaccacaatgagcagcctcaacagagcaggccttgtaaatccaaaatcttactaatgccaaggcggaggtaacagtctccccccttttaactttgagagaaaaatcaggtagccccagcccccctccgccaaaccctcccccctcctcaaaatccccaaatctcaccctctgcataagtcttatttctaaaagtccctgtttttcctgattttacatttgaacaatttacttttgtgtgaaaccacccaattatacccctggagccaagtgaaggtcaaatctctttacacccagtagtcttgacaaccaacattccacttaacaacaagatttccaaatcccagacacaggctctcttaccggaaacatttcctctgtaagtaacagaatgaagtgatcacacacacacaaaagagctggggacaggctctctgggagtttgctgcatgtggcttgacctgaatgtcaggcacctgggggtccccttaatgaaggtcggtgaccttctcccctgcactgcacttctgttccctactgccgccacctctaaatggaacgcctctttcttttccagagggaaggggctgaaataccagactgcgatgtaccatctcttggttgctatgactgaggccattaaaatggcaggcattaaaagactgcacctcagtacccagctacaaagcctcaaggtcactgcattccacagcttcccgtcgcctttcattcctggcctcagagcttcaatatcctggcgagatcccctcgcattatatttcatgaggcttaaatgcaagctctcccacagcaagcccgagagtataatgggggttttaatacattccttttacctaaggctgggatccatttcaaaaagttacccaataggtttcctttcaggtgagctcattgctctgacattccaaaatgacattaaaaaataaatcctctgatgactatattaatacagtacctgggacactgagagttatgccggaaaacgtcttagatgtctataaataaatcttagaaaaaaaacccagcaggaggaatgtgaggagctaatggaattcaaaaggcctcattgctacccccttagagttgaaatccactccgggccgactgtcgcagcagatataaaaagccagccacaggctgaagctgtattagaaaatactgaggcaatagaatattaatctttttctccaaagaaaagccacggactatgctccttggaagatggcttcctttgctataagaagtacactaattaaacatgtacaaggttaaatcctggcaacatgcagctgcttcagggatcagtccttcttgacttcaggtgggaggcattccccgcagaggcaagatatacatgaggcagtgtggggagaatgacgtcagcctcccaaactggcacaaggacctgtgtgtggccttaggatcaaaagcgtccttctttctgctttcctaaaaacatatcttgaaattgccttttatgcctcaacccatcttccttgagatgccgtttctccaaggaagtgctctgtgccctctcagccttgcaggtctggctgtgtcaagtgccactgtgcactactgagggactggaggaactgaaaagcattttggtcataggagggaatagccacgggagaagtcaggcctcagacactcttgtttgaatatggatgtttgagccttagctggtagaataaaacactctttcagagtttgaaatagttttactgcaaatggagtggaaagcgaagtttccaaggttttataaacaacctgatataaacacagcagtgttgtaggtcaaagcagatgtggtgaacagaacttacaaagacatatatgtgtatcagtttattttttccacgttcatttcaacctcagcagagctagcaacactaacactccccagtggcagagccaacaacagggctctagaggctccaaacttggggtcctcttgggtgtccttggatagaattcaaggggtccataaactagaatagaaaaaattatatattttcactagtctctagctgaaagataatgtttacttcaattatggatgtagaaaaatccctatagtgttagtactactgtgattttctcaatagaaatcatgatattttcacatcaattacagttgtagatataaatctgtaatatacctgtagcatctgtttcactgtaaatatatattacatataatatatagagatgattccccttgaaattcgaagtattttattttacttatttgaaaccattctaagaggagactcgtagccttcttcaggttgctaaaggggtccatatacaaaaatggttaggagtccctgtactagggaaacttcccagcagaatggagcaagtcgtgtcctaagacactatctacactactgaaatcctccattttggctaaatgacaaagcactggcaaaagagtcagaaggactgcgttctgatctctaacttattgcatgtcctttggcaagaaagacattcaagcttcttgctattcataagaacacagctactcatgcttacaatgtgccaggtgctctgctaactacatttggttgccacaatgatggttcagtcaacaacagaccacatgtatgacagtggtcctgtaagattataatatcatatttttactgtatttttctatgtttagatatgtttgaaatacacaaatacttaccattgtgttacaattgcctacagtagtcagtagaggaacatgctgtacaggtttgtagcctaggagcaataggttacaccatatggcctaggtatgtagtaagctataccatctaggtttgtgtaagtacactctatgatgttcccttaatgaggaactcacataatgatgcgtttctcagaatgcatccctctttgtaaatattacttcctgtagtcattacagcaaccttctgtggttctattgtaatatttattttgcagataagaaaattaaaccttagaactgttaagtaatccatccacagtcctatccagctaggaagcaacataaatgaaaactttctccaaagctattagatatcatagtctagcaagctaggataacaattcctgccctacttacctcgtaggatttttgtgatgctcaaatgaataatagatacattagatttaaacagtacttcccacccttcaaaacaagttatgaatattttaaaatgattgttattgagattttcaagtatagcaaaatgttgagttttggaaataaccagtgaaaagacaagatgctatcaaagagacttttgaattacatttcatatttaagtggcaatataattattacaaggaatagctgatggactgtataaggatctatgttaatgctagataaaaatggaatcaaatttatgcttgttagtgttgtgctacacggcttgataagtttttctcataagtaaataaaatatgtgcccttcaatctggctgtaggcttttaatttatttggaaacttttatctcctacaaggttttacggaaagagaaaatttagtccatttggccaggtgatatcaagacccagaaaaatatggcttgaccagctgtccagaattatggcctctctcctcctttcctcagtggctctattgaatttctgtgcagggtagagggatctctgcagagacattctcaccttgacatctcagggtccacttacctgactaacgatgaagaagatgacagtcatggcagcgcaggccaaggtgataagcatgaggaacttgaacctaaaaattagcccctattagaaaagaaagagtagtttaatactccatcagctaccaatccttttctcactatgtaaatctataaaaagcttaattttaaagaaatctgtaaaaccaaatccctaagaatgacagtaaaatagtttcccatagtaatatttcttctgcagaggtgagtgtggctgaaaatttcttgggccaagtatttcctatgttcttatcactcataaagcagcgatacgagagcctgggaaattatattcacaacacgtcgtgaggctgctaatttccctgctaagctggttatgcttctctgcaagggttcaaagttaccaaatccaagttttctgtggttgtaataaaattctgctccagtgaacaaaaagaaatgtgcatattaatcaacatgaagtggatttggttgaattttctcatgtcactccagctctggagacaggcaagccttagaaagtgcctgtggtttcctaagagcaggatttaagagaacctgtgtttcagagagggaggcctattattcaggggctcttctgtgcagatctactgcatataaaaactctgaggttctgtagtttctgcttctcttttcatacaggaattaggcttgtttctccaaggacagccacttaggcatgaacccaggggatccctgataaatcaaggatgtgttgcttgcattggggatttgaggatgttaagtgtttctcttgaatgaggaacataatctataaacagagattactgaactctgtctgagcatctgctggatattttaggggaatgtggcctgttaagagtctggaaatcagatcacgtgggctaaaccctgtttaattacaggacagggttgattctgggacagaactttgactaaagcctcatcccaacaaaatcccaattatgccatagtccaatctcccagctagtatgtaacctacattccatcaccaagctgaagaaccggctgaacaagtttattcattactgaaaatggaaacacatttgtaccacagaaaacaccaagatttaggccagctagatgcttctcagagtaagatttggcctctaattttgcccagagatcctacatgagaatctctcaatttgtatttcaaagtaaaggctttctatctccagggtgtgtgtgtttacacatcaagtggaaagatcaagcaagcaccagttccagaacgagccaagaaatctgcccacctcatagtgtagccgccggactttgctcatagctggcaggctggactgcttcccactgatgttccgaaacacctgaaataccatgaagcatagaaacaggaagtagaggcagaggcagattccagccacgatgatgaaggccatctggtcgtgtccagtaaaggaaacaacgggctagccaaggccaagttgagccgggtccaggcccttctccccaggtctgttggcaatacttgttttgtctccaaatatgtagaaaattttcaaggggataaaatattaaaacctgatattctaatgccaatgataggtttcttgacacattagtaccacagagggaggtgttcaatattgctttctaaaccaagtaagaaaagaaatggtgtcttgcttgttagaaatgaagaatctaggccctaccctagacctaatgaatcagaatctaccttttaaccaggtccccaggagatccgtatacacaataaatttgagaagcactaataaaccatatattcgtcactatggatcagatgaaaaaccacagtaaaatcaccagaagggttcaaatgtagatccccaggtccctccctagatatatggaatcagatattccagggctaggacatcaagtatgactatgtttgggaaccactgggctagtccttggagttttataagaatgcgattgagatactctggcataattgaagaggagatacgtgggggctcagtgcaggggacctgggcatgggcttgaaagtcttaaagtgaaaccagggatgaaggactatttgcaatcttctgtcaccacagaaaatcttgtccaacagaatggggattcaaggacacatggcacaggtgggagtctgggttgctgccagtatacttgagacccactagggagactgacctgccaattagagccagtctgagaaccaccaagtcttaggatagcgtgagctgccttggaaggcagatgacctgattccaacccctttctgctacaactttgcccaaattgcctttttttttttgagacagagttttgcttttgttgcccgggctgaagtgcgatggcacaatcttggctcaccacaacctcctcctcccaggttcaagcgattctcctgcctcagcctcccgagtagctgggattacagggataagccaccacacctggcccaaattgtctatttttaaaagcatttaataagtatgaacttggcgtgcatatttcattaaataatataatatctaatgcagtttctccttctttcctataatgaacatcatcctggaatgaagggaatatagttattttctgcaggacttgaaattttactcactccatcctatctacaaaattaaaaaagttgaactagatttaacattagaaacattcttcttgttgtgcagctaacatttggtgggggcataacagaggaagggtagagcttctctctcatctttgaggaaatgatactactgatttagtttgctcacaatgttcttgtgacactgagaaaccaatataaacatcatggcaagacaaaggatattccctagcacgtggcaagatatgagccatcaaggaagaatacaacccaagcctttctctccactccagagcagagtctttttctcccaagatcatttcacatactattccggaagataaaatatttaaatccagcatcctaaaagggataagctaagactgtcacttctgcttcatgaagatgacttagagtttatgccaaccaaccagaagccttggcgacttctctggaactaatcaccttagccttatctccacttggtctcaggaataaatagcagcagtgtgatttgccagcacaccaaggtcacttaagaagtctcacacataggtggtttcagaaacaggctcttccacaggggcccagagatgaacctccatggctccagggaaaagctagtcatgcttcagtctgcaggaaacagtgtataacagataattcagacaggctgcagtaagcctagcaactcggatccctctgctgtgaggataggctgtgaccttctcattttgcctgctctcacccaggcttgaaagcaagcagtaattcttcttattattagccttaattgtgctgttatgattggcctgagaatcaaagccctggctgagtacatatggggagcatcagcagagccttagaaaatgatcttggggactgggtggccaggggaagaaataaaaccctgagcccatcaaggaaggatacggccagctctgttccaatgtctgtagtccagatactgtagaagggattcgtgagttgtacccctctacaaagaaaatgagatggaaaggcaagacacaattaatacaaaggcaacgggaactttccttttcacatattcttagcttttcagctgcaggggtgagggctgtatttaggctaaaaaacattacagaaatcctaaagagaaatgaagcttgtagaatacatcggcccaaatatttttcaactgtaaagagctgtgcctttgatttgatcccagaccttgtctgaggatgtgaccacgtccagtgcttccaaaccaaaggttcccgaccaccattctccttttcaaacactcctcctaaaatgacaggagtgggcgtggtgatgcacagtttggctcagtgtcccacaaacacttgctcacctctcacacatgtcaaatatgaagaggcagaaggagccaacggcaatgggtccgacttgcttccaataccctgcgatgtggttccgctcgtgctgatcctgaggaaaaccaaattgagaagggagatagaggggagaggaagaccaagcaattctatgggggagtcagcattcgaaggacacttgccgaccacctattgtgtatcaagcactatgctagattctaggtatgagaacaaagaagatgaaaatctcttcttcaggagctcatctctgtgggggagtctggcacatacgtagaacatgacaaagcccagccataagggctctgagagtaataagaacaggatgccatgggaacacaaagaaaggcctcggctcccaggcaggggacattttgtggtccacaaaataactcattctgaattaaatttctacgtgacttgtaacttgtgtttataaaagtgactgatcctcagaagacaaagtaaagacattaaagcatttaaatatgtaaagtgtgtctattatggtgaggaaaataggcatattttctccccatccttattaaaaccaggaatgagtccccttgataaacaaagacaccaagagaaagaaaaggaaggaatgtagaatgagaaaaaagggaaagcaaagatgatcttagcctccaggtggggccccaggtgggtcagtccacaccagctccctgcggacaatccttggctggcttcctggtgctggaccaagttccatccactcccccgccctgctgctgaggcctcattctcagcgcatctctgctggaggacacctcatggagaaagaccccttaatgtagacagtttagcagtaggaagaagtctctctctctgctctcacactgctctcctggaagggcagcaggacttgagaggtctggttttcatgattgagccataatggaatttaaaaacagtccactctgctgtgaagcccatgtgcctgacgtgaagaccaagttccagctggcatatcatcttagccacaatgtgatgatgacaccattcttatttttaaccatggtaccttcaatccctcttgaaatatgatttggtgtctgtgcaaactgaggagaccgggaaggtctgtatttcagagtaataggggttactaggccacctggacacattgccagctggaaagagccaggcccacattctctgatggttaacctgtattcctggggacaggacaagcagggcagaagccagcagacaagaaactcaagctcaagggcaagaaataatactaatcattagaatgtgtgtgtttatcttaagttactcacattctgtcatttaattctcatgaaaaccccatgcagtaggtctttacatcccattttatagatgagggacccgagattcagagtgataatgtcatttgcctaaagccactcagctggtcagcaggtggtgaagcaggaatgtgaaccagagggtctgcctccagagttcccacttgtaactactagtttattctgtctcacccactgctgactagaggcaaaggggggcaggtgtcagcttggcagcctgcacagagcagctggtacagacgtctgtccctcccggcggctcttaccatcatgtgctcgccacagaagatgatccagaaggacagaagcatcgcatagaagatgccctgtcggatgtcaccaaacagcagcatccaggtccagtcaaacccgatggaaaaccattccactgggatattgataaaggtcatggaaatcccaagggcaaagatgactctgatggtgagaaaatatcaggacagccactttattcatctggaaggcagattttcaaacaattccccgaattcagttttgagacatgagatgttacttattgggtctgaagccatatgatcaatttcttctgcacagagatgcaaaacgtcctatgtagttggcactgctgcagaatgagggagtgctataccaacctttctatggaagtgaacctgacctccttaatgcctcacactttactttggtaccactgcagatggcagtcttcctataatgtttgtgtccccttgccttctcacccaggcctcagtgagtacaattgtcctctttcacctattcaggttatcattcatctgatcattaagaacactcattattattgtgatatcctcagcaactatgaattatataagcatatttgtttcaataatacatgactccaaacacatttgaaatgtaaattctcttgactgcttgtttagcttttattttactcttcccctgtcacactaagaactgccaattctctactaaaatataattcttaagtcactgatttattcatacttttttccatccccttgaaacacatatgttaattaagcacagatcatgtaccaggtattgtgttagcactatggaatcctaaatgaacaggacctgttttttcactcacgggagatacagttagtagaggagccagataaagagacaactgaatagattaggatcaggaacatcatagagttttaaagcatagagggctgctaccaggacttctgactttgacacagacaggaatggagctgacttgtgagtcaaagtgagggaagtggaaagggtgtttggaggagagggcagagcctggatggaggcatagaggcctggaagaacctgctgcatttggggatctgcatgtggcacatcaggaaatgacaggacatgagaccagagaaacaaagagggctgtgctcatgaagaaacttgcataccccactggagaactgaaatttatcttgaagagactttttattggaatccaataaaaagtttaaacaatggagtgacatgattcattcaaaaaatatttattaaactcctactatgtgtcagtcactattctaagatgctgggaatataactgtgaacaagaaaagcaaggattgtgctcttgtgatgcttgcatagagatggaatgagagagggagtacaagaaaaagataataaatgaagaatgagcatcatgaaaaaaaaagctaggcaagagagtggagagcaatggggatgtgattttacgtaaggtggacagacgaagagatcagcaggtgtgaaggccctggggtgtgggtttgagcacaataaagggggctggtgggtggtggagaggacaagtgacaagatcagaggtggaaggcacccaatcatcaaggggcttataggtcagggcaaaggagatgaaaagccagtggagagctttgagcagaggggtgacaggatctgattaacacttgaaagggggcactcctggctatcctgtgaataggctgcagggaggcacgtgatggaagcaaggaaaggggttgcgaggctgttcccactgatccaggtgagaagcgatggttggttagttagattagggtggcagcagtggaattggtgagatttcctggtgaggttgatgagaagtgtgaaaaacagagacatacaggatgactcactgctacatttccagtctgaacaactgaaaggatggagttgccttttactgaaatggggatcctgggagggaataggttggaaatgggacacaatcaagtgttgttcttggtacatgtgacattttcaatgcaaatgaagacattaagtaaagagctggaatatttgggtccagagttgggagaggctgaggctaaagatacagattaagagtcatcagagaatagatgatttttcagaccacaaaggtaggtgaaatcaacccccctagggaaagcacagctaataaagagaagaggtccaaagcaggtgccccagtcccaaagtctaagagtctggaaagatggaaggagacaggaatggaatctaaatgctggtcagcaaagaagaatgaccaacagaagggtagaggagactctgggaagaaaaactgatcaattatgtcagatgctgggatgaataaaaaaaaagtgaggaacaaaaaatgacctttggatttggactatgaaggttgttggtgatcccgtgaaaagcagttttagtagagtggtggagatgaatccagactggaaaggactcaagagagaacagaggagaagacatatgcacaaggtttttgagaagcattgctgtaaagaggagcagaaaaagggtatgtggcttcagggggaagtgggaaatgggagaattttgtctaagaatgggagatggcaggacatgtttgtatattaatagaatccagcagaaagggagaagtcaatgatgtggagagaaagtaggtacatctacaggagcactgtctttctgtaagtgagaggagctgggcttaggggagtttcttcactacaacacagacaagtatctgattctgaccacggaatatcccgaagagcaaagacaggttaaagaaccagaaaggtcagctgggtgtggtggctcacacctgtaatcccagcactttgggaagctgaagcgggcaaatcacttgagctcaggatttcgagatcagcctgggcaacatagggaaaccctgtctctacaaaaaatacaaaaaactagctgggaagcatacacctgtggttctagctaccgggaggctgaggtgggatgaccactggagcctggaaagtcaaggctgcagcaagctgagatcccagcactgcactccagcctggacaacagagtgagaccttgtctccaaaaaataaattaattaattaaaaagagccagaaaggtgagagaggtagaaccccgaggatttacttaataacaacttgcataggaaaactgcaggagaaaaaggagtccaggatgactcctggtcaaatcactggcctaagtcacacactggctgcttgaactggacaccagcaaaagcaagagcttggcagatcatgagaagccagtattcctgaagagcgctccaaaaccagctcttacttttccagaagcactgggggtcgggacatcatggtgatcctcctccaataccacaccataatgatgaagatgctgggcgtaaggaaggtcttcatggcaaaccacaccttggtgaagcctccattttggtggatcccctaggcagagaccagtgataattttgaaggtgaatattatcttagcatttccttctactagcaaatgcttttgtgggagaggtaagtggagacctcgtctgcgaatgttcacgatcaagagctttcacattcatagcaggtactgccctcatacacccttggactctcctcagagataatagaaatacatattaaaagagccctgtgctatggacctgagaccagagaaataaagagggcatcccattcacaataacggctttcatgttctggggtctgaaagaagaacatggggctttggggcagggtcactatttccaagagacttcgaattatcttaccttggactcatcccactgatattaaaatgctaatacctaaagatacactttagaggtacggattaatagggcaggtatggattaatagggcatacagggtgtatgatatctacccagctaccacccccacagtgtaccccccaaaaaagccacatttgaggtagaaccagaaatttcaggtaaaaagcagagatatcctctatctcttaacacctctcttggccgtttaatcctcattctaccctcacatcttactaatctggtctactaaggctacaagagctttttccctatgctaagattacgattaagtacatgatcaattttttttgtaagcttttcattagaaagttgcagatatcctagatggtcaatatgttgagattggtaagtgttaaggtaaatctattctataaaatgctaatcaatattggaaagtatatttatattacattcaccaatttatattacatataccattaaataaagaaagcaaggaaaacagtcagttcaatatgatcctactttttgtaagggaattactacgtataaaaaaaagcctggaaggagatatatcaaaacctgaacagtgattatttctctaaatagtaggacattacaggtaattattatgcttttctgtgtctctacacaattcttgtgggactttgttgagattgaaaagaaatggcctccttgcagcaagttctaacttttccccaattaaacaaatatgatggaaagaacctaaaccacccctattccttttaacatttgtgcttgcaaggtgaaacacataaaaaagaaaatttacttttatctcagtgttattcattatgcaatcatgactatttcatgatcttatcatcattgtaatgatcttaagtgatcttaagcccatttaaaatcttaagtgggcacaataattgcattgtttcccatttctgtaatctctcacacaaattagttcactttatgatctcagccatcatgagtatgttattattcccatttctcagatgagacaggtgaggcatagaggtgccaagagtgagatggagttcccctccaatacacatgtcaagatcaattacattcacttaccaccaaccggatatcctttatctccccaattcccacattgattttcttcttctcattcacaggcagccggatgtttaaaaggtaaaacttatgggccacagacccaatttccatgaaaggaaggacatcacattcatagtaacggccctcatgctctggagtctggaaaaagagcagagggtttgaggcagggtcactatttccaatagactggctctgaattctgttaccctggatccataacatcaattgtaagcagctaatgcttaaaggtacactttagacgtacagagtaacaatgcatactggaggcatggcgtctacccagctatcccaacctaaaacaaacatcaacaacaacaacaacaaaaaacagctgtattcaaggtagaaccagaaattttaggtagaaagcagagataccttccttctatctcctaacacctttctaggctgtttaatcttcattagaacctcgcatcttacgaatcttgtctgccagggctacaagagtttttatctgcagtgtgttgtcagggtcctctaaggctctgtggaacagtcagcttcttaaacgttcaggtggaagctcttgctgaatcattacactctttaatgacggctaattattctcctgattttggcctgagggagaagctagaagaagctgaaaatatcttctttttattcacttgccaggaaaaaaaaagacacaaggagccgttggtatttagggaaggtcgaaacagaagaaagaaagataataagattagtggccagagatacccactaagaattttctgcctccggtgcttcctaacagtccaagatggcagaagggaatagaagttttaatgaaataagaatttagcccagtgtctaggaaagcctcttggacttcgtgccaaacaatttaagagatactgcccagagcacggtggtgggaaattggacagtagggagacaccttttttttgaaaactaaattctgctccacctcaccaggactcccggctgtgtacctgctgaggggtgggggccaggggtaaagatgagcataaagaggcatgagcttcagcaggccgggacttttccctgatatagaagatgagagtctaccatcaatgttgggtttctatgtcagcttcaatgtttccttggcacctcctgatcaagtgataggggagatctaatttgtcgttcctaagcctgaatttgcaagacctccataatttgtcataaatcttcagagcaaagatccactgaagaagtgagaagaaagaagataacaaagagtccatagtctaagagtatgtaggaaggggctaggaaggggctctgccccttctgagatcttggctggtggggagggttccttactgaacagtcagagcttagaatgcagtaaacagacctttgtacagagacagagacacacacggcaaggtagaggtggggaggtgcttctacctcctcttgcccaccacggcacacataaccaatcagtcgtcaacagtttttatccctaaggtgtgagcagctcttgtcagacacaccagttgattagagttggcatgtgagatttttaaaaattcttctgtagaaagaatgctgctttttcaaacctcagctgcaggtcagatgattcttcctatatagatcatctttctctcccctccactcctttctctcttatactttcaaatcagggaggatgggggctctgcaggtactactaaaagttcactgcaggctctaattctccctcagattaagctgcagtgaggaggctgattatcctctgtggtaacagcaagagggtattttctgatttgtttccagttagggccttattttattgatggaaattgagaacttgagggcggaagggaacaaaacctacttagtctaattccatctggtgtgtgtctcgcccagggtcccaaaagtagtagcagaattgggagaaggacatgggccctgcccaaaggcaggcattgtgctgtgataaagactcctgaactccaggccaggaggctgattctagtcctgaccatgttccttgctgggtaccttgggtcaccctgcctcatttggcctcagtttcctcctaagtgagaaagttaagtaagatgatctccagggtcacttctaatcccccacgatgggtctctgggtgccccacacttccctgtcactactgagtgagtaacatggacacccttgacacaaatttacctaagttcaaattaaaagagacacattggcatctgggacactggctcaaccttcctgtctcagagacaagttcgttgtatcctgttagagacttttcttcatgcactaaagtcctgcctctgccagtatttagggcatttaagaagattcctctctctccttcctttgccccacccccagttctcccccaactccagcatgagactagctcattaggacaaattacagcaggtggcaacttgacttttttttttttaacttcacaatccaccagggactcaaaagctttaaagcaatttctcatttaatcttgagactcaagactaaatttcactgcaatcaaaaagcagagacttgatgattcatttccttcgcacttttcaagatttaatatctttcttgcaagggatcaacacatcctaaagataattaagcattaagaagcagttgcaggcaaacacccttccccctcgctactcagtgccctccatgtgtataaatgagaaatgacttttcccttttctatggataaaattctgtatccgaaagccatctagcttagatgttcaaccagtatttcaaagatgcagtcaacttgcagagatagctagaaaggtttttaattttcttggttgcatgcaaagatctgaaaatgttagctgttcctctctcctgcttcctctagtttgtctatcattcatttctacctacaaatggctttctctggaggacagccctatatttagcactcagcagagggtctagggcagtggctctcaaacttcatagagtttaataaactgaaggcctgttaaaacacagattccttgctcctacaccctgagacattgacttaataggttctgggtgtgccctgggaatctgcctttcctaaaacctctcaggtgatgctgccactgttggttctcagaacacattttctgtagctttgttctaggaaacctgcgggagggagactcccctagtgtttcaaaaaacactgcaatgggtacttaggtttacccatggagggccttagtttatatgttttctcctagtggcccatctggttaatatccgctttgactctcaaatatgtcccagacaagatgttaaattagaaggtcatcctgcctacgtcattgtatcatctagtccaggggtgtccaatcttttggcttctctgggccaaaccggaaggaggagaattgtcttgagccacacataaaatacactaataatagctgatgagctaaaaaaaaaaaaaatcacaaaaagaaattataatgttttaagaaagtaatgaatttacattgggccacattcaaagccgtcctgggctgcatgcggcccgcaggcagagttggacaagcttgatctagcccttaaacagactcccaaggtaggtactcttatctcatcttgcagaagaaaaactgaagctcagacagattatgtaagcttacctgaggtcacaccgtcagtgataaaaccacctaatctttctcctctttaggaaaaaaatggctaaagctggggcaaggtactcagaggcttcaacctcatgtttttactattttgcaggaaatcttaacagtaataggcaaaagcaaagttaggaaaggcccgtggcaggagagaagaggaaataaaatgctccgcagagcaggtattaccaaagctgtcctcatgcgaagaagggacacacctatgaaaagtaagcaaatctttccacatacctgagaaccaaataaaaactgtcagcttagacagcaaggggtcataccttgggagatgtgaaggtgcatttgagtttccgtggtactctttcatgggccatttcagtccactcagcaaacgcgtcatcacggtaagccagggaaacgtccatggagacttctgcattttctcctgcaagagaaaggatgcacgtttcagaaatgacttttggaaagatattttagaaacagctcaaaaaattcttataggctttgacttggaaaccaacgagacaaaagggaaatattaatttctatcaaactccaaacctgaagacttagaagtcataggatgaaagtctaagccaaatgctgggtcccctctcatgtccactctgccagagtcaagagcctccatttaaactcttccagagacaggggcctcactctctctgagggagcacaaatggtcagacctcatcctcccataacttgtaccatgggtcctaggtctgcctgtagaagccacgtggaaggtgatgtccttccttcttccataaaaagtgccttatgttcttgaaaaccataccacatctgcctgcattctctttcctctctgataaacatgaccaagtttttcaaccacctctcagacacgtccctctggggctcttctctggtcacactctgtctgaaaacatccttctcaaacttattcccgaaagttctcaaatataggatttgctacttttccaaaagtcaaaatcccttcatattgtggatgaagttaatgtaaaaggcaaagtgtttttccaaaattaaagacttatacacagataggaataatacataattgcacaaatgaatgttcacacatacttccatatgtgtggactggaccacgaatgagttaaactcaccacagaactcattaaggagatgagattaataaaacattgcacctattaattttgtctgttttatactatgatgagcaagttcaagagcagagaagtcttttttttttttttttttttttgagtataaaggtttaattctatttaaaaagaaagtccattaaatcaacttcaagttcttaactcatgggactattttggaacacttctttgtaaatatcattttgttaggttattggcaaaacagtttcaaggttcacttccctcccttgaaccaggtccaggtcattttgctttggggtaaattaaaatcagaattctaaaagttgagcaactttgtttttttttaattgacttagctctaacccaccattacaacttaaggacggcatgacttgataatgatggacttgtgtgaggttttgagttttcaattaaactttgtatcacatgaggtaattgtcagcattcttgagtctggttatggaataggcagatagaaccctgtagtaacaagagttggaaattggctaattgacaacgcacttgccttaaacatctcaagtagagaacttttacattagtgagatgtacttgaatttcagaactcaacaaattttaattactttttactgaaaactgcagtgaatgctaaatgtctacgtttacaataaacaaatacagtaacagtaactcacactgaaacaaaacatacttctgatagccattatttttctgcttgggacaattttaaagtttttcttttgtcacaaaaacaggaatgtatccaaacaaaggctcaaaagaggccatcttttcaaacaaaaaggcaatgattcacaaaagactgtgaatagaacatgtaactagttgatacaaatctaataggatttgttaaaatcagtcacatctaatacatctgaagtgctcttgtataaaatatcacgtgaagaaaagaagactttatcaatgtctaaaaaagtgggtttgttcatagacaatctgacaagttaccataaaaagtgtttcctgagacataaggaaatgcaacattattcttcttgaaccgttttagctcaactttccactcaataaaacagcagaggatctgaaactgagaaaatgtatttgagtacaaacagcttgtgaaagttaatactttttttttgcatcagagggtttttactgaacttacaaccaacttgcccactcagtatgcagttcagatgtgagagatgcttctctgtacaggagcctgtactgtcttcaatcctatgcgagcaagtgtctaccacaggcaaacagttttctccccattttgtagtaatgtaattttcctattagcaaaaggaggtcaccagcccctgtagacttaagggactcaagtcacaggatggggatatcctcttaatattttttattttgttgtttgaactcttgatgcaacattgtagagcagggtgttcaggacctgctgtgcccaagggactgataaaggaaaaagctctatttattctttgtgatttgatgcacagatgaaaaacttaacacacaataacagaagttggtcgttaataaatcacatcctagtctttcagcgcttccgtaagcagacgacatcttcagttttctagctcttgtagttttaacactgcagcatcaatgatgcataagtccagaatcagttacaaagaccatcatattctttttctcttagttcatcatttttcactatctcttggtcccaaatgtatctgaatgattaccttccggcattctctgctattgctcgttggagtgctctcgattgtccccgtgttttgtgggctggttgggagagggcgcctgggaaggatgtgccactgttgggaggttgtgagtcactgggatgcctccagggatgatcccttccacggctgcaggaagtcctcctggagccacgcccacgatgcctggcggatatctgtatgtggcaccattgagctcaggatgaattgcttgctggtctattactgaccaaggcgctgatgtgacagagaattccttgttcacacagtttcttaagctttctgggatgtgacctgtgatggctcggcggatctcagtggcagctgcctccctcatctccagtgacgcctgcttgctgtaccaggcagtgtgaggagtgcagataagattcggtgcatctttcaacggaccctgagcaaagctaaagggctccgactcacgcacatagagggctgcccctcgtatcctgccctccttgagagcttgtgctaaggctttctcgtccaccaggccaccacggggtgcgttcacaaggaatgctccctgcctcatctgctttatggtaaagtcattgatgaggtggtggttatgttcgttgagattgcagtgcaaggagacgcagtcgctctgatacagcaaatcctacagagtgtagaccctctgcacgcccagggatcgctcgatcccatcctgcaagtaggggtcataaaatatgacgctgaatccaaaggccttggctcgaactgcaaccgcctaccccctgcgatcaaagccgatgaggcccagcatttccccacggatgctggccgatcccgaggccaactcgcggttctgctccatgctctgaacccgtgtgccttaccgcagtgcttggtacagccatgtgttcctctggtacagattgaggatgtggcagatggtagagtccggtgtctcttccacggctgcagacgggatattgcacacagcaattccgagctcgctggcagccttgatgtccacgttatcgtagccactgcctatctgcacgatcactctcggggccttaaacttttctaggtcctccctggtgaggatgatggtgtggtacatcatggtacccatggcttcgttagaaccttctcgtggatttcctgcgtggactgcgcgtcacagaaggccacagtggccaggtctttcaggatgggcatctccacagtgcagtcgcggccgtccagcagcgccaccagggggcaggagtgcagggggccgttcatgatctgggggcggataccttcacaaattctgtccaattgctgtctcttgactttgtgcttatccacaagggccatactttatggaactttgcaactctcagatcaaaaggcaaagcagtcctctaagaacttaggggaactcgcaggagtctccgtgcatgacgccactatgaacccactataaatctgtacacactataaatctgtacactataaatctatagttcacacgatgggctgtccgtctttttaagggaatacagcttcattggttcaaaaccatttaaggtgatgaaaccctcgtcccggacggtcagcgtccacggcaaaaggcgcccactctggaggccgcggtggcggtggctcccgcccctcccaccccaccctgcggcggtggcggtggcggtggctgcagctgtgcagcctcccctcagcgcagcatggctcccttttcggtccctcgctcctccgggccgctcccgagccaccttaaaatgacgctcgcacacagggacacacaacacaaaaacttaatctctccagctccccaccactccccctccctccctccgctaccccgctctccccaccctacccctccagagaagtcttaatgaggaaaaaaaaaaaaaaagcacaaatcacatttccaaaatgactggagatcctgccaccactagggttatgaaaatgggcacaattttaggctctggctattcagccttgaagaagtctcagtatccaggcacctgagtttgctccatacccacctcctccagggctgcgacaaggattaaaagtcaagttagtgaaagcactgcatgctgcctcatatgcagtaggtgcttaataaatgtttactaaacctgaacacatacaaatcacaagggaaacagataggaataactgccctctgaaaagcagggcttttctacggtggcttaaagctgacatggcagcatggcagatccctggttctcagaagaaatctcggaaaaggaagagatgatccatggaagaaggaatttgaggccattctgatatagaggaaaccctcgatgaacatcagtacccactattctattattcctatttttatcctcagttaaacatagtgaattagccactgtgttttcctcctgaaattccacaaaataaagacaaagacagtaaaaagaaaagcaaaagatattaaatcacaaggggaaaaaactaactgtagacacatgagcagacaagagatttcatttttttttttttaagacagagttttgctcttgttacccaggctggagtgcaatggcatgatctcggctcactgcaacctctgcctcccgggttcaagcaattctcctgcctcagcctcctgagtagctgggattacaggcgtgcaccaccatgcctggctaattttgtatttttagcagagtcagggtttatccatggtggtcaggctggtcttgaactcctgacctcaggtgatccgcctgcctcagcttcccaaagtgttgggatcacaggcgtgaaccactgtgcctggcctcaaaatttttttaaaacataaaaaatacatgaagtagggtttcctggcagccacagcctacactcctatagaggggatattctagaaaagtgagccaacatatctgcaggaacctgaagccactcagaatttgaaagtaccaggggttgcagaaggcagaacaaagcatggcactgacaatggggtgactgggtcaaagtctgcacacaaaactgctggacctcagttctcccacatcttcccatctgtgcaagatccaaggagagactctggacttgaggacaccaggggaatatgtagacccagggctggaggtggagaagagcaagagtctgtagaagaaactgtgccactcccagcttggcagaaacaatgttcagagttggtatctccccttggtcagggaccaagctggctacaacttctccccacttagtagcctcagtggtcaacagaaagaatcagtcagagctcccatggagtcaaatcttaggcaataaagtacatcctacttataacgctgggagtaggaattgggactttaaactgtgttgaaaagggtgcttggagaaacacaagagtataaatatgaaaagctgtaaaaaatgtcatcagctcacacacaggttacaaattactcacaggttgttctccttggagccatagggttcagagcaacactagccttagacacaggcaagaggggcctttgaagtttgggccccacacttttaaagggtcccacacttttaaagggtcccactctgtcaactgttcccttctttataggacaagaagactcccaagtgaaggggatatatatacccagagcctacagaccccctcacttctagaccacgctccgagatgtcagactccagaacattctgcctagacagctctgaactcttatcttacttccaaggtctgtgtggcctctttccaggtctggcttcccaagaagaactagacaaccacctgtatactcttggatgttcggtgggggtgggagtgaaaaggctgctatttgttggaagatatgaacagagcttgagctcggaggttagggtgtccatgtagaagcacgcaaggcccctctctttatgggatggagccagcggtggggagaaaaggggtgtaggggcccacacttcctgaccagtcacattttggcacagaattccaagtcgtccatgagtcctcaattcgaacctggccatcctgttcattatgcaagtaactcatcatcagaggatgcaacgtacttggcttaacagtttgctggcctgatttatcacttctaaatatttagacacatgataggcatgccttcattcatactgtttccccaagccagacaaatgtttgtagtgggcctggttcagagcaggtgcctcacagagacaaggctagataggattgcttccttgcctggtcccagcttcaaaagttattctaatctgttgaggatcctcaaaggaaaaactattttaaaatatgcggtttaaaatgaaaattgtgcacagtattttaatgtacaattactccatgttaagctcctgtggtttctgtgctttaaattacctcatttaatgttcccaacaattccatgaagtggacagaatattttattttaattaatgagtaaagtgatgccctcagatcttaaggaacttgtataaagtcattgaaattgccttaaaataaaatcacttttttggtattgcttaaagaaaactggctaacttgtgatagaagaagcccctcaaagcagtcacacaatatgaatatgctaagtctttaataatagcaacagctctccttcatcagaggctaacatgcaccagccttcttcaggcctcacatccatcctgggaggaagacgttatataaattgcccaagaacatatggctagtaaacagcagagctcaagtctggatcacgtaagggccccactgcactctactacctttgctggtgaaaacaaacaaacacagtagaattcaaaagaagctaacagctgaatcaagcatacttggtcaaagagccactcaacacaaactaaatacctttccagctttctacaggagagaaacaggcaatgttcctgggaggctgcaagtatggctcataagaatgtctggaattatctaatctaagctttctaaagccatctattgttggctgttaaaattatagcatgttctgccgtctcttcacgttaccatctccttacttcccgtgcaatctgaagcagaggtgttattcctgtttatgaggtgaagacgccataactcagaaagccctaccctagaaataccagactcaggaccctagagcttcatagccaatagtctcatagcatcctgccatcttttatgatgtacataaaaaaatagaaatcacagggagaatggcctgttcaagtgacctttactagactgtgatatcactcctcacccccagacagatagcacacatgaggtagcacaggtcaatcttagcagacctggttccttacctgttaggataagacttaacgcctagaatttcatgattattacactagttactgcatgaaaaatgctcaagacagagcagaaagcatgaagggtaaggtattgttgttgacattttattagggaagtgaaactcttatccttaattcaaaataattaccaggtttcaggaacatggagcttcccactatgaatccctaatccaaacctagatcacaaaacccagaaacgggaaagcactggacagaggaatacagtaaaactgcgaagctggttacctgaattgttttctcttctgcctccagtggacttggaaataaagttcagcattaatgatgatgttgcatttaataaaacactggtttcatgactcctgggatactgtgtgggcaatacttcccctccaccctccagagataatgaaggcgaggaatccaatttgaactccctgggagaatggcaggaaggctaagctacatttggcactatattagaactttccctataaaacaaggacactggttatatcagtttcatgggggtacagttgtaaggtatcagcatagggcatttatagatttgaaatccatggttttccatacctatactataccagcagctttggtatagaagcccataggtcctatgggctagccaagcttcacatttctcaaatagctttggagacatattttagttgggtggagaattcattcagaggaggaagggaagtgtggaaaggcactgtcgttcgttacacttactatttccatcctgttatgggggcagtttcccctatgctccagggttccataggagcagacctagactgcaaagtgtggttacagacagaaagatccatgcctttccatgttgggaagcatcaactaattgtatccttaggaagtctgtctctataccagttatactgccctgccctgcttgagaaaagcaaagccaatcagtttttctgcaggcaagtggaaagtcagagaggagggcaagtaccttctataagccagaaatggtgggaggggggtgctagaaatcgctaggaaagaggtctagtgtccccaagaaatctagggcagctgcttaatgtaagaatggtccctggggtgggaatgtggggagaaggaaaagcaatgaaaaggccactagagccttaattgaggaagacatcagaatgcttgtcacctaagctctacaccttctatatttgaaacaggtatttcccagccaggatagtacaaagtgtataaattgggcaccaaatggatgtgattttgaattctccttttatgacttcccacctgaacaaccttgaataagtctcagtttccacctttgcagtatggaaacagtgggaactactccctaagtctgttaaccaataccagttccttctccatctagtcccagggtggctgggttatattgttgacctattaactggaataaaaggggaaaaaggagaggacaagatatattagaggaaatcaggaatgattttatggttgtcaaaagcttttaggttcctagagacactttgactttcctgggcctttgccctgggaaaaaaattaaagaggtttcaatgctcgtgtgcattcccacattacataggggagctgccagtcaccagagtttgtttgggtaacctcagaaagaggccacagagacaaatctcctcccagcctctggcagacatataatctggagttatttatgccagcattccttccccaataaaaaactctctgacctggcttgaatttttcttgacgctttcaattaaggaaataacaaaaccaaccctgtcttatacatggttaggtctggcaaaaatggactcagctaattacaaatttggccctggcggttttcttaagatgccctacaggcctgggtgtgagtggttataaaaatgaatgagtacaattattttgcaaaccagcctaacagtttagttcacattgcttctcgtctttcctcatcaaatcaagcatttgaattgcagagaattatcttccacatgtaagaaaacatatttctaagcattgcaaaactggttccttgctgtattctgatgcattatcatctggttgaagtcacatatctgtctatggaacatgacaaggacaagggagaacggtgctcacattaggttctcttcaaagtgacatgcagttagaaaacatccacttacccctattgtagccaaggctactagtacttaaatgctataccactgaaaaagtaagtggagacatcaatttttttaaataaatgaatctgaagtaccaccgaatatagaaaaaaaccatatctattgttcaccaggttggagagtagctctttcctcatctaactcaacacgttcaccctgaaggatttcatctgctcctgggatgcaagtcaccctctccagtccagatttccctcttgatatttgaatttgcatgctcacttttcaccagtctctcctctttcatggtttagaaatgcaaaccaccaaatttggtcaactctactaggtgtctttcagatttagcctcctctcctcactgatatgccgcttgttcaggccaccattatctccagcctccatgactaaaacacctgccctgttcctgtctaattttcacacttcctgctacagaaatgatttctaaaacactttcaatgcctttatattgtcttcagtgtgatattaagactccttaaatggcataattggctaaggtgttatgtagcagcctaggttctagttctatgaacgttcactaccccttctacctaggttggccacttcaaatacagcccctctcctctccagccttggaagatgagtaagagctcagctttggagacagacaggctgggaccacagcccaccttagctacttggtgcctatgcaatgttgggagtcactaaatgtctctatctgtaagatgaggataatggtaatggtaatgcccttctcctatcactgtgaggagtaaatgagataatgggtgccaagcactcagcacaggcctggcatatagtaagcactcagtcaatgctggctactatttcttttttttttttttttttttttgagatggagtttcgctcttcttgcccaggctggagtgcaatggcacgatctccgctcactgcaaccttcgcctcctgggttcaagcgattctcctgcctcagcctcctgagtaactgggattacatgcatgggccaccatgcctggctaatttttttgtatttttagtagagacggggtttctccatgttggtcaggctggtcttgaactcccaacctcaggtgatccacccgcctcggactcccaaagtgttgggattacaggtgtgagccaccgcgctcggccgctggctgctatttcaaggctagtactcaaggttatctacacctgctgtactcagggtccccataatcacaccaaattttatgaagagatgcctcctttgagagggtaaattacaaaaggcttctttatctgggctgcagacagtgcttggcatccccgctcgtgccagactcctactcatcttctggaattccccccagatttactcttgccttcttttactcacccaaactcaatatggcaccccccccttgctcccacagtaccttgttcacccagcaatatgacacttatgacacttattctccatgttgcttctcctgactacttatccccatctctctccctacccatctcctatttaggctgggttcctaaaagccagggactgactcagtcttgttcacagttatatcactcatgtctttgcacaatagatattcattgaatatttaccaaattaatgattatcatccttctttctccaaataactcttacaaacctaaatttcctgtcactctaccatcaaacaagtggtttgctctatattttggtgacattcatactttctttctccatcacctgcctttttacttctactccccccaaacccctgcacacacacccctgaaatccctgtgctagatggaccatccaactctatttttgtttccaccaaatatttttgagcacctactggtgtcctcgcacaagattggatgtaaagcctaaaaccataaaaaccctagaagacaacctaggcaataccattcaggacataggcatgggcaaagacttcatgactaaaacaccaaaagcaatggcaacaaaagccaaaattgacaaatgggatctaattaaactaaacagcttctgcacagcaaaagaaactatcatcagagtaaataggcaactacagaatgggagaaaatttttgcagtctatccatctggcaaagggctaatatccagaatctacaaggaatttaaatttacaagaaaaaaaaacaaaaaaccccatcaaaaagtgggtgaaggatatgaacagccacttcgcaaaagaagattctaatgcagccaacaaacgtgaaaaaaagctcatcatcactggtcatcagagaaatgcaaatcaaaaccacaatgagataccatctcatgccagttagaatggcgatcattgaaaagtcaggagacaacagatgctggagaggatgtggagaaataggaacacttttacactgttggtaagagtgtaaattagttcaaccattgtggaagacagtgtggcgattcctcaaggatctagaaccagaaataccatttgaactagtaatcccattactgggtatatacccaaaggattataaatcattctactataaagacacatgcacacgtatgtttattgtggcactattcacaatagcaaagacttggaaccaactcaaatgcccagcaatgatagactggataaagaaaatgtgccacatatacaccatggaatactatgcagccataacaaaggatgagttcatgtcctttgtagggacatggatgaagctggaaaccatcattctcagcaaactaacacaggaacagaaaaccaaacaccacatgttctcactcataagtgggagttgaacaatgagaacacatggacacagggaggggaacatcacacctgggcctgttgaggggtggggggatgggggagggatagtattaggagaaatacctaatgtagatgacgggttgatgggtacagcaaaccaccatggcacatgtatacctatgtaacaaacctgcacattctgcacatgtatcccagaacttaaagtataattaaaaaaaaaaaatactcagagaagttccaaatgctgtatataaataaatacaaatcttatatagaaataggatttggaactatatacatgtatataaacataaaaatgtatgtttatatatgtctataaagagtgaaacaattaaacttcttctataaaaaaaagagtagggataaaaaggcatataaggcaaagtcattgccctcaaattgtttacagtaaagtggtgaaggcaggtatataaataagtataattccatgtagtttgtactgcattagaagtatatatgaagtatacagtcagcacaaaaagatcaagagttctgagtagaaggtcaagaattgtagcacagaagacacaatcttctggctcaccctactgagaagaggtgatatttaccaatgaattgcagaataggagttcactaggcagcgagataggaaaaggcattacaggcagaggaagccccatgtataaaaagtcacataagcacaaaatagcagggaaagcaactaattcaatatggcagggaatgtgagagggactggagggaacagggaaggctagagaacaggaagggtctaatgacaaagggaagaagcttgccctgagtgctgcagcattttgcttagaggatgttaaagcaaaggaggagattctggcagctgtgcggaagacggactgggatggggggccaggtagacaaagagacatcctaaggaaactgaggcccactgctaacacagttctcagtgtgcttaagacgatttaaccttgtggaaaatactgccaggaggatattttctaaggaatttgtttaccaaagaatctgaacccaatgatgaaccaatctttcgctaacaaagctagagaactcagaaccatctaagttagcaagtgttaaaacactggaaagcaaatgtggcaacagcactttcctatttgaccataatcaacatcaatgtggaaagaaaacaaacctgaaagcaagtgaggaaaacacacagtgggtttctttgctttctctccaggacactgtcagtacacagagcatttagaatagctgatttgatcgttgtgaaaatctacctgcgtgcccctctctctctctctctctctctgaatgcaattagagaagacagcttcattcacactgtgtctaaaaatagatgatggcagagttcacagactgacagctgcattgtcatacagtaaccaggaaaggaaagggatggctaatttaacttaacaacttccaaaacaaacagtgcagagggagtccaggataaagaaaaaacacacaggtcagttcttcaaagagctggcagagggatggggtcgctccatggcagtttattagtcctcccaaaatcctgacgaaaccagctaagtattttgcccagatctacccagagtccttcagacaagagctctggcagatgaaccgctacagagattcaggcaatattaggcagcagggccaggactttccctgctgacttcttcatacatcccctggacacaagtaagctaagaagagtcatgacgtttttctaggcaagataaataaatgagttttttccccctttgccatatctaaattatactctgcctagcctggggcatttaaaaaaaagttatccaggaaataaacatgcatcattaaggggcagaaaccaggtgtctaaaagaagcaaaccatttctttccctcccttcagtcctaaaatgttttctgttttcctcctcagtctgccttgcccagggaagggattacggttgggcttcaaaagaaacaagggaataatgcctgtggacgggtagcagattctctctgcagctctcccgcagctccatgttggctctcagcgctgctgccagccagctaaatgtcagatcacggcaccccaacattccctcactgcatacctccatcgccctggtgactaagctgtttcaacagctgtgttattgctggagtcaggccagtgttattcacacgaagtatttgtttcatacggcttatgtggggaattattgcactcagctttggggttctatttaaagataaggtccttcccttgatcaatcagccaggacattcctcgagttgggctccaggagacagtgggacaatattctactgccacccggggttccagataatggacagattcataatactataaagaaggtggatgaagcatatgtgtgtgtgagagaatgggaagcataatggaaaaccatgacccttggtggagctgcggaagaactctgctgctcctccctcaataaaagccacccacaacacaagagtgttaagctggactccctttctgctcttcttctccagccatcaccctcagcctttcccttaaaatcattgctctttcctttcgggtcacgctagcactgttgcgttggtctctacatgcatcactccacacacctgccccgaatgccatctcctccctcagcccttggcttctcctatctcatcaaatggtttatgaccattgatgttcctatcatgtaggaagcaagttgggcctgttggcctggtgacctcctccactactccacatcctcttctgagtgtgagtaagataagggctgtgttactaactgctgagttaatcaacccaaactcccttatatggagggacaactgggaaaaggaaaaggcattacatccatgagctttatgtcctgtaggtgggactaatttctatttctagctcattctaggctgaatctccatcaaagaggcctactggcctgttctccctccaaagttgttctcaccaagagcaatcgggcaccattttctgatgctgaaaagatctcagaaatatgttttcttataaatgaagtatttttaaaagaaataaaacaatgattcctaagagctcacattttttactgcctactatgtgtagacattttcacccatgcagatgccagccagatggaaaccatcacaggcaatttcaaagtgaggaaactgaggcccatggccatgctaccaatgtgagagggaggcaaaatgagaacccaggtttgcctgactcagcagctcaagtactttccccttatgtctctcagtcatggggtaggaaagttaggacacccgcttcttgctctaaaaaggccactatttagccaaacaatttgagtaagtcactttacataatgtattatttcatgaaatactacagttggatcataggcttactaagatcctttctagttctaatatttcatgaatgtagaaatctaaaacacctccagctgttgactgccttctatacttaaggcactgaggccaaaacaaagagctataaaaccatgcctgtcctcagggcacttataatggagtttgagtgacaaaggataacaagttgagtttgactaatggaagagttaaacaattaacaaatacaaaaataccagagaaccagactacagggcagtgcttgagaaataacaccgcataccagcatgactatacaaggagaaaagtagatttcaacaatggtaacacccctaacccggaaaatacatttgtgctgccagcagaaagaaaagaagagacagaaaacgcttgcaggaaaagccagctactagaagggatcccgtctgtttcacaggaaagctttgtttctgacaagtttcgtaaaggaaaaagtaggctagaacaagcttttttatttccaacccaccttttcttcgttcccatgaatgaggaggggatacaaatgagagcaggcagccagggacaaaaataatatggctggtggttcctgacctcttggattcctgccaacagagaagcctgagaggcaacatttaattgtggaaaaaccagcctggctctcctcttatctttttcctctgtgacttaaacccacaattactggcaacccctagattccgagtcacccagctggtggtggcagcaatggctgtgtctgtagctgaaaagcaaaagggagtcagattttacctgcctccgaagccagccctgggagcacagccctaacccagcttgatgacttctcccattaaaaggttcacagatgccctcccgttgggaaaaccaccaagtgagaagtccagatgggaaaaaaagaaacacgattttcagctgctgtataattcaaaggacaagctacgagtctcaaatcctgaattccacattttatttcagcactagagatgtgatgttcaattccttttcttaagaaacaaactccaaatttcttagctggtcatcaaggcaactcacctaccaggccctctgtctttcagcagctcatcttttttctctaatatggacacttttctacagcccaacaaatgggcttaccgtcctttgcacatatgttatttcagagcatttcatgatagaaaaatatggtcttagtcctcactttctcacctagaaatcactttgaagaagtcacttaacttccataatttcatacttgtttaaatttaaaactttttctccagtaacagcctcacagaggacagtagagatttaaccttgaacatctagcattgagcctgcagaggagatgcataatcaacgtttccttctctatacctaatgcctttgctgagttaccttcatccaaaagaatgttcccattgctaactcttgtcctgatcttttcttaccactcttccactccaagaggttgtctcccatacacctctgctcccatcttaatattcttccatttcaaaatattttaatttacatgctgctatgtttatagtcaaatataattaaatcatgcctgtgggcacattctcctaaggatgctaagaattttccacatcttctattttaggactttatccaattgcttcagtgctgatcagcatgcattttggtactcatggggcataccctcatcgggattcataaacctctgaattccatgggtgagcttcagggcttccattgaaatatgaatactaaatgtgcaaatggggtctatgcatatttgtctcccaaggttaaagtccttgacctgaagttaataaccactgtccggaagtaatgaaaggcctgtggctaacatccatggacggggtcctttttctgaacactcagccctgccacctatgtttctgggcttctatgctctctctggaacacaattcctcctttctattcaagtccgagaataataactactcactcttatttatttatttagagacagaatctcaaccaggcaggagggcagtggcgcaaccttctgggcccaagcagtcctcctacctcagcctcccaagcagctgggactacaggggcacaccaccacatcctgataatttttgtattttttgtagagacagggtttcaccatgttgctcaggctggtctcgaactcctgggatcaagagatctgccctcctgggcctcccaaagtgctgggattacaggtgtgagccactgcgcccagccaactattcacttatattgagcatttactatatgtatccagcacttactatgtaaaagcctcacatacactattctagtttaatccttacaacaaccctataaaggtagtactactattctattttataagtgaggaaaatgaagtacaaggaagtttcaaaaacttccttgccaagggtctcataatttataagcagcaggccaaacattcataatttatgattcagcccaaacactctggcttgaaagtacttaacccagtgctggagttgtctctccaagctctttcactttccagaaaaaaataagactgcccttggactgtttctttgccttcacattgtaagtgatcacagattccaacgcctttaaaactccacctttgactcaatcaaaacatttccttttccgtgagttaatcatttccccttctatgtttatggactcctttgggtacttaatgcactgaacacactggtgtaattttttaattctctctccatgaattagactgtgagctcctaattattttgagtacacatggaatatttactgtgcctggaattgtgctaaggatataacaatgaacaacacagtgtccctgcctttaaataattcactcttaggccaggagtggtggcttacgcctgtaatcccagcactttgggactttgggaagccgaggtgggcagatcacaaggtcaggagtttgagaccagcctgactaacattgtgaaaccccgtctatactaaaaatacaaaattagctgggcatggtggcacacgcctgtaatcccagctactcaggaggctgagacgggagaatcacttgaacccaggagggggaggttgcggtgagccaagatcacgccactgcactccagcctaagcaacagatcgagactacatttcaaaaaaaaaaaaaagaaaagaaaagagaaaactaaacaaaagagggttatgatggtttctgaaattgtattatgaagaataaggacttatctttatttcttaaatcctgagcaaaatgctagcatgtagtacaagtcccaataatgcctatcgaatgaatgaatgaaattgggaaagggttttcagatactgaactgctaaactgaaagatctaccatcccatcatgaaactctttgaggttatttatacactgactcacctaaaaactgcttcctgtgttggtgtctatgatacattttttaatgtcagactaaaaatacacttccagtacaccaaccctgtctgcctacctaaggagtagaaatgaacacaaggtcgcatgtaacaaaagaaaagaaaattcactcatttcaacactaagctcaccctctaacaagagcatctgtcttgactgagcactatcttctagaatggttttcacttgagggtctctgaagtcatctatttacaaaaccaaaggataccaatgagattttttataaagtcagagaatcttaagtgagtcatggactctcaacttcagagagttagagtagatgggaccttaggggtcgtctagtataatttcccactcagaacaggaagcactccatagccctgtcaatagactcatggtgggatcaaggcactggagtcctaacatcatgtacactcatagcctctcgacttcccagctgggagactggcaaatcatgtaaactctgtcatcctcagtgtcctcactctgccagatataattgttccgatgatcagatgaaataaacgttgtcttaattagcgaacatttgtttgcaagtaacaggacttcacccccactaacttaaccagaaatcagctggagggatacaggagtgctttaggaaaatcaagggcagaaaatgctgagaagctggagggtctgaaaccaggaatagaaagctgtcaggaggaaagtcaactcttatagtctattgtaattacactaatagtcttcatctccatttcctctttgcatctggtcttcccactctgccagtcaacaatcacggcttctctgtgcacgtgtagaatgatgactgcccaggtggctctcatggcttttcagtttaagtgctaataaaggtagatctcgaattactgaaacacaatttcttataagagagaatttgattgcttcccctttggccaagggaccactgctagtctgatcagttatggcttggggactgatcatatggccagttgcccattcagtagaggtggtggaacatgctgagggagggggaagttaaggccaagttcaggccaagcaaatgactgacaacaaagacaagcaacagcatctctagtgcgatggtactttgcaaagaaagcactgccccatgccagctatcactgtggccatccttatgatcctcaccaaccatcttctgcttgaccactaccagtaacaggctgctcactactggtagaggcaaccttttcatcagcaaacaacttcagctattagaactcttttccatgtgacagcaacttaagatactaaactgaaatatttgtaatcttctcccaagccttaactttaatgaaggcataatcttgcttgttaggtcaagcctgggcttttctttctagtcaaaatatgaataatgggcaaagcaagatgttgaggaaaagctgagtgttgggagggaaactgaggcagggcttgcataatgtctttgggaatgtgtctagacttgctggttccttacttctagccctcataggctcctaggctcctattcccattatctcaagtagcagaacatgttccatataaatgctaaaccatcacagctgtagatcatgtgcctgctcttttgacctccacattttcaccacctgtttctttgttggattaccaataaatagcatgggctcccagagctcagggccttcacagcctctgtacactagtgatggccccctggtgtcccaactttctctctcaaactgtctttttctcaatcctttgactctgctggactttgtcacccccacaacctggtgttgggtctgatcaccccaacacaagagagatagattcactatgcaattattttagcaaacaacctggaccagaacaaagccagaacctcttcttcctataaagaattactactatctctctactaacaccattactaatgactcactaaagcaaaagaggatctggaactgtttctagcatcagtgtgtagacaataggtagggttggggaaaatggttttttccaatgtagagtccctagcacttttgcaagcagaattctgccttgctctcatttaacttccttttgcttagaaaaatataatccagaaaataatcttaacttcatttttttaagttaaccaagataaagttgtgaattccccataaaagaacctcataatagctatgttatgaccagctggcatttaaatactgaaagacccaaagttagaagaggaggtgaaaacaaaaaaataccttctatacattgggggcaccattaagggatgtgctgcttctggcttctctgctcttcacattagtcaatgatgtcaccaggtttttattttagtaatcaggatatacttgtatggatgcaaagagaatatcctcatttatattctaaactcagagcaggaaatgagacacgtgggtgatctgcagctgtggcactataaacagggccagcctaccacctagtctagattctagactgcacttcattccctgaaatactgattgggagattttaaaaaattgaaaatatatcattttagaaagaccagtgcatcttctgtgcaaggatcttagagtccgctgtttggtagaaggctgactcacctgtatggggtggtgcacgtgttgttaggtaccatctacctatctacaccactgatgtacaacgaggagatcctgccctggctccagccagctgtgccaccgtgggcgagtaccacagagttcaagctttctccagctgctaaattaaaggattagtgctttaacttgggtcaaccacccatttgcaaacctgacaagaaccacaaacactcttacttcaaaaatgcatataagcaaataccactgaaattttatgtagagtatcaaggggttctcttagcccttacactccagtctaaactgcttggttgatgattgttagaccagcagccctctagtattcctttcagcactccaagctaaaataaaacagctgatgtttagtaacaatttctgcaaattattcaacaccatagaagagtgttttgttaagactagagactaatctaacacaatctactcaacaatgttaaattgaccagtaaccaatagatgactagaagaaagtgtatgtaactagatataccaaactatagatactaattttaaaatcttggaaaggttttggaggagccctactgtttctgaattggaatttttcatttgcaaatacttaacaaaacccaccaagccagatagagctctatagcgatgcctatggaggagccttataatgatgttgtccaagtaatgtgcttaacaataatcacactcaaagccaaaggttcccatgctcctgccaatataacatgctcacaacggtcaattccaaaggaagagctgtcaagaagtgcctgaagatttcctcaaagggagagataattcatgagcaaacaaacatcatgtccctaatcttctctatcctggggtaaacaaaatatagttttctcccatgatttcagttgctttctataccaagtcagtaagtaaaactgattcatactggtaacttccaggttccagccttggtttgaaggggcacacaattcaataagagtaaagaagactggccatgtaagcccatcttgaatactgacaacttccgtaccatttacctaacactacaaaccctactccatttaagtctctgagatctttttgatgtattttgagcttttcaacttgccttttttggtgggagaggagggaggaggagaacaaagggagaatttgaagtttttatttctgcttgcattgactcaaattgtggtaaagaaacttaaaaggtaactttaaaattctagtgacactagccaacaatgaaaactatctaattagaatgttagaggttttttttgtttgagacagagttgctctgttgcccaggctggagtgcagtggtgcgatctcggcttgctgcaacctccacctcccaggttcaagtgattctcctgcctcagcctcccaagtagctgggattacaggcacacgccaccatgctgggctaatttttgtatagacagggtttcaccatattggtcaggctggtcttgaactcctgacctcaggtgatccacccacctcagcctcccaatgtgctgggattacaggtgtgaaccactgtgcccagccaaaatgttagatagttttaacacaggctataacatagtcataaattaaagaagacatggtcgtaaatgaaagaagacctctttttggtgggagtagtagtaggggtgggagagtagagttatacatttcttcttagcagttgcttcaacatattttattaataaggactatctgctgaagcacagaaatacaattatgtgaatatcatactaccaatggcctgttccatcatagcagggatagttcttatagtgtataaaatcctctgccccattcagctctctttatggagctttcctcagaagcatcagaaaacacagaattaaatatcacaattcttgttgaaggccaaaaattagttcccagaaggattctttgactttcatccttctacaaattcacccatcaccattgtagataatgtgaggggtgaatttgtagaaggatgaaattcagagaattgtttatgatcaatagattgttccctttattccagttgtcttcccttgatgtccacttaacattccataataaatggacaaatggaaaagcacaattactctgccaaaagtcagtcaacattctcccaggacactcagccatctaacttgaaaactgactggtaataatatcattctaattactttaactagaaatttgttatacagaaatgctttcagtgtggggaaagaaaaatcacttgccacttatagaaagaattctgcttcatgtgaccatttgcaataatgaaacaagtaagacaacactgggttccagtgtacagcacaaggatcaaggcgaaacataatgctttcattacgtaagaataggactgacattattctggctttcccctacccttcatcatttaccaatattttttcagtctcaggaatttttcaacccctgaaactcctagatttactactcaagacacagctatccatcttgaggctttctgccaatggctctagtgcttctatttcaacagcttatagatttgaaagctggaaagagagatatgtaaacaaattctctaactttgatctatgcacccaggtttctcaaaagaagcccttggagagtctggggtatactaagtgtatgacttgcagttgtaatcattagagtgacaacccatttccagtgggtaccgttttagccaacccaaacctttcttttcctaatgcatagagtgactttttaaaaaatggtatatttgggaaagtattttagaatggcatgttaacaaaacaaaaacactctagaatatattttcaaataacagaacttggccttaccaagaggtctaataccatcaggtaaataatcatttttatcagtgattcataatacatccagactctaaatgttaaggctgacttttttctgacactcttctctgcctattcatactccatttcctaactcctttagagtaaaaattgaaatcccatatccctaacaactagacagaagcatcatgtttacatcctgacaaattcattaattctgtacctctgaaatatttagcaaaaagccagcactgactcaatcatagatttccacagacaggtctgttcatatttgtaattggtattcactgaaaggtcaatgactcctgttcccaagtatctatgagtctctagattttcttaattggcctcttttcctcagctcttacagactattgttttaaaactaccaccatttagaagttgaactccgagtgaggggaaaaacaaacaaacaagcaaacaaaaaaaacactttttgattcccactccactcataatcaacataacacagactacttctgacccaggtgtgatggaaggagcggggcacagagtcgggggaggtttctccacacaccaagcaagcaatcaatcacttccacagcagacatcagctgggtgtccaaaaattcaattttgacaccacttacctggaaatagcatcaagtctcataggttgaaagctcagtcccataagactgctccccacttcagatgcccatcgaaaaaacaggttgtggcctgttataaatacgcgttcccatgaccctcctccttaggattgattgatttgctacagaggctcacagaactcagggaaacacttaacttatgcacgttataaaggatatgacaaaggatacacatgaacaaccagataaaagattgatagggtaaggcatgtggtatggcagggatccctgaccctctggcagcagacaggtaccagtcagtggcctgttaggaactgagccatatagtagggggtaagaggtgggtgagcaagtattatagcctgagttctgcctcctgtcagatcagctggcattatattctcataggagtgggaaccctattgtgaagtattcatgcaagggatctaggctgcatgctccttatgagaatctaatgcctgatgatctgaagcggaaccatttcatacccaaaccatcccccatcccctcatctgtggaaaaagtgtcttccatgaaaccggtccctggtgcccaaaaagttgaggatggctatgataaggcacagagcatccctgtcctctctagggtgccatgctccgggaacctctgcaagttcagctgtctggaagctcccagaacccagtccttttgagtttttatggaggcttcattacctaggcatgactgattacattattggccataagcgagtgactcaatctttaggcctcttccctcctggctgttggtgggtggggctgaaattagttccccacccttctaatcatgccttggtctttcaggtgaccattctgaagctatctgggagtccccagccatcagttgactcattagcatgcaaagaggcattcctatcactcaggagattccaagaattttagaagctgtgtatcaggaaatttattactataaagtaccttataatgccatcatttttctcccaaaggcactggcttgattaaattcagaaattaaaacaatggccagcttctatagtgtaagtcaatgcttttctagttttctgagggtttggaaactcaaatcctagctaaaacctgtatcacttttaaattgaaaaatttaaagggaataaacatttaaccccaagtgactagaagtcatttaaaatatgtagtacttagattattttatctactcaaagactcttcaaaagtagatgaaaacactaaccagatatatattataaacccaagctttaatttcagagcccaaacatgaaatctcttctcattgtttgaaatctgaaactcatttcaaagactgccacgaaaagttaaaaaaaaaaaaatggattggtcttgacttttccttacatatgaagtaatattgttacaggtgaatctctgataagcaggaagccatcatgtgtaataggatcttgtttgccacactcccaaactcttctctgaagtcctgttcattgctgtcagaaaggaatccaaagtaatgataaacaatataaaaagtagagagtctcatgcattcttaataccaaaatcagagagaaatctagacctgatgtgcctgttatactaaaacatgtgtgtatatgtatattgctgaatatatataacataatatatataatctgtataatcaatgccttgctcagtgtccataagcaaaggtagagaggataaatttaaggaaatgaatattcccacaaacacaacatgtaacttctcatataatagttagcagctggccaggcatggtagctcacgcctgtaatccccgcattttgggaggccgaggcgggcggatcacaaggtcaggagatcgagaccatcctggctaacacggtgaaacctcatctctactaaaaatacaaaaaaattagccgggcgtggtggcaggcgcctgtagtcccagctgctaggggaggctgaggcaggagaatggcatgaacccgggatcgtgccactgcactccagcctgggggacagagcaagactccatctccaaaaaaaaaaaaaaaaaaaaaattagcagccaaaatgtgttgctgctactcatgaaaagtattttttggtgtggttttcttgatagctctattaagaaagttattttatacatttatcaaatgaataattagtggtccatcttgttaactttttagtatgccccctattaagtgctagttctcatgttataagaaaattaaggattatttttaagtcagaaagcttgagtacagtatttttgtagatgaagataaaatattttaaagcatgaagatgtacatgagaaaaaaataagacattaatatttatatatagaaatgttttaaagctttgccaacatgggcatttttgttgtttaggattagtatttgctgggaagtaattcatctgtgaaattatttaacatgtagaattatttcttagtttctggtttgggagaaatgctcaagagttgagcttaaaatcattttattcacactgctaaagctgaaaaatgtaaacagggagctttcaatacatttcaaatgagtttggagaattctaaaatattcaatccatttataatgaatacaaaacatcattagaaactggcaaaaaaaaaagtagctaaaagtattcgagttatttcacattactgggaaagtttcttttaaaaagttcagttataaataacattcactaaacatatttatccttttttcaattttggtggtataattttagaaatttatcgttgacttttaaaatttcacctaaacttacctgaggctctgcattatgttactcaatgattctgatgccaagttttgaaatcaaattataggccagtcaccttcagtgatgtaaaaggtagaaccacaagataatccagcactttcctcacaacctgaaaacggaacctgtggcaagtacctgcccaagtgtcagactatgctctaaacaactgcctgtcatgtaacaggctgctcgaaagcagcaacatactactcctatagtcaattcttaacttcttaaccacaatttcatcagtgtaaaaaatataggagcagtggggaccagacttacatatactgaaatgttaaacaacagaactcttattttgaagtgtgggaggggaggaagcacctcaatcagttgctttatgttccttttagtggcagaagaatgatacaatccagtattttcatccacagctccctaaacacaaagctgtggatttcataaatgtaaatatactgcgtaatctgcccactgggagttcatagtttagtaaggactcagagaagacaatttcactgtgcagaacacaaggctgataaagtaaacatcacaaggccagtaatgaagaatgcgtaaggaaagacagattatatccaggaaggaatgaggacgggagataatatagaaaatacctaggaaggctccaggggaatgtaaaatttgggatgttgtgaagaatgagtaggtttatctgggaggagcccttcatttgtgagaagaggaatcacaagagaggaagaggcaggcaggatcaatatcagcgaagacgcaaagggagaaactctctggatgtgtttacagggcaggaaactactccttttgaggatgcagagaatggttactggccagcagtgaggaaggaggctagaaagaagccttgagccaggaagcgagaggactctgaacaccgagtcttatttgttagtcactgaagatgttttgagcaaggaaatgataaattaaagctaaaagagtctcctccttatcagaggtttcaccttcagtggtttcagttagcagaggtcaatcacagtgtaaaaatattagatgaaaaattccagaaataattcttaagttataaattgtgcactgttctgagtagcatcatgaaatcttgtgctgtcccctgataagaatcacccctctgtccagcatctccctgctcctgcctgttagtcacttagcagccatctaggttactagatcaactgctatgtattacagtacttgtgtgcaagtcatccttattttctctcattgccccaaggtgcaagagtagggatgctggcatttcagatgtgctaaagagataagtcaagtgcttcctttaagaagatgaaagttctcaacttaaaagaaaaaaaaatcttatgctgaggttgctaagatctacaataagaatgaatcttctgtccttaaaattgtgaacagtatattttttctttcattattaattattgttgttatcttttactgcacctaatttataatttaaactttattctaagtatgtatatatgtataggaagacacatcatgtatgtatatagggttcagtaccgtgattttaggcactgggtggtcttagaacatatcccctgtggataaggaagacttacctctaccacgtgcttcttttataaagactaatctcactaaccaaggtgtagaagtaagaattggaaaaatggctgaatttcagcaataaggataaatataattggataattgtaatagctacttttaatttttaactgttttaatagtacttactatgtccaggctgggtgcagtggctcacacctgtaatcccagcactttgggaggccgaggtgggtggatcacctaaggtcaggagttcgagaccagtctggccaacatggcgaaaccccgtctctactaaaaatacaaaaatttagtcccagctactcaggaggctgaggcaggagaatctcttgaacccaggaggcagagattgccgtgaaccaagatcatgccaccgtactccagcctgggtgacagagcgagactccgtctcaaaaaaaataaataaaaaataagtacttactatgtcctaaaagttttacataaactaatttattccttagagtgagttggttaattaggcattattatccatattttacaagggaggaaactggctaagagcggttctgtaacttccccaatactgcagagcttttaaaaagtggcacaaggatttaaacccattgctgtaggactcctaagtccatgctcttaaaaaactttctatcttaccccctaatctagatataaatcagggatcacatttcaaatgaaactgtgactccattgaaaagtatgccagcaggtagtcagcctctaagatggtccttaatgatccccatctcctggcattcatgctcttctgtaatcacctcccttgagtgtgggttgaacttactagttcacttctaaccaacagaatacagcagaagtgatggaatgtcgtttgcaagattcagcggtttccctctccagcactgctcaggctctctcttggctcactatccctgggggaagcccgctgccatgttgcgaggcagtcttatggagagacccatgtgggagggatggaagcctgccaacaaccatgtgagagagcttggaagcagatcccccttccccggtggagccctcatgcctgatgagactgcagaccaggccaacagcttaattgcaaccttgagagagtttgagccagagactcccaaactagattcttgacccacagaaatgaggagctaagaaatgtttataggtggccaggcacggtggctcacgcctgtaatcccagcactttgggaggccgaagtgagtggatcacctgaggtcgggagttctagaccatcctggccaacatggagaaaccccgtctctactaaaaatacaaaaattagccaggcgtggtggcacatgcctataatcccagctactcgggaggctgaggcaggagaatctcttgatcacgggaggtggaggttgtggtgagccaagatcgtaccattgcactccagcctgggcaacaagggtgaaactcagactcaaaaaaaaaaaaaaaaaatgtttatagttgaaagctcctaacttttagggtaatttgttacccagcattattaatacagtcagtagacagtaattatttattattacagggtaaatctttttctttatacttggagctagaagtagggatctgtctaggagagattatacctgaaataaccacaaccagcccaaataacagaataccacgtcctttacctttccacccaaacatacataaatcaggtaatctacctatctcatcctcccatggctcttcttgttgtccttattctcctttgcttgaatgcattcttaggaatagaaatgctaaaacccaaacctgcaggtttcaaaaaaaaatttttagacatacagttttgaatctcatagcaaactctttccttcccaaggctcctcacattacattgtgtattcttattatagcacataacatgttttttcttatttgtaggtttaagtgtctgttttccaggcaccctcttccctaacccgttacaagaatcatgtctcgtgtgatcttatatccccagtactgagtgttcgtatggctgggacttaataaagtttaaatgaactcatgaataaatgtgttgcacaaccaatgagtgagtgagtgaacaagtgagtcaataagcaagagtttagggacatgggaaccaccacttaaaagcttgaggctgttgtgcaaatttggaccttcatataagccatttccttctatatagaatgctctttcttttgctcatcctcacctcctcaccaggcttttctctctttaacattcacctcaaagagctgtctgattgcctctctacaactctccccgccaacacacacccacacaccctaccagggaagtcttccttttctctgctgtgaagccttttctttaagtttccatatcctcctgggcataacttggtcacagcacccagcataccacactgtaatgattagttatttgcctgtcatttccacttagccgtaagttccttaaaggacagcatattcagctaacagcagaatgcctagcagtggtaggcactcaaaaacagtttaaaataatgggcaagagaatgaatgaatgagaaaaagaaaactgtatctagaaaattatctcagcacaatctatttatttcaggtaagctatcagtcaggtatacatagtgctccaactcctaaacagagtaaaaataattgtacatcaagattattacagatacatgaaaatcatatttagaaatagtacttcagatcaggcatggtggctcacagctgtaaaccaaaaatttggggaggctaaagtgggaagattgcttgagctcaggagagacccccataaaattttaaaatttaaggccaggtgcagtggctcatgccagctactcaagaggctgaggtgggaagatcgcttgagcctgggaggttgaggctgcagtgagctgtgatgacaccactgcactccagcccaggcaaaagagaaagaacctgtcacacacacaaaaaaaaaagaataaaaaattacaaaattagcgtgcctgtagtcctagctattcatgaggctgaggtgggaggatagcttgaacccaggagttcgaggatgcagtgagctatgattatgctactgaactccagcctgggccagcattcgagatcagcctggggaacataggagactctgtctcttaaaaaaaaaaaaaaaaaaacagaagaagaaagaaatagttttcaggccaggcacagtggctcacacctgtaatcccagcactttgggaggccaaggtgggtggatcacctgagatcaggagttcaagagcagcctggccaacatggtaaaaccccatctccactaaaaatacaaaaaaaaaaaaaaaaaattttgctgggcgtggtggtgggtgcctgtaatcccagctacgtgggaggctgaggcaggagaatcacttgaacgcgggaggcggagattgcagtaagccgagattgagccactgcactccagcctgggcaacaagagcgaaactctgtttcaaaaaaaaaagaaaagaaaagaaaagaaaaagaaataatgtttcaatctatggacaggccctagacagagctgcctttaacacatctttttccctttccctcacatccttgatcccatctcagtcaaaaaggaaaaaacaaaaagttttcttacttctcagcctaagattcctgatactgtccccagatgccatacatgtattggcctcccagaaatcacccagtgattttctccccatgaaaagtttatatgtctcatgccctcagagtttttaactgcaaataagctaaaaaaaaaaaaaaaaaaaaaaaaaaaaaaaaaaaaaaaaaaaacgaaaaaaaaacctggtttggtggggaaatgggtgctcatgggttggcatttccattttggtaggcatctttttctaaggccatagctttactcaaagcccagtggaaaaagacatttaaaaaaaaataaaaacctttcaggaaccctcaagtcactccattggggtgaactcccctgtgacactagagaggtggtgaagcttggtggttagggcagttttctgagtcagaaatctcagcttttccactctctagtcttcagatcatgagtaacctcactggtgcccaagtgttccatctgtaaaatgaaataataagactacctcaaggaacctggtgggaagattaaatgggttaatacaggtaaagtacacagaaagtgcctgggaagtagtcaataattgtttgctattactattaccatttttacttttattagaattggctcaaaaagaacccaaagagggcaatgctcaaagggaagaaagggatgagaggagagtacacttaactgatttggttgtttagcttgaaggcaatgtccagctgcaggataaacagcatgaattggaaccaaggactcatctccatgtgggggaggggaatgtgaacagaaaacacgatgtcattggcttcaatttcccttggaattgcctcttcaatgtctcggatcttgtcacaatgattgggtccccaaggcacgaaccattttgtcttgtgatggttcttacgggcatccacacatttcaccgacatgtaggacactgccgttgtgggccctggagctgaaaagagaaagtttgtctgttttagaaaagccatctattgaaactactgtttctggttaatattctttccactgctgtgttccctccagcttttgtatcgccttctacaagtggggctcagcaatacttagggatcttccaaatctgggtgaggatctttcactgacctccagaggtgtcataacagtatctctgagaaccttcccattatgttttcaattgctgtgaaagaatacatttgtaaccagtctagttatacttccccacttcaaaacaatgtcacaaaaaatcaactgtgctacagttcccacctgattgaggtcttggagagctctggtgcttcatagagaacagtatctaaagtcagaagaccttagtcttcaaacctggattcgaagcctggttaaaaacctactgtcagtgaatcttgggtaagtcagttaaatctgtaatagcttcaggaccctcatctgagaaacggaagagtttctaagattccttttggctctaaaattgtacaacattgcttttgcttaagataaagaactaggggacaccagttagcttggtacctagcagagaatgggaactcaaacactgactgatacttcaaaagtgtactaaaatataaacgatgcacttcaagacagcaaagcaactttgaaatgtgtaactttaaaaacactattttgtgattatataatggttatatgattataatattaataacttggaaaatacagaaattttaagttcaaaacaacatttacccaaaatcccactagagggaagtaaccactgttggaaaatgtcaaaatgccatctgtcttttctatgactgtgtaattagataaaaagtttacacatgaattaaattgtgtaactttaaaatatacgcaaatattaacacatatttataaaatagttatatcatgcatagttttgtagtcttttctttttattcacttagaaaagcagagtattgtgtgataacaccagctctggaggcgacctgtctggtgtcaaatcctggctctctcatttttagttgtgtcaccacaaatccacactaggaaagttttgggcaaattactaagcctatctctgtatcggttttatcatctcttagatggcaataataatagtactgatctttccaagtcactgcatattttaaacaagttaacatatgaaagcactcagagtagtgcttgggcacacacaaagtataaaatattagccattatatcatattttctttataattaaaatctttcagttagtagttgcaaaatagtcaatcacacaatacaccaaaatcaacttctccttcatcagtttgtaaaggctatctataagaataatcctttgcctaatatgttttgttggaaatttctcctaaactttccatctgctatctaaatttgtttatgcacatttaaatagagaagttccagatcttatatggaatccctcttttatgtttttccccccatgcttttgtgtttagagaaactgaccttcttcatctcaaaattcaatagtcatctatattgacttctatttattttttgcaatttcattttttctaatatttaaacagttgatccatctgaaaattgctataagagatgcagtgaggttctagttttatttcttaaatatttaaattatagttgattgaacagaccctcccttttgttgatttatcatatcactgttaatctttatgtatgtaagcatgtttctgaacatctgttcttttccatgcattaaactgtcaattcacgggtcagcacaacattgctttgaattttataaatttattatttttatcaatatctgctagagtaactctcttccccaatccatttcaaatttacatctttttgctaggatattgaagattaaattaaatttataaataataaatatataataataaattaatgtggacagaattagcatccttccccagcgtttagttttcccatccaagaacagtacttgtttctccattgtctacaatctgtttttaaatttcttggaaaactttcattgttttctttatgtgggtcctactagtatattttaaaatagatacatctataaacctttgaaagttagtagttaaaagaaagtgtcatcaattatggtttatgtgtgtggtttaaatatgtgtatttctgtgcatctgatacttggtatattatgtttgcagaaattctctcttatttaatagagatcagatagcaatggagaaacatgaaaagcaaaaagaaagttatataacgggaaaaatgtgtattattaatattctgccctacttctaatgttcgaatccacattatttttctattctattaaacatctattttaatgatacatttttagtaaaatgttatgtttgtaagaagttaggacaatgcctattaatacttaccagaaaactcaacactactaagctctagctgaacatccttcatgtagaaggctgaacactgcaatacaagttgccactaacccctgctacagacgtttttctttaaaactcaaaactgtatcacgaagacctcacatctaatccatctaaaatcagacatctgacttattcttagaaatatgagtcaatcaaactttggttatcctgactcagctaaatagcccactgacattagaaaagccaaatggcacatttaactgaaccctttttaatgtggttggagaaataaacagtgagacaaaagtcatgaattctattttcggctaacatactcaaactgactatttgctgcagaaaatagttactacattttaaaacttctattcttccaaaatgaacctaacctttttttctttattttttaccttcttgaaaaacaagtctctcacttctcaggccaaaacgaaaaataactagctgagttcctcagctaagctccaaaaccacattccaaacttaataacagagaagctgaacactttatggtcacaaagtccgcatttttaatgaatgcagtgaacgcctgcctttttaggggcctgcattattttcatcctctcattagtctagtgtttcttctataaagaaaaaaaatcccagaaatactaatattttcataaatatcatggcagtgaacttggagaagcctcaagtgcatctcaagctatactgtgagaatcacaatttttttcacttgaataaattagtccttgagtctcaaaaatgctttccataacttcaaaacctgaagataattcaacattttccgtttttctaatagtgttcaaaagagaaaacacaagtattgcttgagaaagtaaacagacatcctgatattcaaacatggacagttaatgttcccccaataatatatttacagctcagtgcaatgtcctactccagctaaaagtgaattcccaagtgtttctttatatagacagcattatcacgtaaaccaaaagcaaagcttacagctggtagctggtcacctaccatagaatgtgttttcattagctatagtcaaaattttagctacatgggtcacaaattgtgtctagaatcaaaaaaagtttgatctgtctgtaaatttttttaaagtgtgtgggattaagagaaaagagctaaatggaggaagtttaaatcatcttcaacctttgaacaagccacaataacaggtatttgtaatgaaggccttacttagtcacttgcgtggttctagggattaatagagtttgtgtattcaagagggggctggatagattcaggtcaacaaactgagtcatgtttgctcaggtgaaagctaaaaataaccactccccagtattcctaggagagtaatgcaatattacccagctgcctcagcacacattataaatgtctcctccacccacccatagtataaggtttaactgaaaacaagtaggccaaaaactacttctacaccagaccaattcaatgacagaataatttggccaaaactaaatatgcctagtcactgtaaactggttaactcatggttggttaagatagccttgggaatatgcacagaagttataaaaccatgagctattcattgaaaatgcagtccattatgaattcagttctttttactttatcaaacatgaccattttattttgtctgtatttcaatacagtatttttggcctccacttttccactacagcacatgaattgtgaaatgtgattctatataacatttaatgttaaagtgatatgaaatcaataagacttctaacaaattcaaggtgtgaagaaatgtacaaacacaacctgaagtctctatgaaaattcagtggtccctcagttacacacattactatggctcacagtatattgtccaaatttgtcttgagtatctaccatgcactagacactgccggttctggagtaaacctgataggcaccaaccatatggaacgtacaaataacggaggaagcagacaataaataaacaatttcaggaaaaaataattttgatgaatgttatatgtaacctgacattccctgagaaagggcaacagtcagatatttgggaggtgggagaaatgaatacaccagaatgacagaaaaatccagtcatcgttacaacataaccttgaataaaaatgtaagtgaacaatgactaaacctgtagtacttcttttggaagaatattcattgactccagtcagcttcctgttatttcacttcaaatggctatccagtttacaaattactatctagccaaccgctagcatttatcatgcttaaaattgagtcaacattaaatcattagcccctattccttccagaacctgtaatttaagagttagagagagacaagacttggttgcctcttagaaaagttaaaataaaactaaaacaacaggctgacatgacacattgtctccatttaagccaacatagactatttatttctttgctttattatgagtaatgaacatttctttagcaatcacctaggagcattactattatgcaggtaccgtactaactaaagacagagacgaatggcctcccagacccccatttgctcacaggctagtgtgggaggctgagaagttcacaaagaattacaccctgattggaaatttctttgacagaggtttgcacaggatgctccagttgtaaaaagagctgagggtagctttcggcagggcttagccttggaagagagcaggtaatagccaagggagaatgggggatggccaaggagggaaggtgctgaggtagagatagaacatgtgctgggtcatagaatatctaaaacaatcatattttctgcagatatctgtgcttgaatattaaaaattaaaaagagatcatttaacggtgaaaactgtagtactactcttatctctgtgtccacccttgccttttctaatcagtggtataattctactagagtgccttggcctctgctcccaatcatccctgctgtactctatagagcaccataaagaaggaataataaacagagccacacataacaaagaacttttatttggcaggaatgtttccttttatgacacctatctctgccctgtaagtagccacaaggccagaccagagatctgctggaaggaggcggagtgagagggtagtcaggtgggaatgaagaagctccccgtcctattcccacaaatggccccaaagagcctttgaagtctcagtcatcaggtaataatagccttcctctaaattagaggaagaatgtctgccttgcaacaaagatgatatttaaagaataatctgctttggggtacaaggggaaggaatgcagagaatagaccagttgaaaaggtaattcctgtttataagaattaataatcagaacagcaccattttaaaaagtaatgacttaaagtaaaaatggtcaaagatttcagaaatgttttagagaattttatgtttacaatagaatttatctaacaaaaatgataggaacaatacacattgatttaaaaacatacaaaaagttggtagcagatactttctcctactgacttgagacattgatttaacacctgaaaactaatctcagttaaaaagctgccagcaccatctctccacctgtaaaaatgtgaatatttatttatattttataatttcattttatttattctctatcttgttccataaaacattttggggtactagaactggttattagcctttattttttaaaaataattgggactgatttcaacggatagaattaatgttggggcgggggtgggcagagactacaaattacttggtctatgtctatatcttcaaaagtttggggagcttatattctccagctattgctttttttttttttttccagctattgcttttgaaacaacagctgggaaatataagctcctcaaacttttgaagcaatagctgaagaatgaatataagctcccaaaacttttacctgatctatgaagttgaatggctcaatatccattttactttgaaatgtagagaaaacctccattgcactatgaatggtatttataagaactaaaaggcatatgcccaagttggttctaagctctgcctatctaaatatctctgcttgccttatgagaacttatataaaacatattgagcacttaaacccttgggcaattgcagagtgtgctttggattttttgagtatcaaggtggggagggtcgaaaagagggagaaagggaacacaggtgtcagaaaagactagatgaattcctgttatgtaactactttttcaaatgcccccaaagtacttatttaacctaagaaaatctttagctaagtttagaaattagctttaaatatgctcaattgattttccttagacattccacatgcctttcgccagctcaaaagccttaattctggttaaaaggaaacatgtgaaatatactgcacaacttcagtggccagatcatattaactggctgagctgtgaggtcttatgagccaaacctgcttaccattcactgaaagtcagttcctaaaaagatttcttaatatctgccataccacttatctaagttttgggtggctaattagaatgagctcttcaaaaagttcagctaaagaaagtgcaaatatttgcattaaattgacttagtacttaaatgattcagtgtgttaattcttttactgaaattgctctgaagttatagtagacacttatgctttctccaccacctactttgaagagaagattctcctatatttcaaccatacccattaaatcttactagcttactaaatgaagtattatttcacaattcaatctcaattactggagagctgaaagtgtgtctacagagactagaccagaagtgatttttacaattatcaaagctatgcccttgtgcatgaaatggggtacgctaagtgaaatgaaattcattcttgccagccactttcagtcagttagttatgctaacatctgttctaggaaagctaattttttttaatacagcagaacattcctttacactgaaccactaccaccaaaacacaaacatacatactacatagcagagttgaatgcaaaataatttgtaccgtacacacaaaagtcaagcacttatttaaaaatagttctttacaatataaacttatgaaattatggacattttgacagcaattttccaaaaattgtagcaaacacttgtaaatacattccgactcaaaaatattgaaaatatcatatgtttacattttaggcagatgaggattttaaatgcttcgcctacaacctcaattgttgtggagccaaagatgcaacagctttgaagaatagaagaattactctatatttgtcaggatctacgtggcaaacaagcgccacttggcttacattacttgcctggcttggatcccatggaatggaggagcattggaaccaagaggaaaaaaattaaagtgctttgggacagcgagccaaactcttacatagtatttgaaatggtgtggcaaacatgaaattattttaggctcaagattggtgctagttttttaccctctttttgaaaaaatagtaaaatgcacataaagggccctgccagaggtttagctcataaaatctgccaatcattggatgtgctaattggtgtagcaatccagtggtggcctggattaggactcaaaaactgacccttaccacccttggtgtcctgcagcaaagacagcctaaatcgaaaagactgatggaagtatatcaaattacgaatttctctatccctgaaaaatgcctgcaatttctgtttctccatcactccagaaatactcaaaacagcaaaaattaaatacatatgaagtgaacacaaaagacctccacagaaaaatcagtggctcatctgttgacgctattgctcattgctcggctggccagtcatctgggctaagttttgactttgggccagtgcttcaaaatcagcaacctttcagccaaaagactgtggaatgcagccaagaccacctgtggaaagtgaattatagcatctttaatttactaccttgggctatgatgtcagaaacccagcatggagggcgcaccagttcttgtgtgggaaatctctcagagcccccatggaggcccccaaagtggctctggcaaagctgtaggggtggaggtaacaaaaaaggggacacctggctctccttcttaaatcagctcaccatgggcacacatttatattggaattttagggtcagaaaataccaaaattaaatcttctagaag

SEQ ID NO: 2463 - DNA, 107190 bp, Homo sapiens
gtatgagttttagcaggaggggatatgcatgtacacatatgcatatacatacaggtttatttaaatgattggatctacacttttggaggctatttgaagtatcttatcaaaataaaacgcattttaagcaagaagttaaaaaagcttttcagacccgaaggccatttaatacagtaaatcttacttgggtagtttagcaaacattttttaaaacccacatccaacagattggttagtattagatacacagatttggtttcaaagctgaaatacccctggtggaataaatcttctcatgaaattcagttatattatgccacaaaacagggacacttatctattgacaacttaaatattaactcagtgggctacctggtgatataaataggaaaaaaacagtggtcatggattaggagtgagaagactatgacaccagcctaccttggactgggaccgcaaaggatgttaaaatctatcctagaatttaaaacaggaaaaatgtcaaatattccactccccattcggcccaaaccatcccccaaggaatacacccccaccccacccccacatgaggtttactaaccagctgctacagatgttactatgtcactaattaacaatgatcacagaaaatgtgtcataccagagtttttgttatcatacacaatgcattagtggctgcaggaatcttcctccaaaagctaccgtcagaaggcaaactgacaaatgtccatgccgctggtccaagaaaccacagctaagagccatgaggcattcatttgtacattgagctctctctggcatgctccccactctagttagaggggctggggtatggagagaccgtcccagccgggcgctgcagcctcctactcctgggcctccttgcgggtcaacttgtagatctcagtgggtccgtccacatgggtgatagtggtggtgagctggagttcttccccactatggacacccagatcgcctgaaacagggttttcggtgttagatgcattcaaggaggaaggagaagcaagctggggttcatctcatggacaactgccctgatgctagccctctttgacattctgagcacacagagacacctagggcacacaacattcagaacaaggactaactccaaacctgttcacttggactttgcagaactttttaaaataccatttttggctcctagatgacagtcattaagatacgtgagtcagctcactgctgatattattcatagtaatcattaacatttaatgagcatttactttgtgcctgacgctattctaatcactttgtaagtgatcttctttaatcctcgcagaagccctctgaagtaggcagtatgaacgtgccagccttacagatgaggaagctgggaggtaggcaaggtaattgtcctgggtggaggagcaggcccacaagagagctggcaaaggaacatctgatgccaagaccaatgtgatgggctaaaccagcataacacccctcccaacggatgggtcagtcaggcaccaacacatttgctatgaataatttacaaaataggagccaggtgcagtggctcaggcctgcaatctcagctactcgagaagcaggggtaggaggactgcttgtggccaggagtttaagatcagccttggcaacagagcgagaccctgactctaaaaaaaaaatttgttttaattacctgcgtgcagtaactcacacttgtaacctcagctactcaggaggctgaggcaggaggatcactggagcacaggaattctaggctgcagtgagctatgattgcaccactcactccagcctgggtgacagagtaagactttgactctaaaaaaataaaaaaataaactacaaagcatctatgtcacgtgaaagcaaataagacctgcttatatctatccatagattggggaaggagccatgtctaacacatctaggaacaatgaggggctttattctccaggaaaaaagaagtgccagaaacgtgctgtgcatttccttctgccctcaggattgtcctaagtgttctgaactcattatcagtggacagtgttctgctaaaatggaataatttgaacttttctaaattagtaggagaaaaaaattttctctaagttaaacctcgaaaactctgctacctgccataagacaagtgaatgtataaacaacaaagggaaaatggaaaacgcaaccacgctcagtctgactgtgtgtgggggtgcacgtgtgcacacatgtttgtggagaggggtgctggggaatagaaagttaaacttgtgtcagtgatttttatattgtgcacatatcatatgataagttttctggaactgaagtttttctaatttaaagcatagaattaagtaactaaatgctgttttccattgaaatgccataccataacttagaagcagccttggccctacccttaggactagtaatcttatcactaatttaagaactgctaggcatcaatgaatctggtggccttagaaccccagatgtcactcccacccactggcccagcaggctgcttggctggttcccttcacgtgtgccacgcagtattagtttctcatcgtagacccatttctctgtggctgcacagcaaaatcagtcctattattaaatgccaccctgtaagctctctacccaggagattccctggcctcagaagcagactcattggctgctgcagaggactgctgaagacatttggggctgttttggcaagggtctaatccacaggactatgggtagagaaggcattaaaggggcatcagtccagcctccagcacatccacattcatctgccctcaagccagagcatagatgccaagtaaggctggtgagaggctttagctgggctactttgggccaagctgaaccaccacttgtacagtgagcaactactcccaggccaataacttgtattctcactgctgcaacatctagtccacacctcagtcaagcacaagcagtctaagcttcacatttctcagtcaaagctatttctggatttgcatatctgggctagccatcagaacttcaaagccagtttcatgatctgcatgtctgtgtgagtcatcaaaatttcaaagagtcctgaccaccccagtggacccattagcactcataaccgtttacctaaggaatccctttccctgaggacttcttagaaatagatgctagagagtaattctactcaggctttgaaccaaagatgttaattctttaaacttaaaatatgactccaattagcagatcttagaatatgcatatgatcctacagatcacttgaaaaaacagccaaaattgccttggcttctttatttaaatggatacctatgtcataatgcttaacacgtgcctgacacagttctaaatactgtacaaatattaatgcacttaattctcatagcagtcctcagaggcactattatcatcactcccattctgccgatgaagaaactgaggcacagagaggctaagtaacttgcccaaggcccaagctgctaaatagtgtgtgggattcaaataaataggtgccaggatgcaggctctcaacttttgggttctgctgcctcttcttaaatattcaagtttccagcagccagtgagactgccagtgaggtatgaagtccacacacacagcattacagctaaaaatatccgcatacagccgggtgcggtggctcacatctgtaatcccggcactttgggaggctgacggcggcggatcacttgaggtcaggagtttgaaccagcctggtcaacatggcaaaaccctgtctctactaaaattaaaaaaattaaccgggtgtggtggcgcatgcctgtaagtcccagctactcagtaggctcaggcagaagaatggtttgaacccggaaggcggaggttgcattaagtcaagatcgtgcccttgcactccagcctgggtgagagagtgtctcaaaaactaaacaaaacaaaaaactacacataaaataatttgaataaattgtttagcatatttactttgcttttgtatctgataaatttatagcatataaatcagtgcactgacaggagagctgttataaatttatgagtattggccatatgcactgttaggggtttagcatgccctgtatttccttgtacgatgtgaagctactgtggcataattaatttctctactgtgctggatgaggacccagataatgggactccatgcaccaaaatctatgtttcacatgtgattttattgtaccttgaaggccaactgttcccccttggggaatgggtgtgtgaacgtggcagtaacatagcacgagtggagatccctccacttgcctcctaattccatcacctcctacttctgccaaggtcttgctccatctgttagtttccccctctcttggctcctgctgttcagtgcacaaacatgctcaaaagtctcttcccatctcagacaagaaaaaacccttctgaaaatgtgatatgtgtcttggggtgaaaaagagtgagaaagaaaaaagaaaagaatgctttagtttgcagtaaatttctctccctggttatgatgtcaaattcatcacagctcattaacaattagatgacggtctatttcttcctaaccttgtgaaatgagaccaatctctggcacagatttcatcccaaaggactacggcaatgcatccatatgtgtggagtcacatccacaggtgtgtaagcggctgcttggttgtaactgcctggaatgcctaatgaggatgaagaaagccatatgcactggagacagcttcttaggaccggcagcattttaatgacaattgtttgtgtatctgtgcccacttcaataaaaatgacaacagctactctcattctgaggatgtattacagattccgggagagatcggaggtaccactagaggtcttctaatattaataaggcctacgtacttccatcctcaccactaccaatgcaaattaacaccccactgcccaagtgtgaaagccagggagctcccataccatgagttcatatttgttctcaaggtcatacacaatgtgtgccggagccaagattccaaaccatctgtgtctacctccaaagcttatgttctttccagaacattcatgacctatccttttttgtagaattttccctaggcccacaccaacctctctcctattcaccttcaaagctaagttcaaatgataactttttgtaacgaagtctctggttcacagcagaatgagaaaaacagaaaagtgtagtattttaaagccaaattattttcatgcaaagaactgcttaagaatatgtctgccttacatttttggtgttaatatgattgttatgttaaagaacaaaatagtgtcgctggtgcagtggcttacatctgtaatcccagcactttgggagacagaggcaggaggaccacttgagcccaggagctggagaccagcctgggcaacatagaaagatcttaaccaaaagaaaaaataataataaaatggtgaatggtaggtttcttcttctttttttttttttttttttttttagatggagtcttgctctgtcacccaggctggagtggagtggagcgatctcagcactgcaacctccgcctccagggttcaaagagattctcctgcctcagtttcctgagcagctgggactacaggcgcatgccaccatgcccagctaattttgtgtgtgtgtgtgtgtgtgtgtgtttttaagtagagacagggtttcaccgcattagccaggatggtctcgatctcctgaccttgtgatccacctgccttggactcccaaagtgctgggattacaggcgtgagccaccgcacctggccttttttttttttccaaagaaagtaaatacccaggacagtatgtggtatatagtaagtgctcaaaacacccatgaaagatttgcctggtgcaggcaagggcagttcctctgtactctgcatggctgggtctagcctagcatatcggcactggtgttcttccccactggcatttaggaaaacaccctcagttagaaaacaagtgtgccttgggatagctcagctttgaggatcccttctgggagatggggcagagtggctttggtggacagggttaagagccctgggtccagttgtctctcggtgcctgtcaaccccagaggtcatttattccaggcttggagcgagccattgcccatggacctccaaagcacctcctgacacttactgccaggcagtaactgcaagtgggagaagaacacaatagaacttattagtttgggggtaaaatcttggtgttacaggctgaattgtatctcccccaaactctcaaattcatatattgaagttctaacccctagaacctcagaatgtgactgtgtttagagatagggccttcttaaagaagtaattaagttaacaatgaggtcaattggggatgggccctactccaacagactggtgtcctttgaaagaaaaggagattagaatatagatatacacaaagggaagaccacgtgaagacacagggagaaagtatccatctacaagccagacagagaggtctcggaagaaacccacgttggtgataccttaatatcagactgtgagaaaacaagcttctgttgtttaggacaccctgtctgtagtattcgtatagcaactctagcaaacatttaggaagccgaaggttcttcccaagaaggtaactgagatgtccctatcatggtggggtgacaagaattctaagactcagaaaaaatgattttaattgactgggccaggaaaggtcaggtcactggcacagcaatagccctgggagaggcagggggcagaagacacctgattacaaacagctgagcaaggggtgccaggctggtgacggtccatcagttggttcccaccttcactggggaatgggaaaacgcttttaagacctgctttagggtctgggtccagcccgtgtgacaagaccaatcccatcagtgctcacagacatcaagaagctcagctggccatgggcagatcatctaatgtacaatcagggagatggcgtcaataaaagggggcaaccaatgtcagggcctcaggacttaatccaacgctttaccgaggcaacaaagccaaagccatctttcctatgaaacaaggggcaggagacctcagaaacctccaggagtaaaactgacatcacactgtagctagctgccaagacgcggaaccagtgttgccgcttttgctccccgcagagtgggtgcattagacagaaaatgcttagcgtgaacagaaataggagggaatggtggcagtgagggcatcttgtgttccctctgccacagtcatctagttgggaattctgtgtctcacttctttttttaaaacattctgacaagaattttataatcaaaagaacacaaaaatcaaagctattatcaagaattgtctgacttcataagcagctccaacttcttattcccacctgaattgtggttgagtgggtttgcacagtttttcatgtgtgcagggctttgctgctggagccccgggaggtggtatttttgctctgagaagaggattcactttagcctgctgcaattcatatctgcctgggaagacatccagaatgattcacaaattggttatggcaacaggtaaaaagaacaactgtcatgaaaaggcagcagcagcaacagcaacagcagcagcagcagcagcagggcagaaaatataagtgttccttgaaggaaaggtaactaaaatatctttgctaaatttaaaaatctatatgtgcacgtgtgtgtgtgtacactcagacacatatgcataaaatgattacacatataattctatgtacataaaaataaaatgattaatgtgaatgagtttgcacattcactgccgctatggtccaccagccaataggaaggaacccaggggaagtccacgaaagcctgtggctataaagaatgtggcgccacactcccgcagcacctatctgctggtgagaacactccagtgtggagttgtcctgccacctttcaagaggtagatgaggaaatcttgtcccccagaccaggctaaagaccccttgagagcaaggactatgtctctgtcactccttcgagcttcacttcactccatctcattcaagatggcacaaggctaagtactaaggaactaaggtatgaggtatgagctaagtactgaggtgctccgtggttcatttgtaaagggtcactttctgatccatactatgaaagagaaacagaaatatatgagaaaatgctctttggaaagtgaccttgtcttgaacctgtggcccactttgttcttctctgtccattctatgaccaaaagagagaagaaaaagtctatcgtgaaatgctcaatgattccatttccttcctacccacttctacttcctcctgacacttggcatgtccctccaactcacataccaaacaacctccatcaaagattctttcccttttcttattgcctttggcatcagaaactgcttgtctgtgctccgtccaggatccatctaacaaaggctgaagccccacacacctgggattcactctctgtagcaagatatctgaattcctagctctgaagcttcaaagcaaaggagagaaagaaatagggagggaaaggccaaagccaacttaaagacttcccatgagaatggaaaaggagcatgggaatgctggaggtggagagagaatgccatccagagactcagagaatgtaaagacacatgtatccttccttgcaagagttcttctttgaggtttccacataatattccaaactaggtctttccaaggaacttcgaaatcttggcaaatgctccgtaattcctaggatacatcgtgtgatctggtggcagatgaagagatgaaaagtgaaacaaaatagagaagaaaaataagcagaatgcccaacatggaagagaccccttccaaatgcacaaggtcacagcaccatgcaggaaagggaagggcccacaagctgccaggggttcccgggggtgctgggaaatcacagatcatgttaccaaaggagaactgctaaatcttatgacttttgtgtttaggatcagcatatggtccccaaatagtttgcccactaaattgcctgaagaatgttttttcacagagggtctacttggcatttcacaggcaggacatttctttatgacatgagccttgttttgcctattgaacaacatttagtagcacccctagaatctggacactaaatgccaaaggcatgtcccagttatagtcacaaaccaaaacaactgtgaacatttaaaaacacccacttagcagaggattcaggggatatgacctcttgttgagaattatttgcaagttttccatgaaattacagatcaagctgtctttgatgaaaaactctgttgaggaagagtgaagtgcttttctcaattgcaacatttcaagcctaggagactggctactgtgtagggtgggaagtcctgatgggagctgcctaatatatggctcaaatctcaagaatctgtccaacatggtggtctgtagtcatcctgcctctgcagggttggccacagctctgggctcccacttgctgaacagtgttaaagttggacacgttctcaccagtgtttggaaatcccttacctatgacagatatcactctctgggctgccacttagtggcaagaagtgttcttctgccccttccctgctaataggaagaaagacaaccatggactttcttttcttttcttttcttttcttttgagacagggcctcctctatctatcacccaggttagagtacagtggtacaatcatggcttactgcagcctcaaactccttgggctcaagggatccttctgcctcagcctcctgaatatctgggactacaggtgcacaccaccatgcctggctttttttttttttttttttttttttgtagagatggggtttcactatgttgcctaggctggtctcaaacttctgggctcaagcaatcctccagccttggcctcccaaagtgctaggactataggtgtgagccattgcacccaggctaaccacagaaattcgtagttcaaaaggacttttaggagatcacttacatttgggagcagtggtgcacagagggttaagtgttttgccaacagtcacacagtaaaaacaaccaaaagaatttatgtacataaagtgctgtagcacacagtcagtacttgataattatttcccaccggtattatcattccatcatccaggaagtccagccattgctttaagtggtatttctctggaaggtagaaactctacctactcacatcaaggacaaggccacatggtttccttcagtgtcccccacaggatgaccatggaatgaaatcaagattcttgtccacaagcccagcagtgcttgctgctcgtgttgtggaagcccactgcttgacaggctgaatgctcccattttccacatgtacagtaaaaacaccgagtggtgtttttactagaaatggaaaggaagaaggctgcctagctcacaagccttctagcaaaacagtcagtcaaaccaaagttgggcagggggtaggtaagtaaatattctgtattctcacctcagaccagagatgggcttgaaactgattgtaacatgtctactccaaagaggtcaaggggtgagggaaactcatgtccagcatgctctcgcatggacatggcaaatacaggatgaagacagacagtggctgagaccactccacgtcccttgacccccagcacagatgccttcctctcctgctccacttcatctcatctctcaagtaactacccccctcccttctccccacaagatcactgaaggctaatctagaactcttacttctaagcattaattcactcaatattttaaaagtatcctaaagaactggtccttgccctgaaggagtcgatgatccagcaggagcataaaggcacagatgactcatcttccacctctacacaataaatgtcatgtggaaagtagactcatgatcccctaggcatattccttaggacaacagtttcaagagatacactgcctaaagaaagggtgccagggccaaatgatctaataattctggaaaatgctgttaccaccccccgctttgtaaagactgacagtacaaattaatgtactaaaggcattaacatgtattgcagtgaaaagccttattagtgctgatcaactcaatcattctcaagcatgtttgactacctaaatttatcaacatttcatggagacaatattccattgaatgtcatttgctggattctaattggggtgattgggaataggtgttaaagaagatgctgcattttgactgggcccaaaagatgagtagagtttcattagtcccagatggaggcagaatgtgcaatccactcatgcaacacacactcactgagtacttcctaaaggtgaggccaacccttggctctggggggctgctaccctggtttccactgcaaggcagagtgaaaggcactagagcactgatttgagaaagggcttcctatgtttggggaatagcaaatgcatggctagagtaaagcaggtgtaaaaagagacagaatgaggaataaggctgaaccaaacagaaaaagcatctattagatcagttgtttatcaggccacctgttacctgttaacagcactggcctagacagtgttaatcatttctgtctgctgtggctagtgaagaaaccctgagcaagatcttcccttctctaggcctcagtttctttatctataaaatgactggattctctaaggctacttgcagcatccatgtctcagtgttctgtgattataagatataaaaaggcagcagcacataccagcactaaaggacaggaagaactggggacaggagaatagctattggtttagacatacatcgaaaaatcaccttgaagaaaaatgagcagaagaaaaatgaagcctattccatcttcagctctcagggcccagactccctccacctgatatcttaggattctgcttctcaaatgggaagaataaacatggcatagtttccaacagtcaattgtgctcaaaaatgtaaagaagaaaatttgactcttgttctaaaatcaagacatattttagacttagcatgcaatattctcaatgtattttagagatttaaaaatgaggacttaaagaaagatctggcttgtgtgggctttttgtcttatgggtgagtcccctgggtgctcattcaccgtctcccagtgtgaggagtatacttggagggaaagtttcactgggcatctcagagctttagccatttaaatcttgtaaagacagaagcctatttatcctgacttaagctgttctaaagagacagaaactcaccattggactggtcttctccatagtttttatgggatggtgcatacaagaacatcagagcaaagacatacagattccacatcccatagatgcctgtgaaaaaggcactgttcacttggactgtgacgccgccccatttccaatggccttccgttacctgcggagaaaggatggtgatattcaattgaaacagagaagaaacagaagaaacataacaccaataaaggaaccaaccaacatgaaaaccaagtctcttctacatgtgggaaacatgaagggccatgtaagactccatcttttaatctgaatcatttcggtgtaaattaaggtcaactgaaggttctctagctttctgtcaggcacagtcagtggtccttaccttgcccacagattagtatcacctggggagtgtctcttcctaaaaacagcaattcattgctatccctaagttaaacaaactgtgtttgagcccatcacttattcacaattataattcctcctctgctgtctgtcttcccagctagatgtcaattccctgcaggcagagaccagttctctgctgccatgtctttaaggcctgatgcaccatagattaattcaaatccagtgtctaccactcactcggcttaatgtaagacaagatgaagactccagacttcagaacttcagtgtccgtaagtgtaacataaaagcttgcaggttatcgaagagaattaagtaaaaatatttctagaacctgcctggcaggtactcagtaaatattagttatttctataacatcccttgaagtaagccactcatgaaaataattatgaagctttcatatgcttcaaaattctgcaagagatgttttgaagctgcttttgtctgtgttaatgatttggtaattgtcttaagggctgcctaaagatatatggattacactaagaactgtcaacagagctgctgagctaagtgactaatttgtgccagctctgagacaaatgaaatgattttgaccacttctgcttactacgggacacttaaaatggaaatagaagaaagtattgggtaaatattcctttgacagctgaatgaggctgcgttgtataaactttctctaggaatcacttttaaattgtaagatggcaggctagattgaaatgttaagaactttaacaagcaggtggatttcattgcctgtttatgatacagtgggtctgtgttcattatcttctgtataatccataacccacttggggccctaggccaaattaaggtctaagtataggtatttttttctgaaagaccaggagtgtcagttaaccacattagccaattatagacttagcagttttagtttggccttggtgatacataattcttcactttttgtgactcataaacaaaccactattatgaactcttatttattttggaaaataatgcattttatataaaatgcccagaagtgttttctggcaaagatggatttcataaccattactaattttaggacaatgtaccagcattcaagctacttaggacttcttagaaatgtctccaaatgtcgctcttctttaagtgcagaatatactaactttataaaaactatattacttagagcatcttatgatgatttttattgcatataatggaaaggaaaagaaagcattaagatagtttccagaaatacaggtacctgctgtcataacacagagaactcttctgtatgtgattaaggaggggaggctaggctgtcacgcatcctagctgcaagagagaatatggcaatatggcagctcttctactctgttaaggcagtggacccttcagctcagggaagggccagtaagagaccctattcctgcgacagaagctggaaatactcaatattgacaattttagtgacattgattcttgctaggattgacatgactgacccatctaaggaaacaccaacctatgtgccttgcacacagtggtgctcgatagacatatgttgaatgaacagaggtaaagtacaggtatgtgtagggactccaggacaaatacatggaggtagaaagtggagatggaaagaaccactcttaaaagtacttgattgaaaagtaaagacaaagtattgcagtccacaagtcataataattgaatttaaaagtgagaggagatgccaatgtgtgacaagtgttattcatttaaaacattgctttccgttatacttatttaaaataagtggttaacacaaatattagcaaagctaagattcttttgtattcataacaaggataagcatatttattcaatgctaatgatgtgccagatacaatactaaatccttttacatgaaacacattatttagtcttattaatgacgctgtgaggtaggtaggtaatatttccattcaacacatgggtaaactgtggcacagaaagatggagtatcttgcccaagattgctcagccagaaagccatggctctgactccaaaagaaggtattcttaaccattatacaacacaagggtaggaatgctatcttaaacaggggttgatctctgaaggtagcacatgctctgaaggtagcacatgaggcaacgactatgtaaggtcaaatttccttttgaaattcacttcattgcccataatgtacattacaaatacaacatacatgcacacatttgtctattcaaatctgtatagtatgcactatatatcctggacatagtaacatatggtataaactggatatataaacaaaataaaaacttacagtagaaccactggaatgagatgcccatagtatgagaggcacacaccaagcctgacaggaaatatcagactcatgctcccgtctcgtacttgctctgggacacatgcacattgtttagagtggagttgcagaattacacaccctactgaatgtgcaatctgtaaatgtggtgtttcctgctgtgggcaaagagttgaactgcagaaataaacggtatagatagtgtaactctgctctttggtggctggcttgtttttccctctcctctcccaattattcatgcctaagacatcctcagctctgagcacattcccaccaatatgtaccacaatgagcagcctcaacagagcaggccttgtaaatccaaaatcttactaatgccaaggcggaggtaacagtctccccccttttaactttgagagaaaaatcaggtagccccagcccccctccgccaaaccctcccccctcctcaaaatccccaaatctcaccctctgcataagtcttatttctaaaagtccctgtttttcctgattttacatttgaacaatttacttttgtgtgaaaccacccaattatacccctggagccaagtgaaggtcaaatctctttacacccagtagtcttgacaaccaacattccacttaacaacaagatttccaaatcccagacacaggctctcttaccggaaacatttcctctgtaagtaacagaatgaagtgatcacacacacacaaaagagctggggacaggctctctgggagtttgctgcatgtggcttgacctgaatgtcaggcacctgggggtccccttaatgaaggtcggtgaccttctcccctgcactgcacttctgttccctactgccgccacctctaaatggaacgcctctttcttttccagagggaaggggctgaaataccagactgcgatgtaccatctcttggttgctatgactgaggccattaaaatggcaggcattaaaagactgcacctcagtacccagctacaaagcctcaaggtcactgcattccacagcttcccgtcgcctttcattcctggcctcagagcttcaatatcctggcgagatcccctcgcattatatttcatgaggcttaaatgcaagctctcccacagcaagcccgagagtataatgggggttttaatacattccttttacctaaggctgggatccatttcaaaaagttacccaataggtttcctttcaggtgagctcattgctctgacattccaaaatgacattaaaaaataaatcctctgatgactatattaatacagtacctgggacactgagagttatgccggaaaacgtcttagatgtctataaataaatcttagaaaaaaaacccagcaggaggaatgtgaggagctaatggaattcaaaaggcctcattgctacccccttagagttgaaatccactccgggccgactgtcgcagcagatataaaaagccagccacaggctgaagctgtattagaaaatactgaggcaatagaatattaatctttttctccaaagaaaagccacggactatgctccttggaagatggcttcctttgctataagaagtacactaattaaacatgtacaaggttaaatcctggcaacatgcagctgcttcagggatcagtccttcttgacttcaggtgggaggcattccccgcagaggcaagatatacatgaggcagtgtggggagaatgacgtcagcctcccaaactggcacaaggacctgtgtgtggccttaggatcaaaagcgtccttctttctgctttcctaaaaacatatcttgaaattgccttttatgcctcaacccatcttccttgagatgccgtttctccaaggaagtgctctgtgccctctcagccttgcaggtctggctgtgtcaagtgccactgtgcactactgagggactggaggaactgaaaagcattttggtcataggagggaatagccacgggagaagtcaggcctcagacactcttgtttgaatatggatgtttgagccttagctggtagaataaaacactctttcagagtttgaaatagttttactgcaaatggagtggaaagcgaagtttccaaggttttataaacaacctgatataaacacagcagtgttgtaggtcaaagcagatgtggtgaacagaacttacaaagacatatatgtgtatcagtttattttttccacgttcatttcaacctcagcagagctagcaacactaacactccccagtggcagagccaacaacagggctctagaggctccaaacttggggtcctcttgggtgtccttggatagaattcaaggggtccataaactagaatagaaaaaattatatattttcactagtctctagctgaaagataatgtttacttcaattatggatgtagaaaaatccctatagtgttagtactactgtgattttctcaatagaaatcatgatattttcacatcaattacagttgtagatataaatctgtaatatacctgtagcatctgtttcactgtaaatatatattacatataatatatagagatgattccccttgaaattcgaagtattttattttacttatttgaaaccattctaagaggagactcgtagccttcttcaggttgctaaaggggtccatatacaaaaatggttaggagtccctgtactagggaaacttcccagcagaatggagcaagtcgtgtcctaagacactatctacactactgaaatcctccattttggctaaatgacaaagcactggcaaaagagtcagaaggactgcgttctgatctctaacttattgcatgtcctttggcaagaaagacattcaagcttcttgctattcataagaacacagctactcatgcttacaatgtgccaggtgctctgctaactacatttggttgccacaatgatggttcagtcaacaacagaccacatgtatgacagtggtcctgtaagattataatatcatatttttactgtatttttctatgtttagatatgtttgaaatacacaaatacttaccattgtgttacaattgcctacagtagtcagtagaggaacatgctgtacaggtttgtagcctaggagcaataggttacaccatatggcctaggtatgtagtaagctataccatctaggtttgtgtaagtacactctatgatgttcccttaatgaggaactcacataatgatgcgtttctcagaatgcatccctctttgtaaatattacttcctgtagtcattacagcaaccttctgtggttctattgtaatatttattttgcagataagaaaattaaaccttagaactgttaagtaatccatccacagtcctatccagctaggaagcaacataaatgaaaactttctccaaagctattagatatcatagtctagcaagctaggataacaattcctgccctacttacctcgtaggatttttgtgatgctcaaatgaataatagatacattagatttaaacagtacttcccacccttcaaaacaagttatgaatattttaaaatgattgttattgagattttcaagtatagcaaaatgttgagttttggaaataaccagtgaaaagacaagatgctatcaaagagacttttgaattacatttcatatttaagtggcaatataattattacaaggaatagctgatggactgtataaggatctatgttaatgctagataaaaatggaatcaaatttatgcttgttagtgttgtgctacacggcttgataagtttttctcataagtaaataaaatatgtgcccttcaatctggctgtaggcttttaatttatttggaaacttttatctcctacaaggttttacggaaagagaaaatttagtccatttggccaggtgatatcaagacccagaaaaatatggcttgaccagctgtccagaattatggcctctctcctcctttcctcagtggctctattgaatttctgtgcagggtagagggatctctgcagagacattctcaccttgacatctcagggtccacttacctgactaacgatgaagaagatgacagtcatggcagcgcaggccaaggtgataagcatgaggaacttgaacctaaaaattagcccctattagaaaagaaagagtagtttaatactccatcagctaccaatccttttctcactatgtaaatctataaaaagcttaattttaaagaaatctgtaaaaccaaatccctaagaatgacagtaaaatagtttcccatagtaatatttcttctgcagaggtgagtgtggctgaaaatttcttgggccaagtatttcctatgttcttatcactcataaagcagcgatacgagagcctgggaaattatattcacaacacgtcgtgaggctgctaatttccctgctaagctggttatgcttctctgcaagggttcaaagttaccaaatccaagttttctgtggttgtaataaaattctgctccagtgaacaaaaagaaatgtgcatattaatcaacatgaagtggatttggttgaattttctcatgtcactccagctctggagacaggcaagccttagaaagtgcctgtggtttcctaagagcaggatttaagagaacctgtgtttcagagagggaggcctattattcaggggctcttctgtgcagatctactgcatataaaaactctgaggttctgtagtttctgcttctcttttcatacaggaattaggcttgtttctccaaggacagccacttaggcatgaacccaggggatccctgataaatcaaggatgtgttgcttgcattggggatttgaggatgttaagtgtttctcttgaatgaggaacataatctataaacagagattactgaactctgtctgagcatctgctggatattttaggggaatgtggcctgttaagagtctggaaatcagatcacgtgggctaaaccctgtttaattacaggacagggttgattctgggacagaactttgactaaagcctcatcccaacaaaatcccaattatgccatagtccaatctcccagctagtatgtaacctacattccatcaccaagctgaagaaccggctgaacaagtttattcattactgaaaatggaaacacatttgtaccacagaaaacaccaagatttaggccagctagatgcttctcagagtaagatttggcctctaattttgcccagagatcctacatgagaatctctcaatttgtatttcaaagtaaaggctttctatctccagggtgtgtgtgtttacacatcaagtggaaagatcaagcaagcaccagttccagaacgagccaagaaatctgcccacctcatagtgtagccgccggactttgctcatagctggcaggctggactgcttcccactgatgttccgaaacacctgaaataccatgaagcatagaaacaggaagtagaggcagaggcagattccagccacgatgatgaaggccatctggtcgtgtccagtaaaggaaacaacgggctagccaaggccaagttgagccgggtccaggcccttctccccaggtctgttggcaatacttgttttgtctccaaatatgtagaaaattttcaaggggataaaatattaaaacctgatattctaatgccaatgataggtttcttgacacattagtaccacagagggaggtgttcaatattgctttctaaaccaagtaagaaaagaaatggtgtcttgcttgttagaaatgaagaatctaggccctaccctagacctaatgaatcagaatctaccttttaaccaggtccccaggagatccgtatacacaataaatttgagaagcactaataaaccatatattcgtcactatggatcagatgaaaaaccacagtaaaatcaccagaagggttcaaatgtagatccccaggtccctccctagatatatggaatcagatattccagggctaggacatcaagtatgactatgtttgggaaccactgggctagtccttggagttttataagaatgcgattgagatactctggcataattgaagaggagatacgtgggggctcagtgcaggggacctgggcatgggcttgaaagtcttaaagtgaaaccagggatgaaggactatttgcaatcttctgtcaccacagaaaatcttgtccaacagaatggggattcaaggacacatggcacaggtgggagtctgggttgctgccagtatacttgagacccactagggagactgacctgccaattagagccagtctgagaaccaccaagtcttaggatagcgtgagctgccttggaaggcagatgacctgattccaacccctttctgctacaactttgcccaaattgcctttttttttttgagacagagttttgcttttgttgcccgggctgaagtgcgatggcacaatcttggctcaccacaacctcctcctcccaggttcaagcgattctcctgcctcagcctcccgagtagctgggattacagggataagccaccacacctggcccaaattgtctatttttaaaagcatttaataagtatgaacttggcgtgcatatttcattaaataatataatatctaatgcagtttctccttctttcctataatgaacatcatcctggaatgaagggaatatagttattttctgcaggacttgaaattttactcactccatcctatctacaaaattaaaaaagttgaactagatttaacattagaaacattcttcttgttgtgcagctaacatttggtgggggcataacagaggaagggtagagcttctctctcatctttgaggaaatgatactactgatttagtttgctcacaatgttcttgtgacactgagaaaccaatataaacatcatggcaagacaaaggatattccctagcacgtggcaagatatgagccatcaaggaagaatacaacccaagcctttctctccactccagagcagagtctttttctcccaagatcatttcacatactattccggaagataaaatatttaaatccagcatcctaaaagggataagctaagactgtcacttctgcttcatgaagatgacttagagtttatgccaaccaaccagaagccttggcgacttctctggaactaatcaccttagccttatctccacttggtctcaggaataaatagcagcagtgtgatttgccagcacaccaaggtcacttaagaagtctcacacataggtggtttcagaaacaggctcttccacaggggcccagagatgaacctccatggctccagggaaaagctagtcatgcttcagtctgcaggaaacagtgtataacagataattcagacaggctgcagtaagcctagcaactcggatccctctgctgtgaggataggctgtgaccttctcattttgcctgctctcacccaggcttgaaagcaagcagtaattcttcttattattagccttaattgtgctgttatgattggcctgagaatcaaagccctggctgagtacatatggggagcatcagcagagccttagaaaatgatcttggggactgggtggccaggggaagaaataaaaccctgagcccatcaaggaaggatacggccagctctgttccaatgtctgtagtccagatactgtagaagggattcgtgagttgtacccctctacaaagaaaatgagatggaaaggcaagacacaattaatacaaaggcaacgggaactttccttttcacatattcttagcttttcagctgcaggggtgagggctgtatttaggctaaaaaacattacagaaatcctaaagagaaatgaagcttgtagaatacatcggcccaaatatttttcaactgtaaagagctgtgcctttgatttgatcccagaccttgtctgaggatgtgaccacgtccagtgcttccaaaccaaaggttcccgaccaccattctccttttcaaacactcctcctaaaatgacaggagtgggcgtggtgatgcacagtttggctcagtgtcccacaaacacttgctcacctctcacacatgtcaaatatgaagaggcagaaggagccaacggcaatgggtccgacttgcttccaataccctgcgatgtggttccgctcgtgctgatcctgaggaaaaccaaattgagaagggagatagaggggagaggaagaccaagcaattctatgggggagtcagcattcgaaggacacttgccgaccacctattgtgtatcaagcactatgctagattctaggtatgagaacaaagaagatgaaaatctcttcttcaggagctcatctctgtgggggagtctggcacatacgtagaacatgacaaagcccagccataagggctctgagagtaataagaacaggatgccatgggaacacaaagaaaggcctcggctcccaggcaggggacattttgtggtccacaaaataactcattctgaattaaatttctacgtgacttgtaacttgtgtttataaaagtgactgatcctcagaagacaaagtaaagacattaaagcatttaaatatgtaaagtgtgtctattatggtgaggaaaataggcatattttctccccatccttattaaaaccaggaatgagtccccttgataaacaaagacaccaagagaaagaaaaggaaggaatgtagaatgagaaaaaagggaaagcaaagatgatcttagcctccaggtggggccccaggtgggtcagtccacaccagctccctgcggacaatccttggctggcttcctggtgctggaccaagttccatccactcccccgccctgctgctgaggcctcattctcagcgcatctctgctggaggacacctcatggagaaagaccccttaatgtagacagtttagcagtaggaagaagtctctctctctgctctcacactgctctcctggaagggcagcaggacttgagaggtctggttttcatgattgagccataatggaatttaaaaacagtccactctgctgtgaagcccatgtgcctgacgtgaagaccaagttccagctggcatatcatcttagccacaatgtgatgatgacaccattcttatttttaaccatggtaccttcaatccctcttgaaatatgatttggtgtctgtgcaaactgaggagaccgggaaggtctgtatttcagagtaataggggttactaggccacctggacacattgccagctggaaagagccaggcccacattctctgatggttaacctgtattcctggggacaggacaagcagggcagaagccagcagacaagaaactcaagctcaagggcaagaaataatactaatcattagaatgtgtgtgtttatcttaagttactcacattctgtcatttaattctcatgaaaaccccatgcagtaggtctttacatcccattttatagatgagggacccgagattcagagtgataatgtcatttgcctaaagccactcagctggtcagcaggtggtgaagcaggaatgtgaaccagagggtctgcctccagagttcccacttgtaactactagtttattctgtctcacccactgctgactagaggcaaaggggggcaggtgtcagcttggcagcctgcacagagcagctggtacagacgtctgtccctcccggcggctcttaccatcatgtgctcgccacagaagatgatccagaaggacagaagcatcgcatagaagatgccctgtcggatgtcaccaaacagcagcatccaggtccagtcaaacccgatggaaaaccattccactgggatattgataaaggtcatggaaatcccaagggcaaagatgactctgatggtgagaaaatatcaggacagccactttattcatctggaaggcagattttcaaacaattccccgaattcagttttgagacatgagatgttacttattgggtctgaagccatatgatcaatttcttctgcacagagatgcaaaacgtcctatgtagttggcactgctgcagaatgagggagtgctataccaacctttctatggaagtgaacctgacctccttaatgcctcacactttactttggtaccactgcagatggcagtcttcctataatgtttgtgtccccttgccttctcacccaggcctcagtgagtacaattgtcctctttcacctattcaggttatcattcatctgatcattaagaacactcattattattgtgatatcctcagcaactatgaattatataagcatatttgtttcaataatacatgactccaaacacatttgaaatgtaaattctcttgactgcttgtttagcttttattttactcttcccctgtcacactaagaactgccaattctctactaaaatataattcttaagtcactgatttattcatacttttttccatccccttgaaacacatatgttaattaagcacagatcatgtaccaggtattgtgttagcactatggaatcctaaatgaacaggacctgttttttcactcacgggagatacagttagtagaggagccagataaagagacaactgaatagattaggatcaggaacatcatagagttttaaagcatagagggctgctaccaggacttctgactttgacacagacaggaatggagctgacttgtgagtcaaagtgagggaagtggaaagggtgtttggaggagagggcagagcctggatggaggcatagaggcctggaagaacctgctgcatttggggatctgcatgtggcacatcaggaaatgacaggacatgagaccagagaaacaaagagggctgtgctcatgaagaaacttgcataccccactggagaactgaaatttatcttgaagagactttttattggaatccaataaaaagtttaaacaatggagtgacatgattcattcaaaaaatatttattaaactcctactatgtgtcagtcactattctaagatgctgggaatataactgtgaacaagaaaagcaaggattgtgctcttgtgatgcttgcatagagatggaatgagagagggagtacaagaaaaagataataaatgaagaatgagcatcatgaaaaaaaaagctaggcaagagagtggagagcaatggggatgtgattttacgtaaggtggacagacgaagagatcagcaggtgtgaaggccctggggtgtgggtttgagcacaataaagggggctggtgggtggtggagaggacaagtgacaagatcagaggtggaaggcacccaatcatcaaggggcttataggtcagggcaaaggagatgaaaagccagtggagagctttgagcagaggggtgacaggatctgattaacacttgaaagggggcactcctggctatcctgtgaataggctgcagggaggcacgtgatggaagcaaggaaaggggttgcgaggctgttcccactgatccaggtgagaagcgatggttggttagttagattagggtggcagcagtggaattggtgagatttcctggtgaggttgatgagaagtgtgaaaaacagagacatacaggatgactcactgctacatttccagtctgaacaactgaaaggatggagttgccttttactgaaatggggatcctgggagggaataggttggaaatgggacacaatcaagtgttgttcttggtacatgtgacattttcaatgcaaatgaagacattaagtaaagagctggaatatttgggtccagagttgggagaggctgaggctaaagatacagattaagagtcatcagagaatagatgatttttcagaccacaaaggtaggtgaaatcaacccccctagggaaagcacagctaataaagagaagaggtccaaagcaggtgccccagtcccaaagtctaagagtctggaaagatggaaggagacaggaatggaatctaaatgctggtcagcaaagaagaatgaccaacagaagggtagaggagactctgggaagaaaaactgatcaattatgtcagatgctgggatgaataaaaaaaaagtgaggaacaaaaaatgacctttggatttggactatgaaggttgttggtgatcccgtgaaaagcagttttagtagagtggtggagatgaatccagactggaaaggactcaagagagaacagaggagaagacatatgcacaaggtttttgagaagcattgctgtaaagaggagcagaaaaagggtatgtggcttcagggggaagtgggaaatgggagaattttgtctaagaatgggagatggcaggacatgtttgtatattaatagaatccagcagaaagggagaagtcaatgatgtggagagaaagtaggtacatctacaggagcactgtctttctgtaagtgagaggagctgggcttaggggagtttcttcactacaacacagacaagtatctgattctgaccacggaatatcccgaagagcaaagacaggttaaagaaccagaaaggtcagctgggtgtggtggctcacacctgtaatcccagcactttgggaagctgaagcgggcaaatcacttgagctcaggatttcgagatcagcctgggcaacatagggaaaccctgtctctacaaaaaatacaaaaaactagctgggaagcatacacctgtggttctagctaccgggaggctgaggtgggatgaccactggagcctggaaagtcaaggctgcagcaagctgagatcccagcactgcactccagcctggacaacagagtgagaccttgtctccaaaaaataaattaattaattaaaaagagccagaaaggtgagagaggtagaaccccgaggatttacttaataacaacttgcataggaaaactgcaggagaaaaaggagtccaggatgactcctggtcaaatcactggcctaagtcacacactggctgcttgaactggacaccagcaaaagcaagagcttggcagatcatgagaagccagtattcctgaagagcgctccaaaaccagctcttacttttccagaagcactgggggtcgggacatcatggtgatcctcctccaataccacaccataatgatgaagatgctgggcgtaaggaaggtcttcatggcaaaccacaccttggtgaagcctccattttggtggatcccctaggcagagaccagtgataattttgaaggtgaatattatcttagcatttccttctactagcaaatgcttttgtgggagaggtaagtggagacctcgtctgcgaatgttcacgatcaagagctttcacattcatagcaggtactgccctcatacacccttggactctcctcagagataatagaaatacatattaaaagagccctgtgctatggacctgagaccagagaaataaagagggcatcccattcacaataacggctttcatgttctggggtctgaaagaagaacatggggctttggggcagggtcactatttccaagagacttcgaattatcttaccttggactcatcccactgatattaaaatgctaatacctaaagatacactttagaggtacggattaatagggcaggtatggattaatagggcatacagggtgtatgatatctacccagctaccacccccacagtgtaccccccaaaaaagccacatttgaggtagaaccagaaatttcaggtaaaaagcagagatatcctctatctcttaacacctctcttggccgtttaatcctcattctaccctcacatcttactaatctggtctactaaggctacaagagctttttccctatgctaagattacgattaagtacatgatcaattttttttgtaagcttttcattagaaagttgcagatatcctagatggtcaatatgttgagattggtaagtgttaaggtaaatctattctataaaatgctaatcaatattggaaagtatatttatattacattcaccaatttatattacatataccattaaataaagaaagcaaggaaaacagtcagttcaatatgatcctactttttgtaagggaattactacgtataaaaaaaagcctggaaggagatatatcaaaacctgaacagtgattatttctctaaatagtaggacattacaggtaattattatgcttttctgtgtctctacacaattcttgtgggactttgttgagattgaaaagaaatggcctccttgcagcaagttctaacttttccccaattaaacaaatatgatggaaagaacctaaaccacccctattccttttaacatttgtgcttgcaaggtgaaacacataaaaaagaaaatttacttttatctcagtgttattcattatgcaatcatgactatttcatgatcttatcatcattgtaatgatcttaagtgatcttaagcccatttaaaatcttaagtgggcacaataattgcattgtttcccatttctgtaatctctcacacaaattagttcactttatgatctcagccatcatgagtatgttattattcccatttctcagatgagacaggtgaggcatagaggtgccaagagtgagatggagttcccctccaatacacatgtcaagatcaattacattcacttaccaccaaccggatatcctttatctccccaattcccacattgattttcttcttctcattcacaggcagccggatgtttaaaaggtaaaacttatgggccacagacccaatttccatgaaaggaaggacatcacattcatagtaacggccctcatgctctggagtctggaaaaagagcagagggtttgaggcagggtcactatttccaatagactggctctgaattctgttaccctggatccataacatcaattgtaagcagctaatgcttaaaggtacactttagacgtacagagtaacaatgcatactggaggcatggcgtctacccagctatcccaacctaaaacaaacatcaacaacaacaacaacaaaaaacagctgtattcaaggtagaaccagaaattttaggtagaaagcagagataccttccttctatctcctaacacctttctaggctgtttaatcttcattagaacctcgcatcttacgaatcttgtctgccagggctacaagagtttttatctgcagtgtgttgtcagggtcctctaaggctctgtggaacagtcagcttcttaaacgttcaggtggaagctcttgctgaatcattacactctttaatgacggctaattattctcctgattttggcctgagggagaagctagaagaagctgaaaatatcttctttttattcacttgccaggaaaaaaaaagacacaaggagccgttggtatttagggaaggtcgaaacagaagaaagaaagataataagattagtggccagagatacccactaagaattttctgcctccggtgcttcctaacagtccaagatggcagaagggaatagaagttttaatgaaataagaatttagcccagtgtctaggaaagcctcttggacttcgtgccaaacaatttaagagatactgcccagagcacggtggtgggaaattggacagtagggagacaccttttttttgaaaactaaattctgctccacctcaccaggactcccggctgtgtacctgctgaggggtgggggccaggggtaaagatgagcataaagaggcatgagcttcagcaggccgggacttttccctgatatagaagatgagagtctaccatcaatgttgggtttctatgtcagcttcaatgtttccttggcacctcctgatcaagtgataggggagatctaatttgtcgttcctaagcctgaatttgcaagacctccataatttgtcataaatcttcagagcaaagatccactgaagaagtgagaagaaagaagataacaaagagtccatagtctaagagtatgtaggaaggggctaggaaggggctctgccccttctgagatcttggctggtggggagggttccttactgaacagtcagagcttagaatgcagtaaacagacctttgtacagagacagagacacacacggcaaggtagaggtggggaggtgcttctacctcctcttgcccaccacggcacacataaccaatcagtcgtcaacagtttttatccctaaggtgtgagcagctcttgtcagacacaccagttgattagagttggcatgtgagatttttaaaaattcttctgtagaaagaatgctgctttttcaaacctcagctgcaggtcagatgattcttcctatatagatcatctttctctcccctccactcctttctctcttatactttcaaatcagggaggatgggggctctgcaggtactactaaaagttcactgcaggctctaattctccctcagattaagctgcagtgaggaggctgattatcctctgtggtaacagcaagagggtattttctgatttgtttccagttagggccttattttattgatggaaattgagaacttgagggcggaagggaacaaaacctacttagtctaattccatctggtgtgtgtctcgcccagggtcccaaaagtagtagcagaattgggagaaggacatgggccctgcccaaaggcaggcattgtgctgtgataaagactcctgaactccaggccaggaggctgattctagtcctgaccatgttccttgctgggtaccttgggtcaccctgcctcatttggcctcagtttcctcctaagtgagaaagttaagtaagatgatctccagggtcacttctaatcccccacgatgggtctctgggtgccccacacttccctgtcactactgagtgagtaacatggacacccttgacacaaatttacctaagttcaaattaaaagagacacattggcatctgggacactggctcaaccttcctgtctcagagacaagttcgttgtatcctgttagagacttttcttcatgcactaaagtcctgcctctgccagtatttagggcatttaagaagattcctctctctccttcctttgccccacccccagttctcccccaactccagcatgagactagctcattaggacaaattacagcaggtggcaacttgacttttttttttttaacttcacaatccaccagggactcaaaagctttaaagcaatttctcatttaatcttgagactcaagactaaatttcactgcaatcaaaaagcagagacttgatgattcatttccttcgcacttttcaagatttaatatctttcttgcaagggatcaacacatcctaaagataattaagcattaagaagcagttgcaggcaaacacccttccccctcgctactcagtgccctccatgtgtataaatgagaaatgacttttcccttttctatggataaaattctgtatccgaaagccatctagcttagatgttcaaccagtatttcaaagatgcagtcaacttgcagagatagctagaaaggtttttaattttcttggttgcatgcaaagatctgaaaatgttagctgttcctctctcctgcttcctctagtttgtctatcattcatttctacctacaaatggctttctctggaggacagccctatatttagcactcagcagagggtctagggcagtggctctcaaacttcatagagtttaataaactgaaggcctgttaaaacacagattccttgctcctacaccctgagacattgacttaataggttctgggtgtgccctgggaatctgcctttcctaaaacctctcaggtgatgctgccactgttggttctcagaacacattttctgtagctttgttctaggaaacctgcgggagggagactcccctagtgtttcaaaaaacactgcaatgggtacttaggtttacccatggagggccttagtttatatgttttctcctagtggcccatctggttaatatccgctttgactctcaaatatgtcccagacaagatgttaaattagaaggtcatcctgcctacgtcattgtatcatctagtccaggggtgtccaatcttttggcttctctgggccaaaccggaaggaggagaattgtcttgagccacacataaaatacactaataatagctgatgagctaaaaaaaaaaaaaatcacaaaaagaaattataatgttttaagaaagtaatgaatttacattgggccacattcaaagccgtcctgggctgcatgcggcccgcaggcagagttggacaagcttgatctagcccttaaacagactcccaaggtaggtactcttatctcatcttgcagaagaaaaactgaagctcagacagattatgtaagcttacctgaggtcacaccgtcagtgataaaaccacctaatctttctcctctttaggaaaaaaatggctaaagctggggcaaggtactcagaggcttcaacctcatgtttttactattttgcaggaaatcttaacagtaataggcaaaagcaaagttaggaaaggcccgtggcaggagagaagaggaaataaaatgctccgcagagcaggtattaccaaagctgtcctcatgcgaagaagggacacacctatgaaaagtaagcaaatctttccacatacctgagaaccaaataaaaactgtcagcttagacagcaaggggtcataccttgggagatgtgaaggtgcatttgagtttccgtggtactctttcatgggccatttcagtccactcagcaaacgcgtcatcacggtaagccagggaaacgtccatggagacttctgcattttctcctgcaagagaaaggatgcacgtttcagaaatgacttttggaaagatattttagaaacagctcaaaaaattcttataggctttgacttggaaaccaacgagacaaaagggaaatattaatttctatcaaactccaaacctgaagacttagaagtcataggatgaaagtctaagccaaatgctgggtcccctctcatgtccactctgccagagtcaagagcctccatttaaactcttccagagacaggggcctcactctctctgagggagcacaaatggtcagacctcatcctcccataacttgtaccatgggtcctaggtctgcctgtagaagccacgtggaaggtgatgtccttccttcttccataaaaagtgccttatgttcttgaaaaccataccacatctgcctgcattctctttcctctctgataaacatgaccaagtttttcaaccacctctcagacacgtccctctggggctcttctctggtcacactctgtctgaaaacatccttctcaaacttattcccgaaagttctcaaatataggatttgctacttttccaaaagtcaaaatcccttcatattgtggatgaagttaatgtaaaaggcaaagtgtttttccaaaattaaagacttatacacagataggaataatacataattgcacaaatgaatgttcacacatacttccatatgtgtggactggaccacgaatgagttaaactcaccacagaactcattaaggagatgagattaataaaacattgcacctattaattttgtctgttttatactatgatgagcaagttcaagagcagagaagtcttttttttttttttttttttttgagtataaaggtttaattctatttaaaaagaaagtccattaaatcaacttcaagttcttaactcatgggactattttggaacacttctttgtaaatatcattttgttaggttattggcaaaacagtttcaaggttcacttccctcccttgaaccaggtccaggtcattttgctttggggtaaattaaaatcagaattctaaaagttgagcaactttgtttttttttaattgacttagctctaacccaccattacaacttaaggacggcatgacttgataatgatggacttgtgtgaggttttgagttttcaattaaactttgtatcacatgaggtaattgtcagcattcttgagtctggttatggaataggcagatagaaccctgtagtaacaagagttggaaattggctaattgacaacgcacttgccttaaacatctcaagtagagaacttttacattagtgagatgtacttgaatttcagaactcaacaaattttaattactttttactgaaaactgcagtgaatgctaaatgtctacgtttacaataaacaaatacagtaacagtaactcacactgaaacaaaacatacttctgatagccattatttttctgcttgggacaattttaaagtttttcttttgtcacaaaaacaggaatgtatccaaacaaaggctcaaaagaggccatcttttcaaacaaaaaggcaatgattcacaaaagactgtgaatagaacatgtaactagttgatacaaatctaataggatttgttaaaatcagtcacatctaatacatctgaagtgctcttgtataaaatatcacgtgaagaaaagaagactttatcaatgtctaaaaaagtgggtttgttcatagacaatctgacaagttaccataaaaagtgtttcctgagacataaggaaatgcaacattattcttcttgaaccgttttagctcaactttccactcaataaaacagcagaggatctgaaactgagaaaatgtatttgagtacaaacagcttgtgaaagttaatactttttttttgcatcagagggtttttactgaacttacaaccaacttgcccactcagtatgcagttcagatgtgagagatgcttctctgtacaggagcctgtactgtcttcaatcctatgcgagcaagtgtctaccacaggcaaacagttttctccccattttgtagtaatgtaattttcctattagcaaaaggaggtcaccagcccctgtagacttaagggactcaagtcacaggatggggatatcctcttaatattttttattttgttgtttgaactcttgatgcaacattgtagagcagggtgttcaggacctgctgtgcccaagggactgataaaggaaaaagctctatttattctttgtgatttgatgcacagatgaaaaacttaacacacaataacagaagttggtcgttaataaatcacatcctagtctttcagcgcttccgtaagcagacgacatcttcagttttctagctcttgtagttttaacactgcagcatcaatgatgcataagtccagaatcagttacaaagaccatcatattctttttctcttagttcatcatttttcactatctcttggtcccaaatgtatctgaatgattaccttccggcattctctgctattgctcgttggagtgctctcgattgtccccgtgttttgtgggctggttgggagagggcgcctgggaaggatgtgccactgttgggaggttgtgagtcactgggatgcctccagggatgatcccttccacggctgcaggaagtcctcctggagccacgcccacgatgcctggcggatatctgtatgtggcaccattgagctcaggatgaattgcttgctggtctattactgaccaaggcgctgatgtgacagagaattccttgttcacacagtttcttaagctttctgggatgtgacctgtgatggctcggcggatctcagtggcagctgcctccctcatctccagtgacgcctgcttgctgtaccaggcagtgtgaggagtgcagataagattcggtgcatctttcaacggaccctgagcaaagctaaagggctccgactcacgcacatagagggctgcccctcgtatcctgccctccttgagagcttgtgctaaggctttctcgtccaccaggccaccacggggtgcgttcacaaggaatgctccctgcctcatctgctttatggtaaagtcattgatgaggtggtggttatgttcgttgagattgcagtgcaaggagacgcagtcgctctgatacagcaaatcctacagagtgtagaccctctgcacgcccagggatcgctcgatcccatcctgcaagtaggggtcataaaatatgacgctgaatccaaaggccttggctcgaactgcaaccgcctaccccctgcgatcaaagccgatgaggcccagcatttccccacggatgctggccgatcccgaggccaactcgcggttctgctccatgctctgaacccgtgtgccttaccgcagtgcttggtacagccatgtgttcctctggtacagattgaggatgtggcagatggtagagtccggtgtctcttccacggctgcagacgggatattgcacacagcaattccgagctcgctggcagccttgatgtccacgttatcgtagccactgcctatctgcacgatcactctcggggccttaaacttttctaggtcctccctggtgaggatgatggtgtggtacatcatggtacccatggcttcgttagaaccttctcgtggatttcctgcgtggactgcgcgtcacagaaggccacagtggccaggtctttcaggatgggcatctccacagtgcagtcgcggccgtccagcagcgccaccagggggcaggagtgcagggggccgttcatgatctgggggcggataccttcacaaattctgtccaattgctgtctcttgactttgtgcttatccacaagggccatactttatggaactttgcaactctcagatcaaaaggcaaagcagtcctctaagaacttaggggaactcgcaggagtctccgtgcatgacgccactatgaacccactataaatctgtacacactataaatctgtacactataaatctatagttcacacgatgggctgtccgtctttttaagggaatacagcttcattggttcaaaaccatttaaggtgatgaaaccctcgtcccggacggtcagcgtccacggcaaaaggcgcccactctggaggccgcggtggcggtggctcccgcccctcccaccccaccctgcggcggtggcggtggcggtggctgcagctgtgcagcctcccctcagcgcagcatggctcccttttcggtccctcgctcctccgggccgctcccgagccaccttaaaatgacgctcgcacacagggacacacaacacaaaaacttaatctctccagctccccaccactccccctccctccctccgctaccccgctctccccaccctacccctccagagaagtcttaatgaggaaaaaaaaaaaaaaagcacaaatcacatttccaaaatgactggagatcctgccaccactagggttatgaaaatgggcacaattttaggctctggctattcagccttgaagaagtctcagtatccaggcacctgagtttgctccatacccacctcctccagggctgcgacaaggattaaaagtcaagttagtgaaagcactgcatgctgcctcatatgcagtaggtgcttaataaatgtttactaaacctgaacacatacaaatcacaagggaaacagataggaataactgccctctgaaaagcagggcttttctacggtggcttaaagctgacatggcagcatggcagatccctggttctcagaagaaatctcggaaaaggaagagatgatccatggaagaaggaatttgaggccattctgatatagaggaaaccctcgatgaacatcagtacccactattctattattcctatttttatcctcagttaaacatagtgaattagccactgtgttttcctcctgaaattccacaaaataaagacaaagacagtaaaaagaaaagcaaaagatattaaatcacaaggggaaaaaactaactgtagacacatgagcagacaagagatttcatttttttttttttaagacagagttttgctcttgttacccaggctggagtgcaatggcatgatctcggctcactgcaacctctgcctcccgggttcaagcaattctcctgcctcagcctcctgagtagctgggattacaggcgtgcaccaccatgcctggctaattttgtatttttagcagagtcagggtttatccatggtggtcaggctggtcttgaactcctgacctcaggtgatccgcctgcctcagcttcccaaagtgttgggatcacaggcgtgaaccactgtgcctggcctcaaaatttttttaaaacataaaaaatacatgaagtagggtttcctggcagccacagcctacactcctatagaggggatattctagaaaagtgagccaacatatctgcaggaacctgaagccactcagaatttgaaagtaccaggggttgcagaaggcagaacaaagcatggcactgacaatggggtgactgggtcaaagtctgcacacaaaactgctggacctcagttctcccacatcttcccatctgtgcaagatccaaggagagactctggacttgaggacaccaggggaatatgtagacccagggctggaggtggagaagagcaagagtctgtagaagaaactgtgccactcccagcttggcagaaacaatgttcagagttggtatctccccttggtcagggaccaagctggctacaacttctccccacttagtagcctcagtggtcaacagaaagaatcagtcagagctcccatggagtcaaatcttaggcaataaagtacatcctacttataacgctgggagtaggaattgggactttaaactgtgttgaaaagggtgcttggagaaacacaagagtataaatatgaaaagctgtaaaaaatgtcatcagctcacacacaggttacaaattactcacaggttgttctccttggagccatagggttcagagcaacactagccttagacacaggcaagaggggcctttgaagtttgggccccacacttttaaagggtcccacacttttaaagggtcccactctgtcaactgttcccttctttataggacaagaagactcccaagtgaaggggatatatatacccagagcctacagaccccctcacttctagaccacgctccgagatgtcagactccagaacattctgcctagacagctctgaactcttatcttacttccaaggtctgtgtggcctctttccaggtctggcttcccaagaagaactagacaaccacctgtatactcttggatgttcggtgggggtgggagtgaaaaggctgctatttgttggaagatatgaacagagcttgagctcggaggttagggtgtccatgtagaagcacgcaaggcccctctctttatgggatggagccagcggtggggagaaaaggggtgtaggggcccacacttcctgaccagtcacattttggcacagaattccaagtcgtccatgagtcctcaattcgaacctggccatcctgttcattatgcaagtaactcatcatcagaggatgcaacgtacttggcttaacagtttgctggcctgatttatcacttctaaatatttagacacatgataggcatgccttcattcatactgtttccccaagccagacaaatgtttgtagtgggcctggttcagagcaggtgcctcacagagacaaggctagataggattgcttccttgcctggtcccagcttcaaaagttattctaatctgttgaggatcctcaaaggaaaaactattttaaaatatgcggtttaaaatgaaaattgtgcacagtattttaatgtacaattactccatgttaagctcctgtggtttctgtgctttaaattacctcatttaatgttcccaacaattccatgaagtggacagaatattttattttaattaatgagtaaagtgatgccctcagatcttaaggaacttgtataaagtcattgaaattgccttaaaataaaatcacttttttggtattgcttaaagaaaactggctaacttgtgatagaagaagcccctcaaagcagtcacacaatatgaatatgctaagtctttaataatagcaacagctctccttcatcagaggctaacatgcaccagccttcttcaggcctcacatccatcctgggaggaagacgttatataaattgcccaagaacatatggctagtaaacagcagagctcaagtctggatcacgtaagggccccactgcactctactacctttgctggtgaaaacaaacaaacacagtagaattcaaaagaagctaacagctgaatcaagcatacttggtcaaagagccactcaacacaaactaaatacctttccagctttctacaggagagaaacaggcaatgttcctgggaggctgcaagtatggctcataagaatgtctggaattatctaatctaagctttctaaagccatctattgttggctgttaaaattatagcatgttctgccgtctcttcacgttaccatctccttacttcccgtgcaatctgaagcagaggtgttattcctgtttatgaggtgaagacgccataactcagaaagccctaccctagaaataccagactcaggaccctagagcttcatagccaatagtctcatagcatcctgccatcttttatgatgtacataaaaaaatagaaatcacagggagaatggcctgttcaagtgacctttactagactgtgatatcactcctcacccccagacagatagcacacatgaggtagcacaggtcaatcttagcagacctggttccttacctgttaggataagacttaacgcctagaatttcatgattattacactagttactgcatgaaaaatgctcaagacagagcagaaagcatgaagggtaaggtattgttgttgacattttattagggaagtgaaactcttatccttaattcaaaataattaccaggtttcaggaacatggagcttcccactatgaatccctaatccaaacctagatcacaaaacccagaaacgggaaagcactggacagaggaatacagtaaaactgcgaagctggttacctgaattgttttctcttctgcctccagtggacttggaaataaagttcagcattaatgatgatgttgcatttaataaaacactggtttcatgactcctgggatactgtgtgggcaatacttcccctccaccctccagagataatgaaggcgaggaatccaatttgaactccctgggagaatggcaggaaggctaagctacatttggcactatattagaactttccctataaaacaaggacactggttatatcagtttcatgggggtacagttgtaaggtatcagcatagggcatttatagatttgaaatccatggttttccatacctatactataccagcagctttggtatagaagcccataggtcctatgggctagccaagcttcacatttctcaaatagctttggagacatattttagttgggtggagaattcattcagaggaggaagggaagtgtggaaaggcactgtcgttcgttacacttactatttccatcctgttatgggggcagtttcccctatgctccagggttccataggagcagacctagactgcaaagtgtggttacagacagaaagatccatgcctttccatgttgggaagcatcaactaattgtatccttaggaagtctgtctctataccagttatactgccctgccctgcttgagaaaagcaaagccaatcagtttttctgcaggcaagtggaaagtcagagaggagggcaagtaccttctataagccagaaatggtgggaggggggtgctagaaatcgctaggaaagaggtctagtgtccccaagaaatctagggcagctgcttaatgtaagaatggtccctggggtgggaatgtggggagaaggaaaagcaatgaaaaggccactagagccttaattgaggaagacatcagaatgcttgtcacctaagctctacaccttctatatttgaaacaggtatttcccagccaggatagtacaaagtgtataaattgggcaccaaatggatgtgattttgaattctccttttatgacttcccacctgaacaaccttgaataagtctcagtttccacctttgcagtatggaaacagtgggaactactccctaagtctgttaaccaataccagttccttctccatctagtcccagggtggctgggttatattgttgacctattaactggaataaaaggggaaaaaggagaggacaagatatattagaggaaatcaggaatgattttatggttgtcaaaagcttttaggttcctagagacactttgactttcctgggcctttgccctgggaaaaaaattaaagaggtttcaatgctcgtgtgcattcccacattacataggggagctgccagtcaccagagtttgtttgggtaacctcagaaagaggccacagagacaaatctcctcccagcctctggcagacatataatctggagttatttatgccagcattccttccccaataaaaaactctctgacctggcttgaatttttcttgacgctttcaattaaggaaataacaaaaccaaccctgtcttatacatggttaggtctggcaaaaatggactcagctaattacaaatttggccctggcggttttcttaagatgccctacaggcctgggtgtgagtggttataaaaatgaatgagtacaattattttgcaaaccagcctaacagtttagttcacattgcttctcgtctttcctcatcaaatcaagcatttgaattgcagagaattatcttccacatgtaagaaaacatatttctaagcattgcaaaactggttccttgctgtattctgatgcattatcatctggttgaagtcacatatctgtctatggaacatgacaaggacaagggagaacggtgctcacattaggttctcttcaaagtgacatgcagttagaaaacatccacttacccctattgtagccaaggctactagtacttaaatgctataccactgaaaaagtaagtggagacatcaatttttttaaataaatgaatctgaagtaccaccgaatatagaaaaaaaccatatctattgttcaccaggttggagagtagctctttcctcatctaactcaacacgttcaccctgaaggatttcatctgctcctgggatgcaagtcaccctctccagtccagatttccctcttgatatttgaatttgcatgctcacttttcaccagtctctcctctttcatggtttagaaatgcaaaccaccaaatttggtcaactctactaggtgtctttcagatttagcctcctctcctcactgatatgccgcttgttcaggccaccattatctccagcctccatgactaaaacacctgccctgttcctgtctaattttcacacttcctgctacagaaatgatttctaaaacactttcaatgcctttatattgtcttcagtgtgatattaagactccttaaatggcataattggctaaggtgttatgtagcagcctaggttctagttctatgaacgttcactaccccttctacctaggttggccacttcaaatacagcccctctcctctccagccttggaagatgagtaagagctcagctttggagacagacaggctgggaccacagcccaccttagctacttggtgcctatgcaatgttgggagtcactaaatgtctctatctgtaagatgaggataatggtaatggtaatgcccttctcctatcactgtgaggagtaaatgagataatgggtgccaagcactcagcacaggcctggcatatagtaagcactcagtcaatgctggctactatttcttttttttttttttttttttttgagatggagtttcgctcttcttgcccaggctggagtgcaatggcacgatctccgctcactgcaaccttcgcctcctgggttcaagcgattctcctgcctcagcctcctgagtaactgggattacatgcatgggccaccatgcctggctaatttttttgtatttttagtagagacggggtttctccatgttggtcaggctggtcttgaactcccaacctcaggtgatccacccgcctcggactcccaaagtgttgggattacaggtgtgagccaccgcgctcggccgctggctgctatttcaaggctagtactcaaggttatctacacctgctgtactcagggtccccataatcacaccaaattttatgaagagatgcctcctttgagagggtaaattacaaaaggcttctttatctgggctgcagacagtgcttggcatccccgctcgtgccagactcctactcatcttctggaattccccccagatttactcttgccttcttttactcacccaaactcaatatggcaccccccccttgctcccacagtaccttgttcacccagcaatatgacacttatgacacttattctccatgttgcttctcctgactacttatccccatctctctccctacccatctcctatttaggctgggttcctaaaagccagggactgactcagtcttgttcacagttatatcactcatgtctttgcacaatagatattcattgaatatttaccaaattaatgattatcatccttctttctccaaataactcttacaaacctaaatttcctgtcactctaccatcaaacaagtggtttgctctatattttggtgacattcatactttctttctccatcacctgcctttttacttctactccccccaaacccctgcacacacacccctgaaatccctgtgctagatggaccatccaactctatttttgtttccaccaaatatttttgagcacctactggtgtcctcgcacaagattggatgtaaagcctaaaaccataaaaaccctagaagacaacctaggcaataccattcaggacataggcatgggcaaagacttcatgactaaaacaccaaaagcaatggcaacaaaagccaaaattgacaaatgggatctaattaaactaaacagcttctgcacagcaaaagaaactatcatcagagtaaataggcaactacagaatgggagaaaatttttgcagtctatccatctggcaaagggctaatatccagaatctacaaggaatttaaatttacaagaaaaaaaaacaaaaaaccccatcaaaaagtgggtgaaggatatgaacagccacttcgcaaaagaagattctaatgcagccaacaaacgtgaaaaaaagctcatcatcactggtcatcagagaaatgcaaatcaaaaccacaatgagataccatctcatgccagttagaatggcgatcattgaaaagtcaggagacaacagatgctggagaggatgtggagaaataggaacacttttacactgttggtaagagtgtaaattagttcaaccattgtggaagacagtgtggcgattcctcaaggatctagaaccagaaataccatttgaactagtaatcccattactgggtatatacccaaaggattataaatcattctactataaagacacatgcacacgtatgtttattgtggcactattcacaatagcaaagacttggaaccaactcaaatgcccagcaatgatagactggataaagaaaatgtgccacatatacaccatggaatactatgcagccataacaaaggatgagttcatgtcctttgtagggacatggatgaagctggaaaccatcattctcagcaaactaacacaggaacagaaaaccaaacaccacatgttctcactcataagtgggagttgaacaatgagaacacatggacacagggaggggaacatcacacctgggcctgttgaggggtggggggatgggggagggatagtattaggagaaatacctaatgtagatgacgggttgatgggtacagcaaaccaccatggcacatgtatacctatgtaacaaacctgcacattctgcacatgtatcccagaacttaaagtataattaaaaaaaaaaaatactcagagaagttccaaatgctgtatataaataaatacaaatcttatatagaaataggatttggaactatatacatgtatataaacataaaaatgtatgtttatatatgtctataaagagtgaaacaattaaacttcttctataaaaaaaagagtagggataaaaaggcatataaggcaaagtcattgccctcaaattgtttacagtaaagtggtgaaggcaggtatataaataagtataattccatgtagtttgtactgcattagaagtatatatgaagtatacagtcagcacaaaaagatcaagagttctgagtagaaggtcaagaattgtagcacagaagacacaatcttctggctcaccctactgagaagaggtgatatttaccaatgaattgcagaataggagttcactaggcagcgagataggaaaaggcattacaggcagaggaagccccatgtataaaaagtcacataagcacaaaatagcagggaaagcaactaattcaatatggcagggaatgtgagagggactggagggaacagggaaggctagagaacaggaagggtctaatgacaaagggaagaagcttgccctgagtgctgcagcattttgcttagaggatgttaaagcaaaggaggagattctggcagctgtgcggaagacggactgggatggggggccaggtagacaaagagacatcctaaggaaactgaggcccactgctaacacagttctcagtgtgcttaagacgatttaaccttgtggaaaatactgccaggaggatattttctaaggaatttgtttaccaaagaatctgaacccaatgatgaaccaatctttcgctaacaaagctagagaactcagaaccatctaagttagcaagtgttaaaacactggaaagcaaatgtggcaacagcactttcctatttgaccataatcaacatcaatgtggaaagaaaacaaacctgaaagcaagtgaggaaaacacacagtgggtttctttgctttctctccaggacactgtcagtacacagagcatttagaatagctgatttgatcgttgtgaaaatctacctgcgtgcccctctctctctctctctctctctgaatgcaattagagaagacagcttcattcacactgtgtctaaaaatagatgatggcagagttcacagactgacagctgcattgtcatacagtaaccaggaaaggaaagggatggctaatttaacttaacaacttccaaaacaaacagtgcagagggagtccaggataaagaaaaaacacacaggtcagttcttcaaagagctggcagagggatggggtcgctccatggcagtttattagtcctcccaaaatcctgacgaaaccagctaagtattttgcccagatctacccagagtccttcagacaagagctctggcagatgaaccgctacagagattcaggcaatattaggcagcagggccaggactttccctgctgacttcttcatacatcccctggacacaagtaagctaagaagagtcatgacgtttttctaggcaagataaataaatgagttttttccccctttgccatatctaaattatactctgcctagcctggggcatttaaaaaaaagttatccaggaaataaacatgcatcattaaggggcagaaaccaggtgtctaaaagaagcaaaccatttctttccctcccttcagtcctaaaatgttttctgttttcctcctcagtctgccttgcccagggaagggattacggttgggcttcaaaagaaacaagggaataatgcctgtggacgggtagcagattctctctgcagctctcccgcagctccatgttggctctcagcgctgctgccagccagctaaatgtcagatcacggcaccccaacattccctcactgcatacctccatcgccctggtgactaagctgtttcaacagctgtgttattgctggagtcaggccagtgttattcacacgaagtatttgtttcatacggcttatgtggggaattattgcactcagctttggggttctatttaaagataaggtccttcccttgatcaatcagccaggacattcctcgagttgggctccaggagacagtgggacaatattctactgccacccggggttccagataatggacagattcataatactataaagaaggtggatgaagcatatgtgtgtgtgagagaatgggaagcataatggaaaaccatgacccttggtggagctgcggaagaactctgctgctcctccctcaataaaagccacccacaacacaagagtgttaagctggactccctttctgctcttcttctccagccatcaccctcagcctttcccttaaaatcattgctctttcctttcgggtcacgctagcactgttgcgttggtctctacatgcatcactccacacacctgccccgaatgccatctcctccctcagcccttggcttctcctatctcatcaaatggtttatgaccattgatgttcctatcatgtaggaagcaagttgggcctgttggcctggtgacctcctccactactccacatcctcttctgagtgtgagtaagataagggctgtgttactaactgctgagttaatcaacccaaactcccttatatggagggacaactgggaaaaggaaaaggcattacatccatgagctttatgtcctgtaggtgggactaatttctatttctagctcattctaggctgaatctccatcaaagaggcctactggcctgttctccctccaaagttgttctcaccaagagcaatcgggcaccattttctgatgctgaaaagatctcagaaatatgttttcttataaatgaagtatttttaaaagaaataaaacaatgattcctaagagctcacattttttactgcctactatgtgtagacattttcacccatgcagatgccagccagatggaaaccatcacaggcaatttcaaagtgaggaaactgaggcccatggccatgctaccaatgtgagagggaggcaaaatgagaacccaggtttgcctgactcagcagctcaagtactttccccttatgtctctcagtcatggggtaggaaagttaggacacccgcttcttgctctaaaaaggccactatttagccaaacaatttgagtaagtcactttacataatgtattatttcatgaaatactacagttggatcataggcttactaagatcctttctagttctaatatttcatgaatgtagaaatctaaaacacctccagctgttgactgccttctatacttaaggcactgaggccaaaacaaagagctataaaaccatgcctgtcctcagggcacttataatggagtttgagtgacaaaggataacaagttgagtttgactaatggaagagttaaacaattaacaaatacaaaaataccagagaaccagactacagggcagtgcttgagaaataacaccgcataccagcatgactatacaaggagaaaagtagatttcaacaatggtaacacccctaacccggaaaatacatttgtgctgccagcagaaagaaaagaagagacagaaaacgcttgcaggaaaagccagctactagaagggatcccgtctgtttcacaggaaagctttgtttctgacaagtttcgtaaaggaaaaagtaggctagaacaagcttttttatttccaacccaccttttcttcgttcccatgaatgaggaggggatacaaatgagagcaggcagccagggacaaaaataatatggctggtggttcctgacctcttggattcctgccaacagagaagcctgagaggcaacatttaattgtggaaaaaccagcctggctctcctcttatctttttcctctgtgacttaaacccacaattactggcaacccctagattccgagtcacccagctggtggtggcagcaatggctgtgtctgtagctgaaaagcaaaagggagtcagattttacctgcctccgaagccagccctgggagcacagccctaacccagcttgatgacttctcccattaaaaggttcacagatgccctcccgttgggaaaaccaccaagtgagaagtccagatgggaaaaaaagaaacacgattttcagctgctgtataattcaaaggacaagctacgagtctcaaatcctgaattccacattttatttcagcactagagatgtgatgttcaattccttttcttaagaaacaaactccaaatttcttagctggtcatcaaggcaactcacctaccaggccctctgtctttcagcagctcatcttttttctctaatatggacacttttctacagcccaacaaatgggcttaccgtcctttgcacatatgttatttcagagcatttcatgatagaaaaatatggtcttagtcctcactttctcacctagaaatcactttgaagaagtcacttaacttccataatttcatacttgtttaaatttaaaactttttctccagtaacagcctcacagaggacagtagagatttaaccttgaacatctagcattgagcctgcagaggagatgcataatcaacgtttccttctctatacctaatgcctttgctgagttaccttcatccaaaagaatgttcccattgctaactcttgtcctgatcttttcttaccactcttccactccaagaggttgtctcccatacacctctgctcccatcttaatattcttccatttcaaaatattttaatttacatgctgctatgtttatagtcaaatataattaaatcatgcctgtgggcacattctcctaaggatgctaagaattttccacatcttctattttaggactttatccaattgcttcagtgctgatcagcatgcattttggtactcatggggcataccctcatcgggattcataaacctctgaattccatgggtgagcttcagggcttccattgaaatatgaatactaaatgtgcaaatggggtctatgcatatttgtctcccaaggttaaagtccttgacctgaagttaataaccactgtccggaagtaatgaaaggcctgtggctaacatccatggacggggtcctttttctgaacactcagccctgccacctatgtttctgggcttctatgctctctctggaacacaattcctcctttctattcaagtccgagaataataactactcactcttatttatttatttagagacagaatctcaaccaggcaggagggcagtggcgcaaccttctgggcccaagcagtcctcctacctcagcctcccaagcagctgggactacaggggcacaccaccacatcctgataatttttgtattttttgtagagacagggtttcaccatgttgctcaggctggtctcgaactcctgggatcaagagatctgccctcctgggcctcccaaagtgctgggattacaggtgtgagccactgcgcccagccaactattcacttatattgagcatttactatatgtatccagcacttactatgtaaaagcctcacatacactattctagtttaatccttacaacaaccctataaaggtagtactactattctattttataagtgaggaaaatgaagtacaaggaagtttcaaaaacttccttgccaagggtctcataatttataagcagcaggccaaacattcataatttatgattcagcccaaacactctggcttgaaagtacttaacccagtgctggagttgtctctccaagctctttcactttccagaaaaaaataagactgcccttggactgtttctttgccttcacattgtaagtgatcacagattccaacgcctttaaaactccacctttgactcaatcaaaacatttccttttccgtgagttaatcatttccccttctatgtttatggactcctttgggtacttaatgcactgaacacactggtgtaattttttaattctctctccatgaattagactgtgagctcctaattattttgagtacacatggaatatttactgtgcctggaattgtgctaaggatataacaatgaacaacacagtgtccctgcctttaaataattcactcttaggccaggagtggtggcttacgcctgtaatcccagcactttgggactttgggaagccgaggtgggcagatcacaaggtcaggagtttgagaccagcctgactaacattgtgaaaccccgtctatactaaaaatacaaaattagctgggcatggtggcacacgcctgtaatcccagctactcaggaggctgagacgggagaatcacttgaacccaggagggggaggttgcggtgagccaagatcacgccactgcactccagcctaagcaacagatcgagactacatttcaaaaaaaaaaaaaagaaaagaaaagagaaaactaaacaaaagagggttatgatggtttctgaaattgtattatgaagaataaggacttatctttatttcttaaatcctgagcaaaatgctagcatgtagtacaagtcccaataatgcctatcgaatgaatgaatgaaattgggaaagggttttcagatactgaactgctaaactgaaagatctaccatcccatcatgaaactctttgaggttatttatacactgactcacctaaaaactgcttcctgtgttggtgtctatgatacattttttaatgtcagactaaaaatacacttccagtacaccaaccctgtctgcctacctaaggagtagaaatgaacacaaggtcgcatgtaacaaaagaaaagaaaattcactcatttcaacactaagctcaccctctaacaagagcatctgtcttgactgagcactatcttctagaatggttttcacttgagggtctctgaagtcatctatttacaaaaccaaaggataccaatgagattttttataaagtcagagaatcttaagtgagtcatggactctcaacttcagagagttagagtagatgggaccttaggggtcgtctagtataatttcccactcagaacaggaagcactccatagccctgtcaatagactcatggtgggatcaaggcactggagtcctaacatcatgtacactcatagcctctcgacttcccagctgggagactggcaaatcatgtaaactctgtcatcctcagtgtcctcactctgccagatataattgttccgatgatcagatgaaataaacgttgtcttaattagcgaacatttgtttgcaagtaacaggacttcacccccactaacttaaccagaaatcagctggagggatacaggagtgctttaggaaaatcaagggcagaaaatgctgagaagctggagggtctgaaaccaggaatagaaagctgtcaggaggaaagtcaactcttatagtctattgtaattacactaatagtcttcatctccatttcctctttgcatctggtcttcccactctgccagtcaacaatcacggcttctctgtgcacgtgtagaatgatgactgcccaggtggctctcatggcttttcagtttaagtgctaataaaggtagatctcgaattactgaaacacaatttcttataagagagaatttgattgcttcccctttggccaagggaccactgctagtctgatcagttatggcttggggactgatcatatggccagttgcccattcagtagaggtggtggaacatgctgagggagggggaagttaaggccaagttcaggccaagcaaatgactgacaacaaagacaagcaacagcatctctagtgcgatggtactttgcaaagaaagcactgccccatgccagctatcactgtggccatccttatgatcctcaccaaccatcttctgcttgaccactaccagtaacaggctgctcactactggtagaggcaaccttttcatcagcaaacaacttcagctattagaactcttttccatgtgacagcaacttaagatactaaactgaaatatttgtaatcttctcccaagccttaactttaatgaaggcataatcttgcttgttaggtcaagcctgggcttttctttctagtcaaaatatgaataatgggcaaagcaagatgttgaggaaaagctgagtgttgggagggaaactgaggcagggcttgcataatgtctttgggaatgtgtctagacttgctggttccttacttctagccctcataggctcctaggctcctattcccattatctcaagtagcagaacatgttccatataaatgctaaaccatcacagctgtagatcatgtgcctgctcttttgacctccacattttcaccacctgtttctttgttggattaccaataaatagcatgggctcccagagctcagggccttcacagcctctgtacactagtgatggccccctggtgtcccaactttctctctcaaactgtctttttctcaatcctttgactctgctggactttgtcacccccacaacctggtgttgggtctgatcaccccaacacaagagagatagattcactatgcaattattttagcaaacaacctggaccagaacaaagccagaacctcttcttcctataaagaattactactatctctctactaacaccattactaatgactcactaaagcaaaagaggatctggaactgtttctagcatcagtgtgtagacaataggtagggttggggaaaatggttttttccaatgtagagtccctagcacttttgcaagcagaattctgccttgctctcatttaacttccttttgcttagaaaaatataatccagaaaataatcttaacttcatttttttaagttaaccaagataaagttgtgaattccccataaaagaacctcataatagctatgttatgaccagctggcatttaaatactgaaagacccaaagttagaagaggaggtgaaaacaaaaaaataccttctatacattgggggcaccattaagggatgtgctgcttctggcttctctgctcttcacattagtcaatgatgtcaccaggtttttattttagtaatcaggatatacttgtatggatgcaaagagaatatcctcatttatattctaaactcagagcaggaaatgagacacgtgggtgatctgcagctgtggcactataaacagggccagcctaccacctagtctagattctagactgcacttcattccctgaaatactgattgggagattttaaaaaattgaaaatatatcattttagaaagaccagtgcatcttctgtgcaaggatcttagagtccgctgtttggtagaaggctgactcacctgtatggggtggtgcacgtgttgttaggtaccatctacctatctacaccactgatgtacaacgaggagatcctgccctggctccagccagctgtgccaccgtgggcgagtaccacagagttcaagctttctccagctgctaaattaaaggattagtgctttaacttgggtcaaccacccatttgcaaacctgacaagaaccacaaacactcttacttcaaaaatgcatataagcaaataccactgaaattttatgtagagtatcaaggggttctcttagcccttacactccagtctaaactgcttggttgatgattgttagaccagcagccctctagtattcctttcagcactccaagctaaaataaaacagctgatgtttagtaacaatttctgcaaattattcaacaccatagaagagtgttttgttaagactagagactaatctaacacaatctactcaacaatgttaaattgaccagtaaccaatagatgactagaagaaagtgtatgtaactagatataccaaactatagatactaattttaaaatcttggaaaggttttggaggagccctactgtttctgaattggaatttttcatttgcaaatacttaacaaaacccaccaagccagatagagctctatagcgatgcctatggaggagccttataatgatgttgtccaagtaatgtgcttaacaataatcacactcaaagccaaaggttcccatgctcctgccaatataacatgctcacaacggtcaattccaaaggaagagctgtcaagaagtgcctgaagatttcctcaaagggagagataattcatgagcaaacaaacatcatgtccctaatcttctctatcctggggtaaacaaaatatagttttctcccatgatttcagttgctttctataccaagtcagtaagtaaaactgattcatactggtaacttccaggttccagccttggtttgaaggggcacacaattcaataagagtaaagaagactggccatgtaagcccatcttgaatactgacaacttccgtaccatttacctaacactacaaaccctactccatttaagtctctgagatctttttgatgtattttgagcttttcaacttgccttttttggtgggagaggagggaggaggagaacaaagggagaatttgaagtttttatttctgcttgcattgactcaaattgtggtaaagaaacttaaaaggtaactttaaaattctagtgacactagccaacaatgaaaactatctaattagaatgttagaggttttttttgtttgagacagagttgctctgttgcccaggctggagtgcagtggtgcgatctcggcttgctgcaacctccacctcccaggttcaagtgattctcctgcctcagcctcccaagtagctgggattacaggcacacgccaccatgctgggctaatttttgtatagacagggtttcaccatattggtcaggctggtcttgaactcctgacctcaggtgatccacccacctcagcctcccaatgtgctgggattacaggtgtgaaccactgtgcccagccaaaatgttagatagttttaacacaggctataacatagtcataaattaaagaagacatggtcgtaaatgaaagaagacctctttttggtgggagtagtagtaggggtgggagagtagagttatacatttcttcttagcagttgcttcaacatattttattaataaggactatctgctgaagcacagaaatacaattatgtgaatatcatactaccaatggcctgttccatcatagcagggatagttcttatagtgtataaaatcctctgccccattcagctctctttatggagctttcctcagaagcatcagaaaacacagaattaaatatcacaattcttgttgaaggccaaaaattagttcccagaaggattctttgactttcatccttctacaaattcacccatcaccattgtagataatgtgaggggtgaatttgtagaaggatgaaattcagagaattgtttatgatcaatagattgttccctttattccagttgtcttcccttgatgtccacttaacattccataataaatggacaaatggaaaagcacaattactctgccaaaagtcagtcaacattctcccaggacactcagccatctaacttgaaaactgactggtaataatatcattctaattactttaactagaaatttgttatacagaaatgctttcagtgtggggaaagaaaaatcacttgccacttatagaaagaattctgcttcatgtgaccatttgcaataatgaaacaagtaagacaacactgggttccagtgtacagcacaaggatcaaggcgaaacataatgctttcattacgtaagaataggactgacattattctggctttcccctacccttcatcatttaccaatattttttcagtctcaggaatttttcaacccctgaaactcctagatttactactcaagacacagctatccatcttgaggctttctgccaatggctctagtgcttctatttcaacagcttatagatttgaaagctggaaagagagatatgtaaacaaattctctaactttgatctatgcacccaggtttctcaaaagaagcccttggagagtctggggtatactaagtgtatgacttgcagttgtaatcattagagtgacaacccatttccagtgggtaccgttttagccaacccaaacctttcttttcctaatgcatagagtgactttttaaaaaatggtatatttgggaaagtattttagaatggcatgttaacaaaacaaaaacactctagaatatattttcaaataacagaacttggccttaccaagaggtctaataccatcaggtaaataatcatttttatcagtgattcataatacatccagactctaaatgttaaggctgacttttttctgacactcttctctgcctattcatactccatttcctaactcctttagagtaaaaattgaaatcccatatccctaacaactagacagaagcatcatgtttacatcctgacaaattcattaattctgtacctctgaaatatttagcaaaaagccagcactgactcaatcatagatttccacagacaggtctgttcatatttgtaattggtattcactgaaaggtcaatgactcctgttcccaagtatctatgagtctctagattttcttaattggcctcttttcctcagctcttacagactattgttttaaaactaccaccatttagaagttgaactccgagtgaggggaaaaacaaacaaacaagcaaacaaaaaaaacactttttgattcccactccactcataatcaacataacacagactacttctgacccaggtgtgatggaaggagcggggcacagagtcgggggaggtttctccacacaccaagcaagcaatcaatcacttccacagcagacatcagctgggtgtccaaaaattcaattttgacaccacttacctggaaatagcatcaagtctcataggttgaaagctcagtcccataagactgctccccacttcagatgcccatcgaaaaaacaggttgtggcctgttataaatacgcgttcccatgaccctcctccttaggattgattgatttgctacagaggctcacagaactcagggaaacacttaacttatgcacgttataaaggatatgacaaaggatacacatgaacaaccagataaaagattgatagggtaaggcatgtggtatggcagggatccctgaccctctggcagcagacaggtaccagtcagtggcctgttaggaactgagccatatagtagggggtaagaggtgggtgagcaagtattatagcctgagttctgcctcctgtcagatcagctggcattatattctcataggagtgggaaccctattgtgaagtattcatgcaagggatctaggctgcatgctccttatgagaatctaatgcctgatgatctgaagcggaaccatttcatacccaaaccatcccccatcccctcatctgtggaaaaagtgtcttccatgaaaccggtccctggtgcccaaaaagttgaggatggctatgataaggcacagagcatccctgtcctctctagggtgccatgctccgggaacctctgcaagttcagctgtctggaagctcccagaacccagtccttttgagtttttatggaggcttcattacctaggcatgactgattacattattggccataagcgagtgactcaatctttaggcctcttccctcctggctgttggtgggtggggctgaaattagttccccacccttctaatcatgccttggtctttcaggtgaccattctgaagctatctgggagtccccagccatcagttgactcattagcatgcaaagaggcattcctatcactcaggagattccaagaattttagaagctgtgtatcaggaaatttattactataaagtaccttataatgccatcatttttctcccaaaggcactggcttgattaaattcagaaattaaaacaatggccagcttctatagtgtaagtcaatgcttttctagttttctgagggtttggaaactcaaatcctagctaaaacctgtatcacttttaaattgaaaaatttaaagggaataaacatttaaccccaagtgactagaagtcatttaaaatatgtagtacttagattattttatctactcaaagactcttcaaaagtagatgaaaacactaaccagatatatattataaacccaagctttaatttcagagcccaaacatgaaatctcttctcattgtttgaaatctgaaactcatttcaaagactgccacgaaaagttaaaaaaaaaaaaatggattggtcttgacttttccttacatatgaagtaatattgttacaggtgaatctctgataagcaggaagccatcatgtgtaataggatcttgtttgccacactcccaaactcttctctgaagtcctgttcattgctgtcagaaaggaatccaaagtaatgataaacaatataaaaagtagagagtctcatgcattcttaataccaaaatcagagagaaatctagacctgatgtgcctgttatactaaaacatgtgtgtatatgtatattgctgaatatatataacataatatatataatctgtataatcaatgccttgctcagtgtccataagcaaaggtagagaggataaatttaaggaaatgaatattcccacaaacacaacatgtaacttctcatataatagttagcagctggccaggcatggtagctcacgcctgtaatccccgcattttgggaggccgaggcgggcggatcacaaggtcaggagatcgagaccatcctggctaacacggtgaaacctcatctctactaaaaatacaaaaaaattagccgggcgtggtggcaggcgcctgtagtcccagctgctaggggaggctgaggcaggagaatggcatgaacccgggatcgtgccactgcactccagcctgggggacagagcaagactccatctccaaaaaaaaaaaaaaaaaaaaaattagcagccaaaatgtgttgctgctactcatgaaaagtattttttggtgtggttttcttgatagctctattaagaaagttattttatacatttatcaaatgaataattagtggtccatcttgttaactttttagtatgccccctattaagtgctagttctcatgttataagaaaattaaggattatttttaagtcagaaagcttgagtacagtatttttgtagatgaagataaaatattttaaagcatgaagatgtacatgagaaaaaaataagacattaatatttatatatagaaatgttttaaagctttgccaacatgggcatttttgttgtttaggattagtatttgctgggaagtaattcatctgtgaaattatttaacatgtagaattatttcttagtttctggtttgggagaaatgctcaagagttgagcttaaaatcattttattcacactgctaaagctgaaaaatgtaaacagggagctttcaatacatttcaaatgagtttggagaattctaaaatattcaatccatttataatgaatacaaaacatcattagaaactggcaaaaaaaaaagtagctaaaagtattcgagttatttcacattactgggaaagtttcttttaaaaagttcagttataaataacattcactaaacatatttatccttttttcaattttggtggtataattttagaaatttatcgttgacttttaaaatttcacctaaacttacctgaggctctgcattatgttactcaatgattctgatgccaagttttgaaatcaaattataggccagtcaccttcagtgatgtaaaaggtagaaccacaagataatccagcactttcctcacaacctgaaaacggaacctgtggcaagtacctgcccaagtgtcagactatgctctaaacaactgcctgtcatgtaacaggctgctcgaaagcagcaacatactactcctatagtcaattcttaacttcttaaccacaatttcatcagtgtaaaaaatataggagcagtggggaccagacttacatatactgaaatgttaaacaacagaactcttattttgaagtgtgggaggggaggaagcacctcaatcagttgctttatgttccttttagtggcagaagaatgatacaatccagtattttcatccacagctccctaaacacaaagctgtggatttcataaatgtaaatatactgcgtaatctgcccactgggagttcatagtttagtaaggactcagagaagacaatttcactgtgcagaacacaaggctgataaagtaaacatcacaaggccagtaatgaagaatgcgtaaggaaagacagattatatccaggaaggaatgaggacgggagataatatagaaaatacctaggaaggctccaggggaatgtaaaatttgggatgttgtgaagaatgagtaggtttatctgggaggagcccttcatttgtgagaagaggaatcacaagagaggaagaggcaggcaggatcaatatcagcgaagacgcaaagggagaaactctctggatgtgtttacagggcaggaaactactccttttgaggatgcagagaatggttactggccagcagtgaggaaggaggctagaaagaagccttgagccaggaagcgagaggactctgaacaccgagtcttatttgttagtcactgaagatgttttgagcaaggaaatgataaattaaagctaaaagagtctcctccttatcagaggtttcaccttcagtggtttcagttagcagaggtcaatcacagtgtaaaaatattagatgaaaaattccagaaataattcttaagttataaattgtgcactgttctgagtagcatcatgaaatcttgtgctgtcccctgataagaatcacccctctgtccagcatctccctgctcctgcctgttagtcacttagcagccatctaggttactagatcaactgctatgtattacagtacttgtgtgcaagtcatccttattttctctcattgccccaaggtgcaagagtagggatgctggcatttcagatgtgctaaagagataagtcaagtgcttcctttaagaagatgaaagttctcaacttaaaagaaaaaaaaatcttatgctgaggttgctaagatctacaataagaatgaatcttctgtccttaaaattgtgaacagtatattttttctttcattattaattattgttgttatcttttactgcacctaatttataatttaaactttattctaagtatgtatatatgtataggaagacacatcatgtatgtatatagggttcagtaccgtgattttaggcactgggtggtcttagaacatatcccctgtggataaggaagacttacctctaccacgtgcttcttttataaagactaatctcactaaccaaggtgtagaagtaagaattggaaaaatggctgaatttcagcaataaggataaatataattggataattgtaatagctacttttaatttttaactgttttaatagtacttactatgtccaggctgggtgcagtggctcacacctgtaatcccagcactttgggaggccgaggtgggtggatcacctaaggtcaggagttcgagaccagtctggccaacatggcgaaaccccgtctctactaaaaatacaaaaatttagtcccagctactcaggaggctgaggcaggagaatctcttgaacccaggaggcagagattgccgtgaaccaagatcatgccaccgtactccagcctgggtgacagagcgagactccgtctcaaaaaaaataaataaaaaataagtacttactatgtcctaaaagttttacataaactaatttattccttagagtgagttggttaattaggcattattatccatattttacaagggaggaaactggctaagagcggttctgtaacttccccaatactgcagagcttttaaaaagtggcacaaggatttaaacccattgctgtaggactcctaagtccatgctcttaaaaaactttctatcttaccccctaatctagatataaatcagggatcacatttcaaatgaaactgtgactccattgaaaagtatgccagcaggtagtcagcctctaagatggtccttaatgatccccatctcctggcattcatgctcttctgtaatcacctcccttgagtgtgggttgaacttactagttcacttctaaccaacagaatacagcagaagtgatggaatgtcgtttgcaagattcagcggtttccctctccagcactgctcaggctctctcttggctcactatccctgggggaagcccgctgccatgttgcgaggcagtcttatggagagacccatgtgggagggatggaagcctgccaacaaccatgtgagagagcttggaagcagatcccccttccccggtggagccctcatgcctgatgagactgcagaccaggccaacagcttaattgcaaccttgagagagtttgagccagagactcccaaactagattcttgacccacagaaatgaggagctaagaaatgtttataggtggccaggcacggtggctcacgcctgtaatcccagcactttgggaggccgaagtgagtggatcacctgaggtcgggagttctagaccatcctggccaacatggagaaaccccgtctctactaaaaatacaaaaattagccaggcgtggtggcacatgcctataatcccagctactcgggaggctgaggcaggagaatctcttgatcacgggaggtggaggttgtggtgagccaagatcgtaccattgcactccagcctgggcaacaagggtgaaactcagactcaaaaaaaaaaaaaaaaaatgtttatagttgaaagctcctaacttttagggtaatttgttacccagcattattaatacagtcagtagacagtaattatttattattacagggtaaatctttttctttatacttggagctagaagtagggatctgtctaggagagattatacctgaaataaccacaaccagcccaaataacagaataccacgtcctttacctttccacccaaacatacataaatcaggtaatctacctatctcatcctcccatggctcttcttgttgtccttattctcctttgcttgaatgcattcttaggaatagaaatgctaaaacccaaacctgcaggtttcaaaaaaaaatttttagacatacagttttgaatctcatagcaaactctttccttcccaaggctcctcacattacattgtgtattcttattatagcacataacatgttttttcttatttgtaggtttaagtgtctgttttccaggcaccctcttccctaacccgttacaagaatcatgtctcgtgtgatcttatatccccagtactgagtgttcgtatggctgggacttaataaagtttaaatgaactcatgaataaatgtgttgcacaaccaatgagtgagtgagtgaacaagtgagtcaataagcaagagtttagggacatgggaaccaccacttaaaagcttgaggctgttgtgcaaatttggaccttcatataagccatttccttctatatagaatgctctttcttttgctcatcctcacctcctcaccaggcttttctctctttaacattcacctcaaagagctgtctgattgcctctctacaactctccccgccaacacacacccacacaccctaccagggaagtcttccttttctctgctgtgaagccttttctttaagtttccatatcctcctgggcataacttggtcacagcacccagcataccacactgtaatgattagttatttgcctgtcatttccacttagccgtaagttccttaaaggacagcatattcagctaacagcagaatgcctagcagtggtaggcactcaaaaacagtttaaaataatgggcaagagaatgaatgaatgagaaaaagaaaactgtatctagaaaattatctcagcacaatctatttatttcaggtaagctatcagtcaggtatacatagtgctccaactcctaaacagagtaaaaataattgtacatcaagattattacagatacatgaaaatcatatttagaaatagtacttcagatcaggcatggtggctcacagctgtaaaccaaaaatttggggaggctaaagtgggaagattgcttgagctcaggagagacccccataaaattttaaaatttaaggccaggtgcagtggctcatgccagctactcaagaggctgaggtgggaagatcgcttgagcctgggaggttgaggctgcagtgagctgtgatgacaccactgcactccagcccaggcaaaagagaaagaacctgtcacacacacaaaaaaaaaagaataaaaaattacaaaattagcgtgcctgtagtcctagctattcatgaggctgaggtgggaggatagcttgaacccaggagttcgaggatgcagtgagctatgattatgctactgaactccagcctgggccagcattcgagatcagcctggggaacataggagactctgtctcttaaaaaaaaaaaaaaaaaaacagaagaagaaagaaatagttttcaggccaggcacagtggctcacacctgtaatcccagcactttgggaggccaaggtgggtggatcacctgagatcaggagttcaagagcagcctggccaacatggtaaaaccccatctccactaaaaatacaaaaaaaaaaaaaaaaaattttgctgggcgtggtggtgggtgcctgtaatcccagctacgtgggaggctgaggcaggagaatcacttgaacgcgggaggcggagattgcagtaagccgagattgagccactgcactccagcctgggcaacaagagcgaaactctgtttcaaaaaaaaaagaaaagaaaagaaaagaaaaagaaataatgtttcaatctatggacaggccctagacagagctgcctttaacacatctttttccctttccctcacatccttgatcccatctcagtcaaaaaggaaaaaacaaaaagttttcttacttctcagcctaagattcctgatactgtccccagatgccatacatgtattggcctcccagaaatcacccagtgattttctccccatgaaaagtttatatgtctcatgccctcagagtttttaactgcaaataagctaaaaaaaaaaaaaaaaaaaaaaaaaaaaaaaaaaaaaaaaaaaacgaaaaaaaaacctggtttggtggggaaatgggtgctcatgggttggcatttccattttggtaggcatctttttctaaggccatagctttactcaaagcccagtggaaaaagacatttaaaaaaaaataaaaacctttcaggaaccctcaagtcactccattggggtgaactcccctgtgacactagagaggtggtgaagcttggtggttagggcagttttctgagtcagaaatctcagcttttccactctctagtcttcagatcatgagtaacctcactggtgcccaagtgttccatctgtaaaatgaaataataagactacctcaaggaacctggtgggaagattaaatgggttaatacaggtaaagtacacagaaagtgcctgggaagtagtcaataattgtttgctattactattaccatttttacttttattagaattggctcaaaaagaacccaaagagggcaatgctcaaagggaagaaagggatgagaggagagtacacttaactgatttggttgtttagcttgaaggcaatgtccagctgcaggataaacagcatgaattggaaccaaggactcatctccatgtgggggaggggaatgtgaacagaaaacacgatgtcattggcttcaatttcccttggaattgcctcttcaatgtctcggatcttgtcacaatgattgggtccccaaggcacgaaccattttgtcttgtgatggttcttacgggcatccacacatttcaccgacatgtaggacactgccgttgtgggccctggagctgaaaagagaaagtttgtctgttttagaaaagccatctattgaaactactgtttctggttaatattctttccactgctgtgttccctccagcttttgtatcgccttctacaagtggggctcagcaatacttagggatcttccaaatctgggtgaggatctttcactgacctccagaggtgtcataacagtatctctgagaaccttcccattatgttttcaattgctgtgaaagaatacatttgtaaccagtctagttatacttccccacttcaaaacaatgtcacaaaaaatcaactgtgctacagttcccacctgattgaggtcttggagagctctggtgcttcatagagaacagtatctaaagtcagaagaccttagtcttcaaacctggattcgaagcctggttaaaaacctactgtcagtgaatcttgggtaagtcagttaaatctgtaatagcttcaggaccctcatctgagaaacggaagagtttctaagattccttttggctctaaaattgtacaacattgcttttgcttaagataaagaactaggggacaccagttagcttggtacctagcagagaatgggaactcaaacactgactgatacttcaaaagtgtactaaaatataaacgatgcacttcaagacagcaaagcaactttgaaatgtgtaactttaaaaacactattttgtgattatataatggttatatgattataatattaataacttggaaaatacagaaattttaagttcaaaacaacatttacccaaaatcccactagagggaagtaaccactgttggaaaatgtcaaaatgccatctgtcttttctatgactgtgtaattagataaaaagtttacacatgaattaaattgtgtaactttaaaatatacgcaaatattaacacatatttataaaatagttatatcatgcatagttttgtagtcttttctttttattcacttagaaaagcagagtattgtgtgataacaccagctctggaggcgacctgtctggtgtcaaatcctggctctctcatttttagttgtgtcaccacaaatccacactaggaaagttttgggcaaattactaagcctatctctgtatcggttttatcatctcttagatggcaataataatagtactgatctttccaagtcactgcatattttaaacaagttaacatatgaaagcactcagagtagtgcttgggcacacacaaagtataaaatattagccattatatcatattttctttataattaaaatctttcagttagtagttgcaaaatagtcaatcacacaatacaccaaaatcaacttctccttcatcagtttgtaaaggctatctataagaataatcctttgcctaatatgttttgttggaaatttctcctaaactttccatctgctatctaaatttgtttatgcacatttaaatagagaagttccagatcttatatggaatccctcttttatgtttttccccccatgcttttgtgtttagagaaactgaccttcttcatctcaaaattcaatagtcatctatattgacttctatttattttttgcaatttcattttttctaatatttaaacagttgatccatctgaaaattgctataagagatgcagtgaggttctagttttatttcttaaatatttaaattatagttgattgaacagaccctcccttttgttgatttatcatatcactgttaatctttatgtatgtaagcatgtttctgaacatctgttcttttccatgcattaaactgtcaattcacgggtcagcacaacattgctttgaattttataaatttattatttttatcaatatctgctagagtaactctcttccccaatccatttcaaatttacatctttttgctaggatattgaagattaaattaaatttataaataataaatatataataataaattaatgtggacagaattagcatccttccccagcgtttagttttcccatccaagaacagtacttgtttctccattgtctacaatctgtttttaaatttcttggaaaactttcattgttttctttatgtgggtcctactagtatattttaaaatagatacatctataaacctttgaaagttagtagttaaaagaaagtgtcatcaattatggtttatgtgtgtggtttaaatatgtgtatttctgtgcatctgatacttggtatattatgtttgcagaaattctctcttatttaatagagatcagatagcaatggagaaacatgaaaagcaaaaagaaagttatataacgggaaaaatgtgtattattaatattctgccctacttctaatgttcgaatccacattatttttctattctattaaacatctattttaatgatacatttttagtaaaatgttatgtttgtaagaagttaggacaatgcctattaatacttaccagaaaactcaacactactaagctctagctgaacatccttcatgtagaaggctgaacactgcaatacaagttgccactaacccctgctacagacgtttttctttaaaactcaaaactgtatcacgaagacctcacatctaatccatctaaaatcagacatctgacttattcttagaaatatgagtcaatcaaactttggttatcctgactcagctaaatagcccactgacattagaaaagccaaatggcacatttaactgaaccctttttaatgtggttggagaaataaacagtgagacaaaagtcatgaattctattttcggctaacatactcaaactgactatttgctgcagaaaatagttactacattttaaaacttctattcttccaaaatgaacctaacctttttttctttattttttaccttcttgaaaaacaagtctctcacttctcaggccaaaacgaaaaataactagctgagttcctcagctaagctccaaaaccacattccaaacttaataacagagaagctgaacactttatggtcacaaagtccgcatttttaatgaatgcagtgaacgcctgcctttttaggggcctgcattattttcatcctctcattagtctagtgtttcttctataaagaaaaaaaatcccagaaatactaatattttcataaatatcatggcagtgaacttggagaagcctcaagtgcatctcaagctatactgtgagaatcacaatttttttcacttgaataaattagtccttgagtctcaaaaatgctttccataacttcaaaacctgaagataattcaacattttccgtttttctaatagtgttcaaaagagaaaacacaagtattgcttgagaaagtaaacagacatcctgatattcaaacatggacagttaatgttcccccaataatatatttacagctcagtgcaatgtcctactccagctaaaagtgaattcccaagtgtttctttatatagacagcattatcacgtaaaccaaaagcaaagcttacagctggtagctggtcacctaccatagaatgtgttttcattagctatagtcaaaattttagctacatgggtcacaaattgtgtctagaatcaaaaaaagtttgatctgtctgtaaatttttttaaagtgtgtgggattaagagaaaagagctaaatggaggaagtttaaatcatcttcaacctttgaacaagccacaataacaggtatttgtaatgaaggccttacttagtcacttgcgtggttctagggattaatagagtttgtgtattcaagagggggctggatagattcaggtcaacaaactgagtcatgtttgctcaggtgaaagctaaaaataaccactccccagtattcctaggagagtaatgcaatattacccagctgcctcagcacacattataaatgtctcctccacccacccatagtataaggtttaactgaaaacaagtaggccaaaaactacttctacaccagaccaattcaatgacagaataatttggccaaaactaaatatgcctagtcactgtaaactggttaactcatggttggttaagatagccttgggaatatgcacagaagttataaaaccatgagctattcattgaaaatgcagtccattatgaattcagttctttttactttatcaaacatgaccattttattttgtctgtatttcaatacagtatttttggcctccacttttccactacagcacatgaattgtgaaatgtgattctatataacatttaatgttaaagtgatatgaaatcaataagacttctaacaaattcaaggtgtgaagaaatgtacaaacacaacctgaagtctctatgaaaattcagtggtccctcagttacacacattactatggctcacagtatattgtccaaatttgtcttgagtatctaccatgcactagacactgccggttctggagtaaacctgataggcaccaaccatatggaacgtacaaataacggaggaagcagacaataaataaacaatttcaggaaaaaataattttgatgaatgttatatgtaacctgacattccctgagaaagggcaacagtcagatatttgggaggtgggagaaatgaatacaccagaatgacagaaaaatccagtcatcgttacaacataaccttgaataaaaatgtaagtgaacaatgactaaacctgtagtacttcttttggaagaatattcattgactccagtcagcttcctgttatttcacttcaaatggctatccagtttacaaattactatctagccaaccgctagcatttatcatgcttaaaattgagtcaacattaaatcattagcccctattccttccagaacctgtaatttaagagttagagagagacaagacttggttgcctcttagaaaagttaaaataaaactaaaacaacaggctgacatgacacattgtctccatttaagccaacatagactatttatttctttgctttattatgagtaatgaacatttctttagcaatcacctaggagcattactattatgcaggtaccgtactaactaaagacagagacgaatggcctcccagacccccatttgctcacaggctagtgtgggaggctgagaagttcacaaagaattacaccctgattggaaatttctttgacagaggtttgcacaggatgctccagttgtaaaaagagctgagggtagctttcggcagggcttagccttggaagagagcaggtaatagccaagggagaatgggggatggccaaggagggaaggtgctgaggtagagatagaacatgtgctgggtcatagaatatctaaaacaatcatattttctgcagatatctgtgcttgaatattaaaaattaaaaagagatcatttaacggtgaaaactgtagtactactcttatctctgtgtccacccttgccttttctaatcagtggtataattctactagagtgccttggcctctgctcccaatcatccctgctgtactctatagagcaccataaagaaggaataataaacagagccacacataacaaagaacttttatttggcaggaatgtttccttttatgacacctatctctgccctgtaagtagccacaaggccagaccagagatctgctggaaggaggcggagtgagagggtagtcaggtgggaatgaagaagctccccgtcctattcccacaaatggccccaaagagcctttgaagtctcagtcatcaggtaataatagccttcctctaaattagaggaagaatgtctgccttgcaacaaagatgatatttaaagaataatctgctttggggtacaaggggaaggaatgcagagaatagaccagttgaaaaggtaattcctgtttataagaattaataatcagaacagcaccattttaaaaagtaatgacttaaagtaaaaatggtcaaagatttcagaaatgttttagagaattttatgtttacaatagaatttatctaacaaaaatgataggaacaatacacattgatttaaaaacatacaaaaagttggtagcagatactttctcctactgacttgagacattgatttaacacctgaaaactaatctcagttaaaaagctgccagcaccatctctccacctgtaaaaatgtgaatatttatttatattttataatttcattttatttattctctatcttgttccataaaacattttggggtactagaactggttattagcctttattttttaaaaataattgggactgatttcaacggatagaattaatgttggggcgggggtgggcagagactacaaattacttggtctatgtctatatcttcaaaagtttggggagcttatattctccagctattgctttttttttttttttccagctattgcttttgaaacaacagctgggaaatataagctcctcaaacttttgaagcaatagctgaagaatgaatataagctcccaaaacttttacctgatctatgaagttgaatggctcaatatccattttactttgaaatgtagagaaaacctccattgcactatgaatggtatttataagaactaaaaggcatatgcccaagttggttctaagctctgcctatctaaatatctctgcttgccttatgagaacttatataaaacatattgagcacttaaacccttgggcaattgcagagtgtgctttggattttttgagtatcaaggtggggagggtcgaaaagagggagaaagggaacacaggtgtcagaaaagactagatgaattcctgttatgtaactactttttcaaatgcccccaaagtacttatttaacctaagaaaatctttagctaagtttagaaattagctttaaatatgctcaattgattttccttagacattccacatgcctttcgccagctcaaaagccttaattctggttaaaaggaaacatgtgaaatatactgcacaacttcagtggccagatcatattaactggctgagctgtgaggtcttatgagccaaacctgcttaccattcactgaaagtcagttcctaaaaagatttcttaatatctgccataccacttatctaagttttgggtggctaattagaatgagctcttcaaaaagttcagctaaagaaagtgcaaatatttgcattaaattgacttagtacttaaatgattcagtgtgttaattcttttactgaaattgctctgaagttatagtagacacttatgctttctccaccacctactttgaagagaagattctcctatatttcaaccatacccattaaatcttactagcttactaaatgaagtattatttcacaattcaatctcaattactggagagctgaaagtgtgtctacagagactagaccagaagtgatttttacaattatcaaagctatgcccttgtgcatgaaatggggtacgctaagtgaaatgaaattcattcttgccagccactttcagtcagttagttatgctaacatctgttctaggaaagctaattttttttaatacagcagaacattcctttacactgaaccactaccaccaaaacacaaacatacatactacatagcagagttgaatgcaaaataatttgtaccgtacacacaaaagtcaagcacttatttaaaaatagttctttacaatataaacttatgaaattatggacattttgacagcaattttccaaaaattgtagcaaacacttgtaaatacattccgactcaaaaatattgaaaatatcatatgtttacattttaggcagatgaggattttaaatgcttcgcctacaacctcaattgttgtggagccaaagatgcaacagctttgaagaatagaagaattactctatatttgtcaggatctacgtggcaaacaagcgccacttggcttacattacttgcctggcttggatcccatggaatggaggagcattggaaccaagaggaaaaaaattaaagtgctttgggacagcgagccaaactcttacatagtatttgaaatggtgtggcaaacatgaaattattttaggctcaagattggtgctagttttttaccctctttttgaaaaaatagtaaaatgcacataaagggccctgccagaggtttagctcataaaatctgccaatcattggatgtgctaattggtgtagcaatccagtggtggcctggattaggactcaaaaactgacccttaccacccttggtgtcctgcagcaaagacagcctaaatcgaaaagactgatggaagtatatcaaattacgaatttctctatccctgaaaaatgcctgcaatttctgtttctccatcactccagaaatactcaaaacagcaaaaattaaatacatatgaagtgaacacaaaagacctccacagaaaaatcagtggctcatctgttgacgctattgctcattgctcggctggccagtcatctgggctaagttttgactttgggccagtgcttcaaaatcagcaacctttcagccaaaagactgtggaatgcagccaagaccacctgtggaaagtgaattatagcatctttaatttactaccttgggctatgatgtcagaaacccagcatggagggcgcaccagttcttgtgtgggaaatctctcagagcccccatggaggcccccaaagtggctctggcaaagctgtaggggtggaggtaacaaaaaaggggacacctggctctccttcttaaatcagctcaccatgggcacacatttatattggaattttagggtcagaaaataccaaaattaaatcttctagaagaaacacagtcagtggctttgctctaaagtgcctattacactctacaagtttccaacatttgttatttaaaataatcagacatttattattcataaattacatatattcttttatcaatattattgttaataataaacatgaacaactagtaagtgaattgcaaagaactttcacatacatagattatcgaatccacctagttaacaagtaacataattagcaccattgcatattcagaagatcagtggtttttgtctcatcagtaaatagagttaggactggaacccaggtctgatttcatatctaatgctcctttccaatacaactatctgtttatttattaacggttactatttattagcactctcagattacctgagatagttgcagagctgagggatgaatgaagacgactgtggccataagtagcttgctgaagctccacaggcaaggcactaccagcactgggctgggtgtcactcaaagggagccagcaagatagcttttctgggagacttacagtcagggacagagtacctctaagacttccataaagaaatgatggagtaataggctcatgaaaatgcactaaactcccttgaatctgataccctcccagtttttaccgggtcttggttatgacttcatattgcaggtaggcagtgtttaggatgttagcctagagaagatctgactcaggaacacagcgctgccatggaagtctatgacagcacttgcaggcatagtgagagacaggaattcaagttagagaaaatctgactccagagcaacctatggaagaattacttataattcaggtaggcaaacaatggcacagtttgactcaggaaagggtgggttcctcaaccatggaaacatttgggaagtaaatggatagataagagcaagagcctgaactaaatataagttcctctcagtcacaccaaaataagtctcctatccatgcatatggtatgtcagggaatggagaaattaaggtccaacaaagagctgcatatagtttattgatttgttttctattttctgaccagttccagataaacagataaaagcaattaaagtacagggcattctgaatggtcaaaaatttagtattgtacattgtaagttaaggctaagggcaagtaagacctgttaatgtctttatctggaatttcacaaatgccaagaataatcatatttccttccttgattgattattcaaagaaaacacaggcccttataatttgcaaatttcctagaattgagggtagaggtacattttaagggtaacttgcagttttaacattcacattcttaggaattattattattattaatttttttttttagacggagtctcgctctgtcgtccaggctggagtgcagtggcgcggtctcggctcactgcaagctccgcctcccgggttcacgccattgtcctgcctcagcctccagagtagctgggaccacaggcgcccggctaattttttgtatttttagtagagacggggcttcaccgtattagccaggatggtctccatctcctgacctggtgatccgcccgcctgggcctcccaaagtgctgggattacaggcttgagccaccgcgcccggccggaaatatttttttaaaaaacattgaaatcacaaaattaaatagtctatgcaattatttagtattttaaatttcatcagttttaggttctagctcaagggccgtctctccttcattcaatttgttaaatgcctatagtgtgccagctggaggcctcctctgattttccttcagttgacaaaagatccttacttcctttggtgccagtatcacctggtctatgtctttattatagcattctactttatttgcaggcatcacttctgaaccctacaaaattataagctcctaaggggaaggactacatcttattctgccttgtgccactaagcacagaaacttaaacatgcaagtcctccagacctgaactgaactatttattatatggcttttgtgtcataataaacatattaatgtaagttatgctcaatgtaactaacaaaattttatcaaatgcctactaagcatcattttttaaatgccatagtggattaatccttgtcccgcctgtatcaaagtacacttagactggcactcagtgacagtttgggaagaagccagagctgccttccgtgaggtcagtctcccaaggtcacacatgtgctcatcagagactcacttcctacaaatacttatgacggttcttccagatccgtgtcaagcaatatattaaatgaaatactgaattttgaagatcaaaatgaacttttcctaaactataacccaatccacacaagtaatttacacatcaaaagaaattagatagtaggcaaacaaaacaatggtaatttttttaaaaaaaactgctcccaaagggtttgtggccaacattaatattgcaggaacatgtttagataactgctgttcagcatagttcctggaaacaggttctcaaagccaggacttacagttatttaccttcttccagcactgccctgagggttttaaggcctaaatgaatagaaagcaaatgggggacaaaatgaaataaaatgttcacatctcagcctttagtgtatataactaatgtttgaagattttatgacaaaatgtgtcttcttaagaacacatgtagggaagattttggccatttctttaacaccctttaaacagtacctaccagagaaaaagcaaacactcccttctaaaagcatcaatattctacttctgagatcaaaactacaaaacaggctcagacagaaacctgggcaaaggaaccttctgctgcacgtatgtactatttcccagagatgtaaatgatttttttctctctgccccagtgaatcacatatgaaagttctcaaagaattagtaaagaaaaatggtgaaaatcttcttggtgttgaaggaacagtggagtgtagctggtatcagaagttctgaagtgactcagagattcagaagggtgacaggcaggggcagtttttactagaggaaagagcgatgtaggatgaacaatttactgtccctgttgattcacataggatgtaagtacaagagaagtcaaggatgtccccaaatttcttgcataggcagcagatgagtgatgtcattcactaagacaggaatcaaagaaaaatgaatgacatgtcatatcacacgtagaatttgtagaagctggagatgtatagcttgtttaaaaggggggtttagtatggagggttgaagataaaaggtcaaatatgtgaatgactaaatgtggaggaggaattagatttaccctgagtggttccaatcttgcaagttctcaggaaggaaatctgagatcaataaaatcaaactggcccacagttcaccacaccagttgaagaaaatgagctgccggcacctgtgtgagtggaggtgctcctcagttaacacttggtgagtgcaaagaatgcagagggcatttgagcaccgggtagggatggaaaggtgacttttagggtctttgttatcattattattctatgggcattcttcatatataatatttagagcttcgattctgggccacaagttgatctgctattcctgaactactacaaatttgagcataagaatcttggcagaataaattatcccaggactcatgattgctgggttctagcaatggatatgcattaatcaggcaaattattcaatcaatcttgggccttagttttctcaactgtaaaaggcagtatttaaactgttaagcacttttaactcagcaattgtaggattctaaaaagaatgtatgtacttctacgttatgatgaaagtcactcttttaagtttaaagaaaaagttcctacaaattagggtcaatttatattccaagagttctggctgtccctatcaggcccctcctccccctccttgtccttatattttcacatctgttagaagaacagatcttaatggtcctattctcgttctgttactgtttgggatctgaatgtattctgagtgttttctgtcttccaacagctggagagatcaaagaactgttcctaaaagcaaggacaagctacagccaactgcatatgtaaactttcatactgatgtatttagcacagtgaattatacccccataatttataatatgagaaggtaggtctaatccaataataataaagacctttaggagaaaacaacaaaaaacaccattccagcttccagccagtggtctgaatactcacagcctaatacaacacaaagacattccaatacaatgaaataatttggatcatgtccagcctctattttttaggatgatagaaataagctcaagagagctaagtctatttattattcagaagaaatgaaagtcatagcatacacttctaagccaagagatcattgacaaaatttgctaatgaaatcaattcataactttctttcagattttcatttaaacggctgggttcctaatatatttcaaaatttacactgattaccctctacaaaaagtatgtcataagagaaaacaatgattacagagtagcaagggacttactttcacaggaacggtgctttatgttgctgaaggcaattacaaaaagagagtaagaaaaattaaaagcaagagctagagctcagaaaaacttgggttcaaatcccaactctgttactcactagcaatttagtggggcagcttacctagccttgtagaatgccagtttcccttttgtaaaagtgtactaaaaggtactcgcctcctaaatttattttgaggataaaatgattaatataaaaaccctattacagtaccatgaaaatagtgaagccttaatgaatgttagctgataataatagtgctgtcaacacatgagaagaattagaatctggtgggagatgaagacctactccatgttctctgttctgtcttcttgccctgaggggtgtgttcatcaatatttaaggaactagaaggtgtgcatcttggatgttaaaaacaggggctcccctcacctatcagtgaacagccccaataccagagatgattctatacaaattttaactggaacatctaagataaccctgagaaatatcccaggcatatcttaagcagcctgttatttgagggaacacagaattaacccttggttttatccttagaaaaatgggatgataacatcttttttcacaattatcttcacaaattattataaaatagttatggcagagcaaaaactattgacatgggtatttgctaccctttcccctcctctcttcagataaagagaatgctggttttgcctcttctgtcacaaccccctcacctgccccccgatgaggattcaactattgctagatggattctttgagttttcatgatgcacaatcaaaagacaggggataggtagaagatatgggcttgagctcggcagggagaggggggcggtttaccagcgggagtgttggggagattttggaagagacgttagaaacatcaaagtagatgggaaagaaaatagggattgctagaagtactgctacagattatatatcccctttaccatgctttgacagttaaagaacagaagttgttaggtcactttaaattcacctttggttgactgcctgtttctttgacagaatccctacttggagactggaccaaagaggctatgtcttccatagaggcaacatgagaaagtaagagaggtgcaaacacatcatgcaaacgttaggcagaatttattgtgttcatacatgacatggggaacattgaaaggattgatgtcttagaaaggcgtgttaggagtgtgggtctagaatgcataaggttagagatatgcctgcactgggccatcatcttattttaatatttggtccaaattctgggcttctcacaatcagagagctatacctaccaatttcctcttattattcttggctgcccggtccccatccctctactcagagatttctcaagctttgcactaatggcattttgggttgaataactgttgtgggggtttggcttgtgcactggaggatatttagcaacatccttggcttctacccactagctgccagtagcatcttcatccccactgctggcaagttcagggggggtgtgggtgggggaagtcttctccaaacattgccaaatattccctggggagcaaaactgcttctggtggagaacctctgctttaccccaatcatccaggcttacaagaaaaattcatactccatcaagccattctacaacacttcattttcagagtttccaactacagagattccaagttctcagcaattcataaccattacagtttgcctcatgttacactgactgcatcaggctgtcatttagaaattataataatggctaccacttgttggatattttttatgtgctaggcattgtgctagggacttaacagggtgattttcattcttatacagaagtaagtgtggccgggcacgttggctcgtgcctgtaatcccagcactttgggaggccgaggtgggcggaacacctgatgtcgggagtttgagaccagcctgaccaacatggagaaaacccgtctctactaaaaatacaaaaaattagctgggtgtggtggcgcatgcctgtaatcccagctactcaggaggctgaggcaggagaaatcacttgaacctgggaagcggaggttgcggtgagccaagattgcacaattgcgctccagcctgggcaacaaaaatgaaactccgtttcaaaaaaaaaaaagaagtggtagatattattatctccattcagagatgagtaaaatgaggccctgaaaaattaaaataactcatccaaggtcacagccaataagtggctgaactggggtttgaacctaatctgtcccaggtccatagtctctccttgtctcaggccacactgtttctcctgatgagaaaaactaatgcagggatacacaagaaatacatttacccaaagttacatgagttcaaatggcaattccactgtatggactattgtagaggttgttgatctcagcactatgtggactcagcagtatggatgtctttgttctagggacatcaacaagctgatttttgaattatgaattttctgcagaaaataggaaaatggtgctctcctttaagtagaaacaacaaacagtagctggttgccatggtagcagaggtaaacttaaccttgactgggaaggcaatcaccagaaagggacagcaagtatggtcaggagtctaaaccagaccaggggtattttaactggagaagagaaagtcaaaggagagaaatgatagtcatctttagttatttgaaaggctactgtgtaactgaagtgaagcatacattcaagattattctaaatggaaaatccagcattcatgagtggaaattacaatgcagtcatggaagccagttttccactgaatgataagaaagaacatttaaccatcgtaatgttccaactggattgaaaaactaaacaagctgtctagagagcaataggtcgctaaaatagaaagatcctaacaggaaggtcatctctcttgggagacccagtgtgggtgagactgggctaaacaaattctcaggccccctccccaagcaaaatctctgtttctccagagaattagtaaattggggttccctgttgaaaacagacaaatggaaggtccactgggcggaaagccccagccgctcatcactacaagaggagaggtaaactacaatctcacctgggaagaaaatgttgtttaggtgacacaaaccaaggggaggagaaaccttgtggaggatttttcccctctgttctgaatagatgatcaaggggtaaggcagtaagggcaaaaccaaaaacaaaacaaacagaaaaaaacccaccaagaatcaagcagctttctgctgtcttccaaccctcagacactctgatgcctctttcttggaatgtaccgccacctcccactgctttggcctaaagactgcatttaattttaaaaagaaaataggcaaccatccagctaggggacagttagagtaacagttgattagtccttttctaaacactgtcttttgtttcattgctctttatttgctgtacaccaacaattcattaaaaacatctcaccactagatttagtgaatggagaggacaggtctaaacccaaacattcctcttggaaaaccgactacattgtaaatttgcagacctgtccaggaaagtaaaactgttacaaagtcaacctctactgaggcacacagcctcctttgtaaaagaaaaaaaaaaaaaagaggtgctaaaaaaatgacaggtttttcttaaaaaacaacaggtttttcttaaaaaacaacaaaatcttattcatctttccatattcagcatgaagaacacctaagagaattttccctatcgcctcatctccagggcactcaaagcatttacaatctcattattttatacaacacccattaagtgggcaccaaagattattacccttctttgatttctaagaaagcaactacagaaagtttaaacaagttgcccaaggtcgttcagtaaattgagatgcttggattttccattcagtgattgttctagggacatagtgcaaagtgactgaatcctctaaactcaccaaaacccctaagtcttacagatctcttccccatttctcaccactcatgagattttcatcatctaatcacaaatctgccaccatgtggatcttggacatgggtatcctaccaggccagtgccatgtctgcaagaagcctggtgctacacctgacagctttcaaatcaccatcaaatgattcctttatctagtgaagttgattctgcctggctgcatctgggaaatttttaacccctcgattagccattgcacagttggcttaacttggatgagacagaggacaaaatagtggtggtttaaaaaaatacctcccccattctgattacaaaggaggcatgattaacgaagtaccctttgtatccgagctccattctaagagaaagagaaagagctttccttcccccttttttgatcgctgagtcttttcctacttgtctcatcacccacacaatctgttcacagcccaaacagacaatccagccagtctgtggagagttcctaaaacatttatgttgtgaaagcagacaggatgaacaggacctcatctcgacaaaggatgatgggacattcagcaaaagagttcacgaagggaaatacagatggagtcccagagctgaatgaatttgcccacaatgtctaacacaatgccagcccttatgggtacttgtaaaccttctggtcaattcacagccacctccaggttttatcccccaaattccattacttttagaacaaagggttttaaaagaaaatacaattaacaagttaaggaggtccaaatcagtgctttaaggatccttcaatttctctagacctttaaacataaaaatagcaagttagatgaagattttagttccaacactaccagatcgggagttgacataatgcacataaaatacttaatacattgcctggtacatactaagtactcaaataatattacctaatattttcatcttacactgctctattttattaatgatgtttttatatatgtcattgcctgtctactcagctaaatagttccaccttatctgtttttggtataatccaaaagataaatgccttcatataattatcttatttaagctttcagatctatagtaggttacagatgagacagtaaaagcaagactaggtctcatagctggcaagtggtagattcccatactgagatctcaactcactaatttaacatccagtgctttatttcaataacaccacagatgaacagattatcatctctcgtgcctctttgtattcttcagaatttagctaagcgctaagatataccttaatgatcatctaaaataaatttctaatgataggtaacctaacatgtctgaagatttattttagtgcctttaataaggaagaaaagaaatgggtggaaaagcccaaccatacttggctttgaggaaagacatgcctctgtttttatttgccaagggaaagcattaccaggtccatttagaaagacaagaggaagtaaagccgggcgtggtggctcatgtctgtaatcccagcactttgggaggccgaggcaggtggatcacctgaggtcagaagttcaagaccagcctggtcaacatggtgaaaccccgtctctactaaatatacaaaaattagccaggcatggtggtaggcgcctgtaatcccagctactcaggaggctgaggcaggagaatcacttgaacccgggacgcagaggttgcagtgagctgagattgcgccattgctctccagactgggcaacaagagcgaaacttcattccaaaaaaaaaaaaaaaaaaaaggaaagacgaggaagcatgagggattcaatgatataccaaagagataaatggggctagagccagaactcttgatactctgctcatggctttctgtattaagttcattattaatttggcaccttgagtgagatgaatcttgccttggattatgcacatcaagttgtatttcagatggctgtcccatactttaaaggcccataccaaacccccatgtatcaaaaaaaaaaattatctgatctaaaaaatgcctagatcccttagcccttaacaacaaactgtcttattttatggatcttgtcttcccaaatttaagttgctggagggcaaaatccatgtgtttactccttctgtagcccatggctaacctagttcagaacttgtagcaacgtgtgctgctcattgcttcctcggcctcacagccttctagatgtcccaaagaaacctcgagtcatcataacatctactgaatttcccaaccatccccagcactactgctcggcttgggcagtcattaaagcttctcttctgccttcaggatcttcatttcagctgctgggacatcctgttgccatccatttcacacagacatccagcccagcaggaacccgtgttgcaatgagctttgcttcaaagccagcagcctggccaagttccaggaattgtcactaatgatcttcaccagcaacttggtgctcaacagtgatctctgaacacacacacacacacacacacacacaccccatttccaatactgctctagttagaggagctgcctaacagaggttggttccataacttattttattctttaattgttacagaggacttatttcatcaaaataagctaactgtccaaatacactctgcaatgcagcagtggcctccaccaacttactccttttttttttttgagatggagtctcgcactgtcacccaggctggagtgcagtgttgtgatcttggctcactgcaacctctgcctcccagtttcaagtgattctcctgcctcagcctcccaagtagctgggactacaggcaggtgaaaccacattcggctaatttttgtattttttaatagagatggggtttcaccatgttagccaggctagtctcaaactcctgacctcaggcctcccaaagtgctgggaccacaggtgtgagccaccacatctggttccaccaacttatttttaaactgaagaaggcataacaagtgtatcagtttcttttggttgtaagagacaggaaagcctgctcaaagatacttaagcaaaaactaaattagtaagatgatactgaaaaatatctagagataaagcagtcttctagtggttgttttgagaaatcagattatgtcaacagatctcacttctctacagtcattgaattccaccctgtattttattagcttcattctcaggcttcattggaaagactccaacaattccaggcttatattctgtgagttgaaattcagtaagaaaaagagaggacatctcttcctggtagcctccacacaagtctcagaattcactctaattagactaacttgaggcataaatccaccgtggctagtgcttggcttggtcacatgtccatcactggaatcagaagtgaagattctcttaaggcacatggactgagagtggggaaaaaaatgctccacaaaggagattcaggcagatcctgctgccaaaacaaataggcgaaacactaggcagccaaaaaacaccaatcatcctctccaataaatcttccttcttttcctaatctccaagaagttgtattactgggatgatccaactttgaaaatagtatattaaaagaaaggaacaaccacgcaagtcatataaaaatatatgtagccagtaggcacatgaaaagaggtttaccattactatcaatcaacgaaatgtaaattaaaagaataagatattatcagcacattgggaaacattttttaaacaaaagtaatcaccagtactggctaacatgcaaagagatagacattcccagatttggctaatgggtgatatgatgattatcactgaccatcaaaatccttaaaaatgtgcatttcattttacctaagataaattcacaaaagtgaatttactaaggaaataataaaggatgtacataagaatttaaatacaaagaagatttctccagtattgtttataatagccttaaactggaattattctaaatgtccaacaatagattgagcaatttaattttatccatactatgggttatcatactgacactaaaaataacctttcaatgcatgtttattagcatggcttaaataagtagaaaggcactatacaaaagaattaataaagtgggcaacaatagcatcattcactaactaaacccagtaaattagtttcaccctcatctcctaggcactccctggttccttctttaagatttaccctggggttctaaagacccagattccacccggggaaagagaaaaactctggacaccctcagcaggctaaaatgtgttgaataaatatgtaaagagagaatcaacaactgttcatgggaatggcttgctacacagaggagggtgaagaagatggaccacaactgtcatttacttgtcctggaagagagctcaaaaagaaatgtttggccaatacacagtgatttctatcacaagtagttcatattttttaaaactactcttttttcttgttcttcaacttgtcataatgtagcaattaatattcaaatcccgagttattccttccacaaacatagctactgccttgccaaataaaccataccacaaacagttactccccatctcagttttcataagtttaaaatgtaaatatccctgatggactggcctatcttagagtgttgttgggaagatcaaataagatgatttctactaaagtaccttcaagaaggataaaagcactatacaaatgtgaggtatcaggtgtatcagtgcattacgcagatttcacaaacacacaacagagcatgggagagttcatggcaagcctctggctcctccattaccctcatgtccttttccctgcagtcatttcagaaaaccagatgtttgtttgcaaagtttctctgcagcaaaagggcaggccctctctacattcaaattggctgaagctgtgtttctagctgttgaaacttagacaataatgggggagatgccaaaattaatccaaaaagcagacaggcacactttacagactggagccctgagatggaaaaaggcagcagcatgaacaagtagagggttaatggttttcatattatttaattcaagccgcaacaatgacagattctaaagatataaacttctgagagtgagcattctttcagaattagtatacaggggtcctattagcaatattttatatactccaaatatcttcccaaaggaaatcactgctgaaaaagacaaagttctttgttggtagggctgtgcgtttataccatggacttaaatacttttcttctacagtctcctcattttaaaaaatggcaaaaaatttcaataaaacatggatggagcaataagaagtacactgaagttcttaaatgcccttctttttaaatccccaccccaattacgtccctcccttgaggatatttacagtcctctatgacacatgctctgtaccttcttggttcaaggaaaacacacctacagcatttcaaattaactactgacccttactctcacactataaacaaacccttttcacaatctcaattgcattgtgtccacattgattaaagcttgaagcctggtgacctcatgtggtgttaacttctcccatgcaccaacagcattccgcctttctactcaattaccccctttggtgccagaggatcgctacccaatgaacacatacaatggacttctgcttcattacactaaccaacagcaggatagaaataagcagaagaggaataaacaagctaatttatcatgaggacagagcaagctttcaccagtctcgccatggaaaacttcagtggttaacgggaacatcaatagtctgggggtgatgtttatgatcttacagattatggacaaagccataacagaaccccaaactgactgaagaattctgcagattggcaggtgtgaacacacgcacacaaaacccatgccttaaaactccggggtcctacataaaacctactcagtaattattttgggaagcataaccctgggctttggataacgtgggctgacactctggtaatttgctccaactgttcagcttaactgtggggcccctcttatttatctttgacaaggtggtcaggaggaacccagcccctttgtgagaggggtctggttcccccaccgccccctgcttcattaggcatggcaaggacacagcggttgattaaattaacaactttggagggcttcagtcccagttcccagacattagcaccatcatccagaacaaattaaaagtctcacagcaattaagcagattttgaaaatgaatttcccatggttcaatggctcaaccacaatcttgagttaagtatcagagaagagtattgaaggaagagaagaggaactgactgctgaaattccaaagtaaacatacaactggtagaagcagcatacacaataaacttctgagcctctgctaagtaggcttatacatttcttttatagaaaattggaaatattcagtcacataaggggaaagaataaaacattaacatagaatggttgtatcaaaatggtggatttttttttcttttttctttgtttttaattactttaacatcattttattcttgttcaaaaatataaatagatattgagaggggacaaaaatacctacttccagtcacaggcttttaaattcaaacaagaaatcgtacatccaagtctggaactggaatcatctatatttctctgaaccagtacaactaggttcacagcaggcaaagaccttttatgccagcctccaaagaaccctgggtgggtgatttacctctaagaactcatttctggatcaaaagaataagattaatgataaaatcatacctatcacattctaggtgtgtactctttgccaggcactgccgttttgaggccttgtcatacttgcttccttccctttcagtttacatatgctcctttaatccctgttcccgcctcgcacctctgcctggctctacttgcaagtcacaggcctccgttcctctttgcctgcaggcagacatttggcacagcttgtgtgcaggaacctggaggaatcctgaaggaatgtgcgaatgaattcattcccactcaccagatctataagctgaagacagtggaatgcagaggtagttacttgaatgaactatattttcctgtcaagggcatttataaaagctgacatcataaatacattattggtctctaagtacaactgtaaataaatctacaaaattcttagaaggataactttcaaagatttgtttttcatctttaaaagtttatagaaaattaagcaaactatgtggctcttctaaaagaagccccttcaaaatagccctcacggaacagaagaaacacatttacttcttaaagacagtaaatctcaaaatttgcattacagttcaacagttccatttggatattcaaaatttggaaatatatatacttctgtgtgttcccttcttcccactaaactttaatcaactagtatagacaaccagccacagtcaattatctggctttatggccaagtagggaccaaaatatataacccagacataataacaatcagcataacagtaggcataggtaatgaaactctccgctagtggtcagaaagctcagttcaaaccttatttctcactatgtcttccttggaccttagtttccacaatataatggaaaaacgtccctttccaactccaaaattgtaccattttagaaatgtaagcatgtatattatgaaggtaacacaatcttttatgttcaagtgaataataaaaaccctcctcccatttaaataataatagcctggaatataatgttataaaacttagggaggacctcaaagccttaaagtagaagcattttagttacctccacaataggtccaaaatgcaaggcattcatctattcacctcttcaacagatattattgggtacctacattgcattgatctgtagtaacagccataaaggtgagtatattagaccatcattattctcatacagcttacagtttgacagaggttatattttaatcattattttttgtttaaaatttcttataaactataattctagctaatgtttcagaagtaattaatattttatttttaaaaatcatttttcctcaaagtttgactttaagaagtctttgtcattcacgttattatctagaagcaaaaaaatttcccagtggatgatgactccaattttataatgtaaaacagaagtacaactgggattcacttcgcagcaagcaaagagggaataaatctcttccacataatgagtgatatccatttaaaaaagtcatgctacctgggcttatctatgctctaaagagccatgaatactggcccagaattttaaaagacaaacatttagattcaaattaaatgttggttaaaaagaggaaaaacaacccaagttaattactctaatttaccgaatatatgaatgacctgcttattggactattggctagcatagatcttgcctaataggaaggctatcaagcagggtggctgggtttctaattttatccaatcaattaagaggcagaaataacctgcccattgaccttacgagacacaagttgactccagaataaacaaacaaacagacttgaaaagttaattatgggcaacctctccttcagagaaatggctcacatatattaattgatctaacacctatgtgcaggctcccaagaagatggaactcgttctctcatttaaatcccacaacccccgtgactcagagatttttggttcaggaaactgaggctcacagaatttaaatggttagtctaggttacaaagcaagtttgataacaaagagataaatcagatcactgccatttatcaaccataaaaccacattccatcagttattatagaaatccatcactttgaatggagagatcaagtttctcaaggattaagcttctcatttaacatgaactatcaaatggaaaacctcgagccaacacttatttttatagcgtgactatttctcaagaatcctgtaagaagcccacatcaagaggcaactttcaaaattactaaaatttcaaaaatttcaaaattacaaaagtaacagttctgtcaagtgggaagagttaatgcctttcctttacagagctgctttatgtaactagccgaagttttaacatagaaatattactgtttcatatatacattaatcttgactttgttaaaatcccaaacatactgctcatcgatctcctaaactttctctttttcaagaagtaggtgggggagggaaggaaggtattggaggaattcttctgatatctgtaaaaacagaaacaaatgctaattaaaagatgaccttagtgccctttcagtttaaaaatcttgagcatttacaaattatcttttttttctctttcatcaactattacccagaaataccacattctcatagagcaaagctctgtcctgtttgggcatgttcaaagaatagtgccagggatttaatactggcatgctcatggacctgcaaattctgaaattcagggggaggcatgaataaaaagatagctgaggtcccacagttgcctgtcacagccaagccccaccccacccacatcctcatatgatcctcaagaagcaaaacctttctgagatattctataagtgacagcaaggcccaatgtgcagtcttttcaaagcctcagtaaaaatcttatctatgacttcacttagcccagacacacaggagctaaaaggtaaaagcctggttcacacaagccagaactagctcaacagaaccgaaaaaagaaaggaatgtcttttctatatcttttccatgtctgaggcattctgctctggggcaaattacaacctaaataagaacagataaaatatatgggaactgagtaaaagaaatagaacctcaaaaagggctgctctgcctggaaagaaggctggaattcataaaacatggaacgtaacttttttagtgatcacctgaaggcaagcttgttaaacagagacttaaaagtcaagatttatttcagctaaattagatggtgcagaaaaacatagtgcttcgtgactctgctcagtttcaacaaaatgaaaagacagaggaggaagaatttacagtataatacttgcaccactcaaatcacaaaaatacacttgttagtcacaaaggaggggcccataacattgtaagccttattttggcaatgtgaattttctgcttgcaattaccttcaaagtgaagaaatggcagagacgaagaatgaggaattttgttgctgcttttgtatgtaaattcgaccaaaatatatagtgctatgtgactttaccccaagctcactagaacttcggaattatgcctgccacaaacatcctccgaaagcacaagaattagtcatagatttttttagtcaaggaagcctcagactgataaagtcttaaaactagacgcaaggactgtgctttggattggataagtaatgactatactgcgtggttttggtgtgtgttttttagagttttaaatttacatttccccaagcaggaggaagggaatgtaccacaccctcagcaagcaaggaaggaatttagttgattttttttaaattctgtagtgttccttaaaatccacatagcatagcataacattctatataattctgttgttccataagggattggctaagtatattaaggatacaaagggaagggggagatgacaaagttattgctattttattttcaagtgacagaaaaatcaatcgagctataagaagcaccagttgggaatgttctgcacattaactctttaatagccttagacagaaatcagatgatcttcacactgaaactctgaaggacatatatctttggggcactgagtagcattagaaactgcgtccaagccatggctccacctctaattgcatgaactgaatggcttccctttcctgggactcgaattccttctaaattaaggtagaacaagatagtcttgaaggccctttcatccttacgatttaatactgacaagctcttcagcttctattcaggacaaacaccaccaaagtgtatggatacaatggattcaagtagccacactcatggacagtgacaaaatcccacagctttagggtggaatcaagtatcatattggcctagaatgtattgatgctgccaaggtgtggggtgggggtgggggtgggggtggggggcaggggtgaggtaccactgatgtgtgaaatgacttgcctaatatcccagagacccctgaatcccaggcattcttattctgaatagagacttttaatcaatttcttgtctcatcctatgtcctcatgttaccatacttctacaagtctgtgctgccagtgagggttggcaaatcatcccaactcagaaggacagacttacaaaatggcataatcaagcttcactaacactgtatataaagtaaaagtaatagattgagtaaaagcatgagagattctcttgggagtaaaatgtgcatgctttaggagaagatttggacttgtgttcttatttgttagttttctgcaataacattaatatttatcatttgggggaggttcataatgaaatacttggttatagcacaggaactaatgttagaaagcaggatgacctccttaaactttcaaacccaaaccaagtaaggttttgggtcattcccattccttctgcctcaacagatctacaaatctgtaggtgttgggcaaagtggtggtgactcaaagaaggaaaagaatggataataaacagtgtcgtgtgtaagtttccccagatctaagaacagagagggacaaagaaatgtaggagagatggatttgggattaatcaaatggtttcagtgcaaagtcctctggaaatcacatctctgataggcctggctcaatgagacactccaacaagtgtcaagtcctcaagatagtagattccagtgatattttatgcttgtagcaatccccatgaggaaggagggctctgtttcacatcgcagttgagagagggagtcaatgagattttatgacttttttgggatcattgaggccacaggttgtctgcagagtcctagccaagtttctctccactaaatgacgctgctttgagaccagaagctctctcttttggagggggtcagccaggaccaaggcagcagttaactggcctccaaccaactttcatgaggctggccttattaaactaggtctgaagaaaaactgagtcaaccatttacagacttattatcttctttctaaaggaaaatcataatgccttgccaaaacaaatgtaataacttggccttttctttcaattacctctgctttcttggaaatgtgtatctgtggataaaacctctgagttaacccagggaattaaccagatgtttaagaagaccctgtgattcctgtgggccagcaaagaaagaataccccttggccacattatgagaatggagtactaaggagaaagggggagcagaaaattaaacttgaaggcccaggatttaaataggcatagcagatagaaatgttagctcagttttgggggattgggtgacactggaagcaggttttggaaatccaggcacaagctgtgtccttgaaaagacagtctcatatatttccagagcccttcatttcattttcttcagtctatattctacccccatcttcctattccacatcctcattacactcccatttcttcaacagctaccttcaggacctacgatgtatgctaaatccagggaacattcagagggcccactatctcgacaaatttcctattacaactctaagccatcttttgctgtatgcaataatttcctttggggagtgttggcatgtaatttctgaggttcagccctccctagcatggcccagaaacactgccaatatttacaatggctggtgtaggcagttcttatgtctcaggagttggggatcccttgttaaggaagtaataggccaatgatcagtaaccatgcagtgatatgagtgcatggtttggggaaggggtggaagcaaaacgaaaaggtgggggggattgagctttcatcttctgctctatctgtgtagaatcagtttcaccacactcatccctttgtttcccatagaaatggaaaggacaatgggaggaaggtagcattaagcttaagaatatggcttaggattcaatcaaggactgtgggcttgagtcttagccctctcatttactatctctgcactcttatttactatctctgcaacctcaaaaaaggttcttaaatgagcctcagattcatgtgaaaattgaagaaagtaaagtatttacttctttgggttgatgtgatcattaagtgaatctttacatgtgaaacgctttccatagtcccccagtcttccaatatgattactgcttttgctcccctacaagatttagtcagggatagaatgtggggggtggggggaagaggtggtagtaagaggctatagaaatttagtatttttatattataaattatacatcattattttctttaatttagcaatccttttagattcatcattttatgagaagaaaacttagaaaacactaaagtttgagatcattaagtttgagaattggcatgtctcaagctcctcctctccttcccacatccccatacgggcactttctctagaactgtgcagagctggcacatttattaggccaccatcacaacccttcagagaaaaagtaagacctaaatgaaatagtcgtgatcatttcgtgtcttgatgctccctgtgtctcattacctctcagggtctctatcaaaatcaagggctgcaaatctttcaatagagaaatctattagcatattttccaaagaacaaaatgtacctattcctgctgtcagggctgctgtttgtaggagtctctggtttaaaaggccctcgttattatgcatgggtgtgcatacaaacaaaacttctccgcatgggaaaagaattttcagctttcagtaagaggctcttttctcaattcctccaccatcactaccaacctacaccctctaaaaacctctccaacctccactgattctttctttcctctcctttgaaaaagtccggacttactgtataactacatatatgttaaaatcaccaactagagaaaataaaattgagtaatattcttgcaagtagcagaatctcaaacatttgatggttaacttggctgctttagtcaattggatgattcatacaattatggggactggttagaacttgaatggaattggttggactggcacaggcaaacttctcaagacatgtcctcccctcagccttggcaaggcactttttgggtctgtacagctggactccatttcatttatcatcacatttaatattttcttccttttgatgttacctgattataaaaatgagaaatcagttttagtgctattctcatgtttccctgcattcagatttttattcaggcctaaaagtcaaggttttggggaaagtgggaggatcacctaaagttgataatctaggctctgatgtccgattgactggagttcaatcccagctttgaccacgagtagctaggtaatcttgtgcagttttactagatctttctgcacctcagttcccttacatgtaaaaggggtacaaaaataccaatttgccaaggttttgtacagatgaaattagacaggctttggcacatattgcacattcaatacatgttaaacattttatcattttattaatatatctatttcaagatgaaatattaatataattagttgatggtataattagtaggggttctaatttcatacattctcgaattcccaataaataagtgaaaattatcttgatgctagaaaactacatcctaggaaatcttttgttgtaaacttagatgacgaggggctcttttctacccacagctcccctagtttactcaagctccatgtctcctctttaccaaccccgtgtcggcatgtagccccatcctgagcacacagtacaccctaatagatattttgcaaatcaggcaagtagcacacaggagttttaaggacctttatataatttcaacaaattcaaaattctaaatctccatagaaacacctttatgaggaatataaggtaagaaatatttctgcagtttatatggatttaaacattttaaggtcaaatcattgtaaaatgtcatgtaggaagggaaggcctgaagtctcaatctgggtttcaggcagggaacctgaaaacctcacaaagccacacataacactattagctcaaggaaatgtttctcactgtaacaggaaaagggaaagttcgaatagaagtctagacaggttgtactgaaagaacaatcagatgaaagagcaattcaagccgggcatcttgtgcctgtaatcccagcactttgggaggccgaggcaggtggatctcctgaggccaggagtttgagaccagcccggccaacccggtgaaaccccgcctggccaacctggtgaaaccccgtctctactaaaaatacaacaattagctgggcgtggtagcaggtgcctgtaatcccagctatcgggaggctgaggcaggagaatcacttgaacccgggaggcggaggttgcagtgagccattgcacttcagcctggctgacagaacgagactccgtcacaaaaaaaaaaaaaaaaaaaagagcaattagagattgttagcatgagcatgattacactgcaagaaccaaatagttaagttttttttaagtcaaatattgtaatttcaattactcttttaaaaaagagtaattgaaaactctttttaagagtttacaaaagagtaaattaaaaacatgctcttttaaaaaagattaatttataaggttgcacagtactcctacaaaccacattagatacttctagtagttaacaaagaggaaaacaatgacattttacaaaataaaaagcagaattgaatacagaaaaatatgacttaacatcaaccaaaaaccaattgattaatcttgtcaagattcttgtcaagattctcaccagacacccaaatactgaaggattacaactattgcatcattaagatatattaaaagaaatgcaacaagcttaaaatctaataaattggagagtaaacacatatactctgcataactgtaatttaatttcttaaaattctgcaacttccaaataaacaacagcagcagaaacaaaagctcacataaatgggtcacagtaaagaccagttgcctccacttaaacaatactagcacaatcgtgtgggctacatccttgaaagaagtagataatccatgcacaatttgagaaaattgattacatatgtgtgtatgttatatcttatacagtatacattacatcctcaacattaaaaatttaaaaaggccactcacataagttaccttttggaagaaacaatgatcttttctaaagaaataataattggtgatttgttgatacttacagtttatgtttggaatagtctcatttatgggtatgctgaaaacaatgcaacaattttctattaatccagttctgatcttcatactcttagcagttttagaagagctgagaacagtgacctgctttttcaaccattatatttctgagacatgactaatttgaagctgagcaaattgcacataatgggattcaagttcatgatttttagtctgcactctcttttcagggtacatggtctccttccctccctgcttctaccaccacccccaaagctgccttttcaggagctaaattcacccaacatgaaatcaaaagagaattatttttaagttttctgcaggcttatttttaaggaggataaagttatatttttaaaaatatttatcttttccttcaggtactaccgcatttttaaataatttctaaatatttagaatgtatttagatgtatttagaatagtagatgtatcagatgtatggtttcatagtggctcaaagtttttaaaaaagcattatataaatcagtgaatttataaataccctaagttctactatgtaagatgttgctttcagagcctttttgcaaaatcccattaaaggtttagcttacagacactggtgccaaaaaaaaaaaaaaaaaaaaaaaaaaaagcaagcaaaaaaatgtgtttttttttgtttttttttttttttggtaagaaggatgttgaaataggagaatatttaagctggctaaaccaaagccaattcctggaggctagttgcttttatagtgaatgtttaaattttctccatcaaatctagaaggctacaacgaaacaacagcctaaatgtcatgtacaattctctaagtactgaaagagttacacaattttagaaccgaaagggaccttaaactccttcctctaccaatgaggagcctgaagcctgctagttaactcacttgcctggtcactctggggttcacggattgttattgtttggtggggtggttgtttttgtgctgtatatttgtgtgtgtggtgtatgcagtactcacacccttacaaacaagagctttgccatttatattctccccttcctaagttgctcttcctaagtttactttcatcagcaaaaagagtgatcaaaaagaaaaatatattctggccagttcaaaggggacatttctttttctcacttggcctactgcagatatattagagagacacttcacacccaggacaactgactttttaagtggcaataacaatgagcagcggaggagttctcttctcactcgagagagcagaggaggtttctgaactttaccttgacttccagcctacaaactgttccttcaactactgtctccgcttgcccactttgttgctattctttccttagtttcctttgttttccagcttagggaagtttggtgggaaaatttttcacttacattttgttgatatttatttcccatatttgggtcctacccaaattttagatttaagagcaaaaaaaaattactgtttaagtgaaagaggaaaggctaagtcactgttcaacatgggctagatctgatctgaattggagacacagcctttgcaattgaggaaggagaggtaagcagtaaacttatacagtttcctccaagaagtgttatacatagatatttttcaaggaaattggaataaagcagtttattaattgaggggaagctagttacagttagcacctgccgcggactttttgaggttgtcgtcattaaccaaattcttcgggaaaaacaatctttggcaccacttactccagacaaaccctgtttggaacagacaagtgttctgaccctatagtcgctccaatgtccaccagccactcacgagtgcccttagggcttctccttggtggtagcatcccagaaatcctactagtttcagaagtgccctaggaagcctacttcttggataatgggctctgtctgcaaagctaggagatcagcctagaaaaagaaacacaccaacaaacaccaggaaactatgtgtaatggtttgctgcttgtgcaaaaacctcaaagaggatgaaggtcagacagggataataggccaatttaattctgaaagcacaaggtgcaagaaattttaattatggtctgccactgaaatcacacaagatccaatggcatctaactgcaactgctcatcaagggagacaagaggtgtaattgtaaccgctgcataatcactgtgagggcacagggaaggctgccttcagctcccagcagagaaggtattaagagcctcgaaaaatccaatacggggaaacgagattgcatgtagccaaacagaagctcctaacacaaaagccaacccgtgtgtgtgtgtgcgcgcgtgtgtgtgtgtgtgtgtgtgtgtgttgagggtgagggttccagaaagaaaatgtgaagctgtttggcccacactggggataagagattgtttgaaaactctgaacccttttctgttttgtggataaatgcacacagagaaaagagcactgtctcctttaggtatttctctccttgatgaagcttcacccactctcctttgtttaagacaattggcttggatgttaccgtgatttacagtaccaaactccctttaatttgttcccatcaaacccaagtctggagacaaaacgccaagcacacgactggaggtgcccaagcctgtgcagctctggcagcgacgccgccggcgcccccgggcgttttccccgcaccccacatcgcgtgggcgcccgtaaaggcacgcgcggagaaagcccctccgtggactccccactccgcaaagtttaacaaagccgtgaagtaaggaaaccgaacctcccgtccgcgcccgctgcaaagttggcattgaagtttgtgccgggatgtcccaaatcttgagggggcggggggcgcgagtgtgcagagaggcgggaggatggatgcagatggggagacagtgaggggaagggagtttttccgagtggacggtccgtgaggcggttttcttcacccggaagcctgtttgactcagagaggtccgggaggtgcacgccaggggaggtctcccggggcgggcgctgtcgccgaggaggccggcgagctgtcacctgcggggggctgtggtgggagctgagggcgctctcctaagcgccaaaagaggacggggacattcacagtcaccggctctcggggctctaagtagtgggggaagggatattcacgagtgggcaggaggccaaaagcaacacctttcggatacgcttttcccctccgacctctccaacttcccgcggcgctggtcaaggactccctcccaccccaccccatcccacccaacctcccggccgacaattcggacctgtccacggcagagcgtggggtggagtgcggcgggaaagcagagggcgcgaaggtcgggaccccaaattgcaaaccctcagcccctagcaaagacgaccaaatgcatttacaaccgtgcaagtatctcagccttgtaacagagctccgggtttgcgccgggcacagttccccgactcttctgttgttcctaataaagtcgattacgttgccctcccggagctgattggaagggaaccgagaggaaaagggggggaacgcgggaaaaagcgggggggggggggggcgagcaatcaactttgtaacccagcgcttcctcgcgcgatccgtcgccatgcttaagattcccacccccgccgcccccctcttgcctttcaagtggatactgaaactaggccaaaactttttcccctccttttctcttagccactagactggattgtgccccacggagccccatggagctctgctttcttaagcacaatagccggactaattagatcatagaagcaaggcagtgatactgtaacaagtagcccaagaggcaaagagggaaggggcccgaaaagacagaaagggggaaaagtttgcagctctccgcacttaccaatcaagcctcccaccagaaaggcgatgatttggaacacgagcagaatcccaccaacaatgcacagcttcttggtgctcatgttttctataattgccccagccatttttgcgccccccctttttcttttctccttgaaataaatgttttagggtgagctttttgctccctcctctcacacactccctccttcctcgcctcctttctgggcgctgcaaaacttcagaggtgctggagcgcggcgaggatgggaccgggacggaaggcgcccgcacggattcccccggcgcagccggctcgggttcccccaatgcccggagctgtgattgtggccgctccgccgcctgtggacg

SEQ ID NO: 2464 - DNA, 107245 bp, Homo sapiens
gtatgagttttagcaggaggggatatgcatgtacacatatgcatatacatacaggtttatttaaatgattggatctacacttttggaggctatttgaagtatcttatcaaaataaaacgcattttaagcaagaagttaaaaaagcttttcagacccgaaggccatttaatacagtaaatcttacttgggtagtttagcaaacattttttaaaacccacatccaacagattggttagtattagatacacagatttggtttcaaagctgaaatacccctggtggaataaatcttctcatgaaattcagttatattatgccacaaaacagggacacttatctattgacaacttaaatattaactcagtgggctacctggtgatataaataggaaaaaaacagtggtcatggattaggagtgagaagactatgacaccagcctaccttggactgggaccgcaaaggatgttaaaatctatcctagaatttaaaacaggaaaaatgtcaaatattccactccccattcggcccaaaccatcccccaaggaatacacccccaccccacccccacatgaggtttactaaccagctgctacagatgttactatgtcactaattaacaatgatcacagaaaatgtgtcataccagagtttttgttatcatacacaatgcattagtggctgcaggaatcttcctccaaaagctaccgtcagaaggcaaactgacaaatgtccatgccgctggtccaagaaaccacagctaagagccatgaggcattcatttgtacattgagctctctctggcatgctccccactctagttagaggggctggggtatggagagaccgtcccagccgggcgctgcagcctcctactcctgggcctccttgcgggtcaacttgtagatctcagtgggtccgtccacatgggtgatagtggtggtgagctggagttcttccccactatggacacccagatcgcctgaaacagggttttcggtgttagatgcattcaaggaggaaggagaagcaagctggggttcatctcatggacaactgccctgatgctagccctctttgacattctgagcacacagagacacctagggcacacaacattcagaacaaggactaactccaaacctgttcacttggactttgcagaactttttaaaataccatttttggctcctagatgacagtcattaagatacgtgagtcagctcactgctgatattattcatagtaatcattaacatttaatgagcatttactttgtgcctgacgctattctaatcactttgtaagtgatcttctttaatcctcgcagaagccctctgaagtaggcagtatgaacgtgccagccttacagatgaggaagctgggaggtaggcaaggtaattgtcctgggtggaggagcaggcccacaagagagctggcaaaggaacatctgatgccaagaccaatgtgatgggctaaaccagcataacacccctcccaacggatgggtcagtcaggcaccaacacatttgctatgaataatttacaaaataggagccaggtgcagtggctcaggcctgcaatctcagctactcgagaagcaggggtaggaggactgcttgtggccaggagtttaagatcagccttggcaacagagcgagaccctgactctaaaaaaaaaatttgttttaattacctgcgtgcagtaactcacacttgtaacctcagctactcaggaggctgaggcaggaggatcactggagcacaggaattctaggctgcagtgagctatgattgcaccactcactccagcctgggtgacagagtaagactttgactctaaaaaaataaaaaaataaactacaaagcatctatgtcacgtgaaagcaaataagacctgcttatatctatccatagattggggaaggagccatgtctaacacatctaggaacaatgaggggctttattctccaggaaaaaagaagtgccagaaacgtgctgtgcatttccttctgccctcaggattgtcctaagtgttctgaactcattatcagtggacagtgttctgctaaaatggaataatttgaacttttctaaattagtaggagaaaaaaattttctctaagttaaacctcgaaaactctgctacctgccataagacaagtgaatgtataaacaacaaagggaaaatggaaaacgcaaccacgctcagtctgactgtgtgtgggggtgcacgtgtgcacacatgtttgtggagaggggtgctggggaatagaaagttaaacttgtgtcagtgatttttatattgtgcacatatcatatgataagttttctggaactgaagtttttctaatttaaagcatagaattaagtaactaaatgctgttttccattgaaatgccataccataacttagaagcagccttggccctacccttaggactagtaatcttatcactaatttaagaactgctaggcatcaatgaatctggtggccttagaaccccagatgtcactcccacccactggcccagcaggctgcttggctggttcccttcacgtgtgccacgcagtattagtttctcatcgtagacccatttctctgtggctgcacagcaaaatcagtcctattattaaatgccaccctgtaagctctctacccaggagattccctggcctcagaagcagactcattggctgctgcagaggactgctgaagacatttggggctgttttggcaagggtctaatccacaggactatgggtagagaaggcattaaaggggcatcagtccagcctccagcacatccacattcatctgccctcaagccagagcatagatgccaagtaaggctggtgagaggctttagctgggctactttgggccaagctgaaccaccacttgtacagtgagcaactactcccaggccaataacttgtattctcactgctgcaacatctagtccacacctcagtcaagcacaagcagtctaagcttcacatttctcagtcaaagctatttctggatttgcatatctgggctagccatcagaacttcaaagccagtttcatgatctgcatgtctgtgtgagtcatcaaaatttcaaagagtcctgaccaccccagtggacccattagcactcataaccgtttacctaaggaatccctttccctgaggacttcttagaaatagatgctagagagtaattctactcaggctttgaaccaaagatgttaattctttaaacttaaaatatgactccaattagcagatcttagaatatgcatatgatcctacagatcacttgaaaaaacagccaaaattgccttggcttctttatttaaatggatacctatgtcataatgcttaacacgtgcctgacacagttctaaatactgtacaaatattaatgcacttaattctcatagcagtcctcagaggcactattatcatcactcccattctgccgatgaagaaactgaggcacagagaggctaagtaacttgcccaaggcccaagctgctaaatagtgtgtgggattcaaataaataggtgccaggatgcaggctctcaacttttgggttctgctgcctcttcttaaatattcaagtttccagcagccagtgagactgccagtgaggtatgaagtccacacacacagcattacagctaaaaatatccgcatacagccgggtgcggtggctcacatctgtaatcccggcactttgggaggctgacggcggcggatcacttgaggtcaggagtttgaaccagcctggtcaacatggcaaaaccctgtctctactaaaattaaaaaaattaaccgggtgtggtggcgcatgcctgtaagtcccagctactcagtaggctcaggcagaagaatggtttgaacccggaaggcggaggttgcattaagtcaagatcgtgcccttgcactccagcctgggtgagagagtgtctcaaaaactaaacaaaacaaaaaactacacataaaataatttgaataaattgtttagcatatttactttgcttttgtatctgataaatttatagcatataaatcagtgcactgacaggagagctgttataaatttatgagtattggccatatgcactgttaggggtttagcatgccctgtatttccttgtacgatgtgaagctactgtggcataattaatttctctactgtgctggatgaggacccagataatgggactccatgcaccaaaatctatgtttcacatgtgattttattgtaccttgaaggccaactgttcccccttggggaatgggtgtgtgaacgtggcagtaacatagcacgagtggagatccctccacttgcctcctaattccatcacctcctacttctgccaaggtcttgctccatctgttagtttccccctctcttggctcctgctgttcagtgcacaaacatgctcaaaagtctcttcccatctcagacaagaaaaaacccttctgaaaatgtgatatgtgtcttggggtgaaaaagagtgagaaagaaaaaagaaaagaatgctttagtttgcagtaaatttctctccctggttatgatgtcaaattcatcacagctcattaacaattagatgacggtctatttcttcctaaccttgtgaaatgagaccaatctctggcacagatttcatcccaaaggactacggcaatgcatccatatgtgtggagtcacatccacaggtgtgtaagcggctgcttggttgtaactgcctggaatgcctaatgaggatgaagaaagccatatgcactggagacagcttcttaggaccggcagcattttaatgacaattgtttgtgtatctgtgcccacttcaataaaaatgacaacagctactctcattctgaggatgtattacagattccgggagagatcggaggtaccactagaggtcttctaatattaataaggcctacgtacttccatcctcaccactaccaatgcaaattaacaccccactgcccaagtgtgaaagccagggagctcccataccatgagttcatatttgttctcaaggtcatacacaatgtgtgccggagccaagattccaaaccatctgtgtctacctccaaagcttatgttctttccagaacattcatgacctatccttttttgtagaattttccctaggcccacaccaacctctctcctattcaccttcaaagctaagttcaaatgataactttttgtaacgaagtctctggttcacagcagaatgagaaaaacagaaaagtgtagtattttaaagccaaattattttcatgcaaagaactgcttaagaatatgtctgccttacatttttggtgttaatatgattgttatgttaaagaacaaaatagtgtcgctggtgcagtggcttacatctgtaatcccagcactttgggagacagaggcaggaggaccacttgagcccaggagctggagaccagcctgggcaacatagaaagatcttaaccaaaagaaaaaataataataaaatggtgaatggtaggtttcttcttctttttttttttttttttttttttagatggagtcttgctctgtcacccaggctggagtggagtggagcgatctcagcactgcaacctccgcctccagggttcaaagagattctcctgcctcagtttcctgagcagctgggactacaggcgcatgccaccatgcccagctaattttgtgtgtgtgtgtgtgtgtgtgtgtttttaagtagagacagggtttcaccgcattagccaggatggtctcgatctcctgaccttgtgatccacctgccttggactcccaaagtgctgggattacaggcgtgagccaccgcacctggccttttttttttttccaaagaaagtaaatacccaggacagtatgtggtatatagtaagtgctcaaaacacccatgaaagatttgcctggtgcaggcaagggcagttcctctgtactctgcatggctgggtctagcctagcatatcggcactggtgttcttccccactggcatttaggaaaacaccctcagttagaaaacaagtgtgccttgggatagctcagctttgaggatcccttctgggagatggggcagagtggctttggtggacagggttaagagccctgggtccagttgtctctcggtgcctgtcaaccccagaggtcatttattccaggcttggagcgagccattgcccatggacctccaaagcacctcctgacacttactgccaggcagtaactgcaagtgggagaagaacacaatagaacttattagtttgggggtaaaatcttggtgttacaggctgaattgtatctcccccaaactctcaaattcatatattgaagttctaacccctagaacctcagaatgtgactgtgtttagagatagggccttcttaaagaagtaattaagttaacaatgaggtcaattggggatgggccctactccaacagactggtgtcctttgaaagaaaaggagattagaatatagatatacacaaagggaagaccacgtgaagacacagggagaaagtatccatctacaagccagacagagaggtctcggaagaaacccacgttggtgataccttaatatcagactgtgagaaaacaagcttctgttgtttaggacaccctgtctgtagtattcgtatagcaactctagcaaacatttaggaagccgaaggttcttcccaagaaggtaactgagatgtccctatcatggtggggtgacaagaattctaagactcagaaaaaatgattttaattgactgggccaggaaaggtcaggtcactggcacagcaatagccctgggagaggcagggggcagaagacacctgattacaaacagctgagcaaggggtgccaggctggtgacggtccatcagttggttcccaccttcactggggaatgggaaaacgcttttaagacctgctttagggtctgggtccagcccgtgtgacaagaccaatcccatcagtgctcacagacatcaagaagctcagctggccatgggcagatcatctaatgtacaatcagggagatggcgtcaataaaagggggcaaccaatgtcagggcctcaggacttaatccaacgctttaccgaggcaacaaagccaaagccatctttcctatgaaacaaggggcaggagacctcagaaacctccaggagtaaaactgacatcacactgtagctagctgccaagacgcggaaccagtgttgccgcttttgctccccgcagagtgggtgcattagacagaaaatgcttagcgtgaacagaaataggagggaatggtggcagtgagggcatcttgtgttccctctgccacagtcatctagttgggaattctgtgtctcacttctttttttaaaacattctgacaagaattttataatcaaaagaacacaaaaatcaaagctattatcaagaattgtctgacttcataagcagctccaacttcttattcccacctgaattgtggttgagtgggtttgcacagtttttcatgtgtgcagggctttgctgctggagccccgggaggtggtatttttgctctgagaagaggattcactttagcctgctgcaattcatatctgcctgggaagacatccagaatgattcacaaattggttatggcaacaggtaaaaagaacaactgtcatgaaaaggcagcagcagcaacagcaacagcagcagcagcagcagcagggcagaaaatataagtgttccttgaaggaaaggtaactaaaatatctttgctaaatttaaaaatctatatgtgcacgtgtgtgtgtgtacactcagacacatatgcataaaatgattacacatataattctatgtacataaaaataaaatgattaatgtgaatgagtttgcacattcactgccgctatggtccaccagccaataggaaggaacccaggggaagtccacgaaagcctgtggctataaagaatgtggcgccacactcccgcagcacctatctgctggtgagaacactccagtgtggagttgtcctgccacctttcaagaggtagatgaggaaatcttgtcccccagaccaggctaaagaccccttgagagcaaggactatgtctctgtcactccttcgagcttcacttcactccatctcattcaagatggcacaaggctaagtactaaggaactaaggtatgaggtatgagctaagtactgaggtgctccgtggttcatttgtaaagggtcactttctgatccatactatgaaagagaaacagaaatatatgagaaaatgctctttggaaagtgaccttgtcttgaacctgtggcccactttgttcttctctgtccattctatgaccaaaagagagaagaaaaagtctatcgtgaaatgctcaatgattccatttccttcctacccacttctacttcctcctgacacttggcatgtccctccaactcacataccaaacaacctccatcaaagattctttcccttttcttattgcctttggcatcagaaactgcttgtctgtgctccgtccaggatccatctaacaaaggctgaagccccacacacctgggattcactctctgtagcaagatatctgaattcctagctctgaagcttcaaagcaaaggagagaaagaaatagggagggaaaggccaaagccaacttaaagacttcccatgagaatggaaaaggagcatgggaatgctggaggtggagagagaatgccatccagagactcagagaatgtaaagacacatgtatccttccttgcaagagttcttctttgaggtttccacataatattccaaactaggtctttccaaggaacttcgaaatcttggcaaatgctccgtaattcctaggatacatcgtgtgatctggtggcagatgaagagatgaaaagtgaaacaaaatagagaagaaaaataagcagaatgcccaacatggaagagaccccttccaaatgcacaaggtcacagcaccatgcaggaaagggaagggcccacaagctgccaggggttcccgggggtgctgggaaatcacagatcatgttaccaaaggagaactgctaaatcttatgacttttgtgtttaggatcagcatatggtccccaaatagtttgcccactaaattgcctgaagaatgttttttcacagagggtctacttggcatttcacaggcaggacatttctttatgacatgagccttgttttgcctattgaacaacatttagtagcacccctagaatctggacactaaatgccaaaggcatgtcccagttatagtcacaaaccaaaacaactgtgaacatttaaaaacacccacttagcagaggattcaggggatatgacctcttgttgagaattatttgcaagttttccatgaaattacagatcaagctgtctttgatgaaaaactctgttgaggaagagtgaagtgcttttctcaattgcaacatttcaagcctaggagactggctactgtgtagggtgggaagtcctgatgggagctgcctaatatatggctcaaatctcaagaatctgtccaacatggtggtctgtagtcatcctgcctctgcagggttggccacagctctgggctcccacttgctgaacagtgttaaagttggacacgttctcaccagtgtttggaaatcccttacctatgacagatatcactctctgggctgccacttagtggcaagaagtgttcttctgccccttccctgctaataggaagaaagacaaccatggactttcttttcttttcttttcttttcttttgagacagggcctcctctatctatcacccaggttagagtacagtggtacaatcatggcttactgcagcctcaaactccttgggctcaagggatccttctgcctcagcctcctgaatatctgggactacaggtgcacaccaccatgcctggctttttttttttttttttttttttttgtagagatggggtttcactatgttgcctaggctggtctcaaacttctgggctcaagcaatcctccagccttggcctcccaaagtgctaggactataggtgtgagccattgcacccaggctaaccacagaaattcgtagttcaaaaggacttttaggagatcacttacatttgggagcagtggtgcacagagggttaagtgttttgccaacagtcacacagtaaaaacaaccaaaagaatttatgtacataaagtgctgtagcacacagtcagtacttgataattatttcccaccggtattatcattccatcatccaggaagtccagccattgctttaagtggtatttctctggaaggtagaaactctacctactcacatcaaggacaaggccacatggtttccttcagtgtcccccacaggatgaccatggaatgaaatcaagattcttgtccacaagcccagcagtgcttgctgctcgtgttgtggaagcccactgcttgacaggctgaatgctcccattttccacatgtacagtaaaaacaccgagtggtgtttttactagaaatggaaaggaagaaggctgcctagctcacaagccttctagcaaaacagtcagtcaaaccaaagttgggcagggggtaggtaagtaaatattctgtattctcacctcagaccagagatgggcttgaaactgattgtaacatgtctactccaaagaggtcaaggggtgagggaaactcatgtccagcatgctctcgcatggacatggcaaatacaggatgaagacagacagtggctgagaccactccacgtcccttgacccccagcacagatgccttcctctcctgctccacttcatctcatctctcaagtaactacccccctcccttctccccacaagatcactgaaggctaatctagaactcttacttctaagcattaattcactcaatattttaaaagtatcctaaagaactggtccttgccctgaaggagtcgatgatccagcaggagcataaaggcacagatgactcatcttccacctctacacaataaatgtcatgtggaaagtagactcatgatcccctaggcatattccttaggacaacagtttcaagagatacactgcctaaagaaagggtgccagggccaaatgatctaataattctggaaaatgctgttaccaccccccgctttgtaaagactgacagtacaaattaatgtactaaaggcattaacatgtattgcagtgaaaagccttattagtgctgatcaactcaatcattctcaagcatgtttgactacctaaatttatcaacatttcatggagacaatattccattgaatgtcatttgctggattctaattggggtgattgggaataggtgttaaagaagatgctgcattttgactgggcccaaaagatgagtagagtttcattagtcccagatggaggcagaatgtgcaatccactcatgcaacacacactcactgagtacttcctaaaggtgaggccaacccttggctctggggggctgctaccctggtttccactgcaaggcagagtgaaaggcactagagcactgatttgagaaagggcttcctatgtttggggaatagcaaatgcatggctagagtaaagcaggtgtaaaaagagacagaatgaggaataaggctgaaccaaacagaaaaagcatctattagatcagttgtttatcaggccacctgttacctgttaacagcactggcctagacagtgttaatcatttctgtctgctgtggctagtgaagaaaccctgagcaagatcttcccttctctaggcctcagtttctttatctataaaatgactggattctctaaggctacttgcagcatccatgtctcagtgttctgtgattataagatataaaaaggcagcagcacataccagcactaaaggacaggaagaactggggacaggagaatagctattggtttagacatacatcgaaaaatcaccttgaagaaaaatgagcagaagaaaaatgaagcctattccatcttcagctctcagggcccagactccctccacctgatatcttaggattctgcttctcaaatgggaagaataaacatggcatagtttccaacagtcaattgtgctcaaaaatgtaaagaagaaaatttgactcttgttctaaaatcaagacatattttagacttagcatgcaatattctcaatgtattttagagatttaaaaatgaggacttaaagaaagatctggcttgtgtgggctttttgtcttatgggtgagtcccctgggtgctcattcaccgtctcccagtgtgaggagtatacttggagggaaagtttcactgggcatctcagagctttagccatttaaatcttgtaaagacagaagcctatttatcctgacttaagctgttctaaagagacagaaactcaccattggactggtcttctccatagtttttatgggatggtgcatacaagaacatcagagcaaagacatacagattccacatcccatagatgcctgtgaaaaaggcactgttcacttggactgtgacgccgccccatttccaatggccttccgttacctgcggagaaaggatggtgatattcaattgaaacagagaagaaacagaagaaacataacaccaataaaggaaccaaccaacatgaaaaccaagtctcttctacatgtgggaaacatgaagggccatgtaagactccatcttttaatctgaatcatttcggtgtaaattaaggtcaactgaaggttctctagctttctgtcaggcacagtcagtggtccttaccttgcccacagattagtatcacctggggagtgtctcttcctaaaaacagcaattcattgctatccctaagttaaacaaactgtgtttgagcccatcacttattcacaattataattcctcctctgctgtctgtcttcccagctagatgtcaattccctgcaggcagagaccagttctctgctgccatgtctttaaggcctgatgcaccatagattaattcaaatccagtgtctaccactcactcggcttaatgtaagacaagatgaagactccagacttcagaacttcagtgtccgtaagtgtaacataaaagcttgcaggttatcgaagagaattaagtaaaaatatttctagaacctgcctggcaggtactcagtaaatattagttatttctataacatcccttgaagtaagccactcatgaaaataattatgaagctttcatatgcttcaaaattctgcaagagatgttttgaagctgcttttgtctgtgttaatgatttggtaattgtcttaagggctgcctaaagatatatggattacactaagaactgtcaacagagctgctgagctaagtgactaatttgtgccagctctgagacaaatgaaatgattttgaccacttctgcttactacgggacacttaaaatggaaatagaagaaagtattgggtaaatattcctttgacagctgaatgaggctgcgttgtataaactttctctaggaatcacttttaaattgtaagatggcaggctagattgaaatgttaagaactttaacaagcaggtggatttcattgcctgtttatgatacagtgggtctgtgttcattatcttctgtataatccataacccacttggggccctaggccaaattaaggtctaagtataggtatttttttctgaaagaccaggagtgtcagttaaccacattagccaattatagacttagcagttttagtttggccttggtgatacataattcttcactttttgtgactcataaacaaaccactattatgaactcttatttattttggaaaataatgcattttatataaaatgcccagaagtgttttctggcaaagatggatttcataaccattactaattttaggacaatgtaccagcattcaagctacttaggacttcttagaaatgtctccaaatgtcgctcttctttaagtgcagaatatactaactttataaaaactatattacttagagcatcttatgatgatttttattgcatataatggaaaggaaaagaaagcattaagatagtttccagaaatacaggtacctgctgtcataacacagagaactcttctgtatgtgattaaggaggggaggctaggctgtcacgcatcctagctgcaagagagaatatggcaatatggcagctcttctactctgttaaggcagtggacccttcagctcagggaagggccagtaagagaccctattcctgcgacagaagctggaaatactcaatattgacaattttagtgacattgattcttgctaggattgacatgactgacccatctaaggaaacaccaacctatgtgccttgcacacagtggtgctcgatagacatatgttgaatgaacagaggtaaagtacaggtatgtgtagggactccaggacaaatacatggaggtagaaagtggagatggaaagaaccactcttaaaagtacttgattgaaaagtaaagacaaagtattgcagtccacaagtcataataattgaatttaaaagtgagaggagatgccaatgtgtgacaagtgttattcatttaaaacattgctttccgttatacttatttaaaataagtggttaacacaaatattagcaaagctaagattcttttgtattcataacaaggataagcatatttattcaatgctaatgatgtgccagatacaatactaaatccttttacatgaaacacattatttagtcttattaatgacgctgtgaggtaggtaggtaatatttccattcaacacatgggtaaactgtggcacagaaagatggagtatcttgcccaagattgctcagccagaaagccatggctctgactccaaaagaaggtattcttaaccattatacaacacaagggtaggaatgctatcttaaacaggggttgatctctgaaggtagcacatgctctgaaggtagcacatgaggcaacgactatgtaaggtcaaatttccttttgaaattcacttcattgcccataatgtacattacaaatacaacatacatgcacacatttgtctattcaaatctgtatagtatgcactatatatcctggacatagtaacatatggtataaactggatatataaacaaaataaaaacttacagtagaaccactggaatgagatgcccatagtatgagaggcacacaccaagcctgacaggaaatatcagactcatgctcccgtctcgtacttgctctgggacacatgcacattgtttagagtggagttgcagaattacacaccctactgaatgtgcaatctgtaaatgtggtgtttcctgctgtgggcaaagagttgaactgcagaaataaacggtatagatagtgtaactctgctctttggtggctggcttgtttttccctctcctctcccaattattcatgcctaagacatcctcagctctgagcacattcccaccaatatgtaccacaatgagcagcctcaacagagcaggccttgtaaatccaaaatcttactaatgccaaggcggaggtaacagtctccccccttttaactttgagagaaaaatcaggtagccccagcccccctccgccaaaccctcccccctcctcaaaatccccaaatctcaccctctgcataagtcttatttctaaaagtccctgtttttcctgattttacatttgaacaatttacttttgtgtgaaaccacccaattatacccctggagccaagtgaaggtcaaatctctttacacccagtagtcttgacaaccaacattccacttaacaacaagatttccaaatcccagacacaggctctcttaccggaaacatttcctctgtaagtaacagaatgaagtgatcacacacacacaaaagagctggggacaggctctctgggagtttgctgcatgtggcttgacctgaatgtcaggcacctgggggtccccttaatgaaggtcggtgaccttctcccctgcactgcacttctgttccctactgccgccacctctaaatggaacgcctctttcttttccagagggaaggggctgaaataccagactgcgatgtaccatctcttggttgctatgactgaggccattaaaatggcaggcattaaaagactgcacctcagtacccagctacaaagcctcaaggtcactgcattccacagcttcccgtcgcctttcattcctggcctcagagcttcaatatcctggcgagatcccctcgcattatatttcatgaggcttaaatgcaagctctcccacagcaagcccgagagtataatgggggttttaatacattccttttacctaaggctgggatccatttcaaaaagttacccaataggtttcctttcaggtgagctcattgctctgacattccaaaatgacattaaaaaataaatcctctgatgactatattaatacagtacctgggacactgagagttatgccggaaaacgtcttagatgtctataaataaatcttagaaaaaaaacccagcaggaggaatgtgaggagctaatggaattcaaaaggcctcattgctacccccttagagttgaaatccactccgggccgactgtcgcagcagatataaaaagccagccacaggctgaagctgtattagaaaatactgaggcaatagaatattaatctttttctccaaagaaaagccacggactatgctccttggaagatggcttcctttgctataagaagtacactaattaaacatgtacaaggttaaatcctggcaacatgcagctgcttcagggatcagtccttcttgacttcaggtgggaggcattccccgcagaggcaagatatacatgaggcagtgtggggagaatgacgtcagcctcccaaactggcacaaggacctgtgtgtggccttaggatcaaaagcgtccttctttctgctttcctaaaaacatatcttgaaattgccttttatgcctcaacccatcttccttgagatgccgtttctccaaggaagtgctctgtgccctctcagccttgcaggtctggctgtgtcaagtgccactgtgcactactgagggactggaggaactgaaaagcattttggtcataggagggaatagccacgggagaagtcaggcctcagacactcttgtttgaatatggatgtttgagccttagctggtagaataaaacactctttcagagtttgaaatagttttactgcaaatggagtggaaagcgaagtttccaaggttttataaacaacctgatataaacacagcagtgttgtaggtcaaagcagatgtggtgaacagaacttacaaagacatatatgtgtatcagtttattttttccacgttcatttcaacctcagcagagctagcaacactaacactccccagtggcagagccaacaacagggctctagaggctccaaacttggggtcctcttgggtgtccttggatagaattcaaggggtccataaactagaatagaaaaaattatatattttcactagtctctagctgaaagataatgtttacttcaattatggatgtagaaaaatccctatagtgttagtactactgtgattttctcaatagaaatcatgatattttcacatcaattacagttgtagatataaatctgtaatatacctgtagcatctgtttcactgtaaatatatattacatataatatatagagatgattccccttgaaattcgaagtattttattttacttatttgaaaccattctaagaggagactcgtagccttcttcaggttgctaaaggggtccatatacaaaaatggttaggagtccctgtactagggaaacttcccagcagaatggagcaagtcgtgtcctaagacactatctacactactgaaatcctccattttggctaaatgacaaagcactggcaaaagagtcagaaggactgcgttctgatctctaacttattgcatgtcctttggcaagaaagacattcaagcttcttgctattcataagaacacagctactcatgcttacaatgtgccaggtgctctgctaactacatttggttgccacaatgatggttcagtcaacaacagaccacatgtatgacagtggtcctgtaagattataatatcatatttttactgtatttttctatgtttagatatgtttgaaatacacaaatacttaccattgtgttacaattgcctacagtagtcagtagaggaacatgctgtacaggtttgtagcctaggagcaataggttacaccatatggcctaggtatgtagtaagctataccatctaggtttgtgtaagtacactctatgatgttcccttaatgaggaactcacataatgatgcgtttctcagaatgcatccctctttgtaaatattacttcctgtagtcattacagcaaccttctgtggttctattgtaatatttattttgcagataagaaaattaaaccttagaactgttaagtaatccatccacagtcctatccagctaggaagcaacataaatgaaaactttctccaaagctattagatatcatagtctagcaagctaggataacaattcctgccctacttacctcgtaggatttttgtgatgctcaaatgaataatagatacattagatttaaacagtacttcccacccttcaaaacaagttatgaatattttaaaatgattgttattgagattttcaagtatagcaaaatgttgagttttggaaataaccagtgaaaagacaagatgctatcaaagagacttttgaattacatttcatatttaagtggcaatataattattacaaggaatagctgatggactgtataaggatctatgttaatgctagataaaaatggaatcaaatttatgcttgttagtgttgtgctacacggcttgataagtttttctcataagtaaataaaatatgtgcccttcaatctggctgtaggcttttaatttatttggaaacttttatctcctacaaggttttacggaaagagaaaatttagtccatttggccaggtgatatcaagacccagaaaaatatggcttgaccagctgtccagaattatggcctctctcctcctttcctcagtggctctattgaatttctgtgcagggtagagggatctctgcagagacattctcaccttgacatctcagggtccacttacctgactaacgatgaagaagatgacagtcatggcagcgcaggccaaggtgataagcatgaggaacttgaacctaaaaattagcccctattagaaaagaaagagtagtttaatactccatcagctaccaatccttttctcactatgtaaatctataaaaagcttaattttaaagaaatctgtaaaaccaaatccctaagaatgacagtaaaatagtttcccatagtaatatttcttctgcagaggtgagtgtggctgaaaatttcttgggccaagtatttcctatgttcttatcactcataaagcagcgatacgagagcctgggaaattatattcacaacacgtcgtgaggctgctaatttccctgctaagctggttatgcttctctgcaagggttcaaagttaccaaatccaagttttctgtggttgtaataaaattctgctccagtgaacaaaaagaaatgtgcatattaatcaacatgaagtggatttggttgaattttctcatgtcactccagctctggagacaggcaagccttagaaagtgcctgtggtttcctaagagcaggatttaagagaacctgtgtttcagagagggaggcctattattcaggggctcttctgtgcagatctactgcatataaaaactctgaggttctgtagtttctgcttctcttttcatacaggaattaggcttgtttctccaaggacagccacttaggcatgaacccaggggatccctgataaatcaaggatgtgttgcttgcattggggatttgaggatgttaagtgtttctcttgaatgaggaacataatctataaacagagattactgaactctgtctgagcatctgctggatattttaggggaatgtggcctgttaagagtctggaaatcagatcacgtgggctaaaccctgtttaattacaggacagggttgattctgggacagaactttgactaaagcctcatcccaacaaaatcccaattatgccatagtccaatctcccagctagtatgtaacctacattccatcaccaagctgaagaaccggctgaacaagtttattcattactgaaaatggaaacacatttgtaccacagaaaacaccaagatttaggccagctagatgcttctcagagtaagatttggcctctaattttgcccagagatcctacatgagaatctctcaatttgtatttcaaagtaaaggctttctatctccagggtgtgtgtgtttacacatcaagtggaaagatcaagcaagcaccagttccagaacgagccaagaaatctgcccacctcatagtgtagccgccggactttgctcatagctggcaggctggactgcttcccactgatgttccgaaacacctgaaataccatgaagcatagaaacaggaagtagaggcagaggcagattccagccacgatgatgaaggccatctggtcgtgtccagtaaaggaaacaacgggctagccaaggccaagttgagccgggtccaggcccttctccccaggtctgttggcaatacttgttttgtctccaaatatgtagaaaattttcaaggggataaaatattaaaacctgatattctaatgccaatgataggtttcttgacacattagtaccacagagggaggtgttcaatattgctttctaaaccaagtaagaaaagaaatggtgtcttgcttgttagaaatgaagaatctaggccctaccctagacctaatgaatcagaatctaccttttaaccaggtccccaggagatccgtatacacaataaatttgagaagcactaataaaccatatattcgtcactatggatcagatgaaaaaccacagtaaaatcaccagaagggttcaaatgtagatccccaggtccctccctagatatatggaatcagatattccagggctaggacatcaagtatgactatgtttgggaaccactgggctagtccttggagttttataagaatgcgattgagatactctggcataattgaagaggagatacgtgggggctcagtgcaggggacctgggcatgggcttgaaagtcttaaagtgaaaccagggatgaaggactatttgcaatcttctgtcaccacagaaaatcttgtccaacagaatggggattcaaggacacatggcacaggtgggagtctgggttgctgccagtatacttgagacccactagggagactgacctgccaattagagccagtctgagaaccaccaagtcttaggatagcgtgagctgccttggaaggcagatgacctgattccaacccctttctgctacaactttgcccaaattgcctttttttttttgagacagagttttgcttttgttgcccgggctgaagtgcgatggcacaatcttggctcaccacaacctcctcctcccaggttcaagcgattctcctgcctcagcctcccgagtagctgggattacagggataagccaccacacctggcccaaattgtctatttttaaaagcatttaataagtatgaacttggcgtgcatatttcattaaataatataatatctaatgcagtttctccttctttcctataatgaacatcatcctggaatgaagggaatatagttattttctgcaggacttgaaattttactcactccatcctatctacaaaattaaaaaagttgaactagatttaacattagaaacattcttcttgttgtgcagctaacatttggtgggggcataacagaggaagggtagagcttctctctcatctttgaggaaatgatactactgatttagtttgctcacaatgttcttgtgacactgagaaaccaatataaacatcatggcaagacaaaggatattccctagcacgtggcaagatatgagccatcaaggaagaatacaacccaagcctttctctccactccagagcagagtctttttctcccaagatcatttcacatactattccggaagataaaatatttaaatccagcatcctaaaagggataagctaagactgtcacttctgcttcatgaagatgacttagagtttatgccaaccaaccagaagccttggcgacttctctggaactaatcaccttagccttatctccacttggtctcaggaataaatagcagcagtgtgatttgccagcacaccaaggtcacttaagaagtctcacacataggtggtttcagaaacaggctcttccacaggggcccagagatgaacctccatggctccagggaaaagctagtcatgcttcagtctgcaggaaacagtgtataacagataattcagacaggctgcagtaagcctagcaactcggatccctctgctgtgaggataggctgtgaccttctcattttgcctgctctcacccaggcttgaaagcaagcagtaattcttcttattattagccttaattgtgctgttatgattggcctgagaatcaaagccctggctgagtacatatggggagcatcagcagagccttagaaaatgatcttggggactgggtggccaggggaagaaataaaaccctgagcccatcaaggaaggatacggccagctctgttccaatgtctgtagtccagatactgtagaagggattcgtgagttgtacccctctacaaagaaaatgagatggaaaggcaagacacaattaatacaaaggcaacgggaactttccttttcacatattcttagcttttcagctgcaggggtgagggctgtatttaggctaaaaaacattacagaaatcctaaagagaaatgaagcttgtagaatacatcggcccaaatatttttcaactgtaaagagctgtgcctttgatttgatcccagaccttgtctgaggatgtgaccacgtccagtgcttccaaaccaaaggttcccgaccaccattctccttttcaaacactcctcctaaaatgacaggagtgggcgtggtgatgcacagtttggctcagtgtcccacaaacacttgctcacctctcacacatgtcaaatatgaagaggcagaaggagccaacggcaatgggtccgacttgcttccaataccctgcgatgtggttccgctcgtgctgatcctgaggaaaaccaaattgagaagggagatagaggggagaggaagaccaagcaattctatgggggagtcagcattcgaaggacacttgccgaccacctattgtgtatcaagcactatgctagattctaggtatgagaacaaagaagatgaaaatctcttcttcaggagctcatctctgtgggggagtctggcacatacgtagaacatgacaaagcccagccataagggctctgagagtaataagaacaggatgccatgggaacacaaagaaaggcctcggctcccaggcaggggacattttgtggtccacaaaataactcattctgaattaaatttctacgtgacttgtaacttgtgtttataaaagtgactgatcctcagaagacaaagtaaagacattaaagcatttaaatatgtaaagtgtgtctattatggtgaggaaaataggcatattttctccccatccttattaaaaccaggaatgagtccccttgataaacaaagacaccaagagaaagaaaaggaaggaatgtagaatgagaaaaaagggaaagcaaagatgatcttagcctccaggtggggccccaggtgggtcagtccacaccagctccctgcggacaatccttggctggcttcctggtgctggaccaagttccatccactcccccgccctgctgctgaggcctcattctcagcgcatctctgctggaggacacctcatggagaaagaccccttaatgtagacagtttagcagtaggaagaagtctctctctctgctctcacactgctctcctggaagggcagcaggacttgagaggtctggttttcatgattgagccataatggaatttaaaaacagtccactctgctgtgaagcccatgtgcctgacgtgaagaccaagttccagctggcatatcatcttagccacaatgtgatgatgacaccattcttatttttaaccatggtaccttcaatccctcttgaaatatgatttggtgtctgtgcaaactgaggagaccgggaaggtctgtatttcagagtaataggggttactaggccacctggacacattgccagctggaaagagccaggcccacattctctgatggttaacctgtattcctggggacaggacaagcagggcagaagccagcagacaagaaactcaagctcaagggcaagaaataatactaatcattagaatgtgtgtgtttatcttaagttactcacattctgtcatttaattctcatgaaaaccccatgcagtaggtctttacatcccattttatagatgagggacccgagattcagagtgataatgtcatttgcctaaagccactcagctggtcagcaggtggtgaagcaggaatgtgaaccagagggtctgcctccagagttcccacttgtaactactagtttattctgtctcacccactgctgactagaggcaaaggggggcaggtgtcagcttggcagcctgcacagagcagctggtacagacgtctgtccctcccggcggctcttaccatcatgtgctcgccacagaagatgatccagaaggacagaagcatcgcatagaagatgccctgtcggatgtcaccaaacagcagcatccaggtccagtcaaacccgatggaaaaccattccactgggatattgataaaggtcatggaaatcccaagggcaaagatgactctgatggtgagaaaatatcaggacagccactttattcatctggaaggcagattttcaaacaattccccgaattcagttttgagacatgagatgttacttattgggtctgaagccatatgatcaatttcttctgcacagagatgcaaaacgtcctatgtagttggcactgctgcagaatgagggagtgctataccaacctttctatggaagtgaacctgacctccttaatgcctcacactttactttggtaccactgcagatggcagtcttcctataatgtttgtgtccccttgccttctcacccaggcctcagtgagtacaattgtcctctttcacctattcaggttatcattcatctgatcattaagaacactcattattattgtgatatcctcagcaactatgaattatataagcatatttgtttcaataatacatgactccaaacacatttgaaatgtaaattctcttgactgcttgtttagcttttattttactcttcccctgtcacactaagaactgccaattctctactaaaatataattcttaagtcactgatttattcatacttttttccatccccttgaaacacatatgttaattaagcacagatcatgtaccaggtattgtgttagcactatggaatcctaaatgaacaggacctgttttttcactcacgggagatacagttagtagaggagccagataaagagacaactgaatagattaggatcaggaacatcatagagttttaaagcatagagggctgctaccaggacttctgactttgacacagacaggaatggagctgacttgtgagtcaaagtgagggaagtggaaagggtgtttggaggagagggcagagcctggatggaggcatagaggcctggaagaacctgctgcatttggggatctgcatgtggcacatcaggaaatgacaggacatgagaccagagaaacaaagagggctgtgctcatgaagaaacttgcataccccactggagaactgaaatttatcttgaagagactttttattggaatccaataaaaagtttaaacaatggagtgacatgattcattcaaaaaatatttattaaactcctactatgtgtcagtcactattctaagatgctgggaatataactgtgaacaagaaaagcaaggattgtgctcttgtgatgcttgcatagagatggaatgagagagggagtacaagaaaaagataataaatgaagaatgagcatcatgaaaaaaaaagctaggcaagagagtggagagcaatggggatgtgattttacgtaaggtggacagacgaagagatcagcaggtgtgaaggccctggggtgtgggtttgagcacaataaagggggctggtgggtggtggagaggacaagtgacaagatcagaggtggaaggcacccaatcatcaaggggcttataggtcagggcaaaggagatgaaaagccagtggagagctttgagcagaggggtgacaggatctgattaacacttgaaagggggcactcctggctatcctgtgaataggctgcagggaggcacgtgatggaagcaaggaaaggggttgcgaggctgttcccactgatccaggtgagaagcgatggttggttagttagattagggtggcagcagtggaattggtgagatttcctggtgaggttgatgagaagtgtgaaaaacagagacatacaggatgactcactgctacatttccagtctgaacaactgaaaggatggagttgccttttactgaaatggggatcctgggagggaataggttggaaatgggacacaatcaagtgttgttcttggtacatgtgacattttcaatgcaaatgaagacattaagtaaagagctggaatatttgggtccagagttgggagaggctgaggctaaagatacagattaagagtcatcagagaatagatgatttttcagaccacaaaggtaggtgaaatcaacccccctagggaaagcacagctaataaagagaagaggtccaaagcaggtgccccagtcccaaagtctaagagtctggaaagatggaaggagacaggaatggaatctaaatgctggtcagcaaagaagaatgaccaacagaagggtagaggagactctgggaagaaaaactgatcaattatgtcagatgctgggatgaataaaaaaaaagtgaggaacaaaaaatgacctttggatttggactatgaaggttgttggtgatcccgtgaaaagcagttttagtagagtggtggagatgaatccagactggaaaggactcaagagagaacagaggagaagacatatgcacaaggtttttgagaagcattgctgtaaagaggagcagaaaaagggtatgtggcttcagggggaagtgggaaatgggagaattttgtctaagaatgggagatggcaggacatgtttgtatattaatagaatccagcagaaagggagaagtcaatgatgtggagagaaagtaggtacatctacaggagcactgtctttctgtaagtgagaggagctgggcttaggggagtttcttcactacaacacagacaagtatctgattctgaccacggaatatcccgaagagcaaagacaggttaaagaaccagaaaggtcagctgggtgtggtggctcacacctgtaatcccagcactttgggaagctgaagcgggcaaatcacttgagctcaggatttcgagatcagcctgggcaacatagggaaaccctgtctctacaaaaaatacaaaaaactagctgggaagcatacacctgtggttctagctaccgggaggctgaggtgggatgaccactggagcctggaaagtcaaggctgcagcaagctgagatcccagcactgcactccagcctggacaacagagtgagaccttgtctccaaaaaataaattaattaattaaaaagagccagaaaggtgagagaggtagaaccccgaggatttacttaataacaacttgcataggaaaactgcaggagaaaaaggagtccaggatgactcctggtcaaatcactggcctaagtcacacactggctgcttgaactggacaccagcaaaagcaagagcttggcagatcatgagaagccagtattcctgaagagcgctccaaaaccagctcttacttttccagaagcactgggggtcgggacatcatggtgatcctcctccaataccacaccataatgatgaagatgctgggcgtaaggaaggtcttcatggcaaaccacaccttggtgaagcctccattttggtggatcccctaggcagagaccagtgataattttgaaggtgaatattatcttagcatttccttctactagcaaatgcttttgtgggagaggtaagtggagacctcgtctgcgaatgttcacgatcaagagctttcacattcatagcaggtactgccctcatacacccttggactctcctcagagataatagaaatacatattaaaagagccctgtgctatggacctgagaccagagaaataaagagggcatcccattcacaataacggctttcatgttctggggtctgaaagaagaacatggggctttggggcagggtcactatttccaagagacttcgaattatcttaccttggactcatcccactgatattaaaatgctaatacctaaagatacactttagaggtacggattaatagggcaggtatggattaatagggcatacagggtgtatgatatctacccagctaccacccccacagtgtaccccccaaaaaagccacatttgaggtagaaccagaaatttcaggtaaaaagcagagatatcctctatctcttaacacctctcttggccgtttaatcctcattctaccctcacatcttactaatctggtctactaaggctacaagagctttttccctatgctaagattacgattaagtacatgatcaattttttttgtaagcttttcattagaaagttgcagatatcctagatggtcaatatgttgagattggtaagtgttaaggtaaatctattctataaaatgctaatcaatattggaaagtatatttatattacattcaccaatttatattacatataccattaaataaagaaagcaaggaaaacagtcagttcaatatgatcctactttttgtaagggaattactacgtataaaaaaaagcctggaaggagatatatcaaaacctgaacagtgattatttctctaaatagtaggacattacaggtaattattatgcttttctgtgtctctacacaattcttgtgggactttgttgagattgaaaagaaatggcctccttgcagcaagttctaacttttccccaattaaacaaatatgatggaaagaacctaaaccacccctattccttttaacatttgtgcttgcaaggtgaaacacataaaaaagaaaatttacttttatctcagtgttattcattatgcaatcatgactatttcatgatcttatcatcattgtaatgatcttaagtgatcttaagcccatttaaaatcttaagtgggcacaataattgcattgtttcccatttctgtaatctctcacacaaattagttcactttatgatctcagccatcatgagtatgttattattcccatttctcagatgagacaggtgaggcatagaggtgccaagagtgagatggagttcccctccaatacacatgtcaagatcaattacattcacttaccaccaaccggatatcctttatctccccaattcccacattgattttcttcttctcattcacaggcagccggatgtttaaaaggtaaaacttatgggccacagacccaatttccatgaaaggaaggacatcacattcatagtaacggccctcatgctctggagtctggaaaaagagcagagggtttgaggcagggtcactatttccaatagactggctctgaattctgttaccctggatccataacatcaattgtaagcagctaatgcttaaaggtacactttagacgtacagagtaacaatgcatactggaggcatggcgtctacccagctatcccaacctaaaacaaacatcaacaacaacaacaacaaaaaacagctgtattcaaggtagaaccagaaattttaggtagaaagcagagataccttccttctatctcctaacacctttctaggctgtttaatcttcattagaacctcgcatcttacgaatcttgtctgccagggctacaagagtttttatctgcagtgtgttgtcagggtcctctaaggctctgtggaacagtcagcttcttaaacgttcaggtggaagctcttgctgaatcattacactctttaatgacggctaattattctcctgattttggcctgagggagaagctagaagaagctgaaaatatcttctttttattcacttgccaggaaaaaaaaagacacaaggagccgttggtatttagggaaggtcgaaacagaagaaagaaagataataagattagtggccagagatacccactaagaattttctgcctccggtgcttcctaacagtccaagatggcagaagggaatagaagttttaatgaaataagaatttagcccagtgtctaggaaagcctcttggacttcgtgccaaacaatttaagagatactgcccagagcacggtggtgggaaattggacagtagggagacaccttttttttgaaaactaaattctgctccacctcaccaggactcccggctgtgtacctgctgaggggtgggggccaggggtaaagatgagcataaagaggcatgagcttcagcaggccgggacttttccctgatatagaagatgagagtctaccatcaatgttgggtttctatgtcagcttcaatgtttccttggcacctcctgatcaagtgataggggagatctaatttgtcgttcctaagcctgaatttgcaagacctccataatttgtcataaatcttcagagcaaagatccactgaagaagtgagaagaaagaagataacaaagagtccatagtctaagagtatgtaggaaggggctaggaaggggctctgccccttctgagatcttggctggtggggagggttccttactgaacagtcagagcttagaatgcagtaaacagacctttgtacagagacagagacacacacggcaaggtagaggtggggaggtgcttctacctcctcttgcccaccacggcacacataaccaatcagtcgtcaacagtttttatccctaaggtgtgagcagctcttgtcagacacaccagttgattagagttggcatgtgagatttttaaaaattcttctgtagaaagaatgctgctttttcaaacctcagctgcaggtcagatgattcttcctatatagatcatctttctctcccctccactcctttctctcttatactttcaaatcagggaggatgggggctctgcaggtactactaaaagttcactgcaggctctaattctccctcagattaagctgcagtgaggaggctgattatcctctgtggtaacagcaagagggtattttctgatttgtttccagttagggccttattttattgatggaaattgagaacttgagggcggaagggaacaaaacctacttagtctaattccatctggtgtgtgtctcgcccagggtcccaaaagtagtagcagaattgggagaaggacatgggccctgcccaaaggcaggcattgtgctgtgataaagactcctgaactccaggccaggaggctgattctagtcctgaccatgttccttgctgggtaccttgggtcaccctgcctcatttggcctcagtttcctcctaagtgagaaagttaagtaagatgatctccagggtcacttctaatcccccacgatgggtctctgggtgccccacacttccctgtcactactgagtgagtaacatggacacccttgacacaaatttacctaagttcaaattaaaagagacacattggcatctgggacactggctcaaccttcctgtctcagagacaagttcgttgtatcctgttagagacttttcttcatgcactaaagtcctgcctctgccagtatttagggcatttaagaagattcctctctctccttcctttgccccacccccagttctcccccaactccagcatgagactagctcattaggacaaattacagcaggtggcaacttgacttttttttttttaacttcacaatccaccagggactcaaaagctttaaagcaatttctcatttaatcttgagactcaagactaaatttcactgcaatcaaaaagcagagacttgatgattcatttccttcgcacttttcaagatttaatatctttcttgcaagggatcaacacatcctaaagataattaagcattaagaagcagttgcaggcaaacacccttccccctcgctactcagtgccctccatgtgtataaatgagaaatgacttttcccttttctatggataaaattctgtatccgaaagccatctagcttagatgttcaaccagtatttcaaagatgcagtcaacttgcagagatagctagaaaggtttttaattttcttggttgcatgcaaagatctgaaaatgttagctgttcctctctcctgcttcctctagtttgtctatcattcatttctacctacaaatggctttctctggaggacagccctatatttagcactcagcagagggtctagggcagtggctctcaaacttcatagagtttaataaactgaaggcctgttaaaacacagattccttgctcctacaccctgagacattgacttaataggttctgggtgtgccctgggaatctgcctttcctaaaacctctcaggtgatgctgccactgttggttctcagaacacattttctgtagctttgttctaggaaacctgcgggagggagactcccctagtgtttcaaaaaacactgcaatgggtacttaggtttacccatggagggccttagtttatatgttttctcctagtggcccatctggttaatatccgctttgactctcaaatatgtcccagacaagatgttaaattagaaggtcatcctgcctacgtcattgtatcatctagtccaggggtgtccaatcttttggcttctctgggccaaaccggaaggaggagaattgtcttgagccacacataaaatacactaataatagctgatgagctaaaaaaaaaaaaaatcacaaaaagaaattataatgttttaagaaagtaatgaatttacattgggccacattcaaagccgtcctgggctgcatgcggcccgcaggcagagttggacaagcttgatctagcccttaaacagactcccaaggtaggtactcttatctcatcttgcagaagaaaaactgaagctcagacagattatgtaagcttacctgaggtcacaccgtcagtgataaaaccacctaatctttctcctctttaggaaaaaaatggctaaagctggggcaaggtactcagaggcttcaacctcatgtttttactattttgcaggaaatcttaacagtaataggcaaaagcaaagttaggaaaggcccgtggcaggagagaagaggaaataaaatgctccgcagagcaggtattaccaaagctgtcctcatgcgaagaagggacacacctatgaaaagtaagcaaatctttccacatacctgagaaccaaataaaaactgtcagcttagacagcaaggggtcataccttgggagatgtgaaggtgcatttgagtttccgtggtactctttcatgggccatttcagtccactcagcaaacgcgtcatcacggtaagccagggaaacgtccatggagacttctgcattttctcctgcaagagaaaggatgcacgtttcagaaatgacttttggaaagatattttagaaacagctcaaaaaattcttataggctttgacttggaaaccaacgagacaaaagggaaatattaatttctatcaaactccaaacctgaagacttagaagtcataggatgaaagtctaagccaaatgctgggtcccctctcatgtccactctgccagagtcaagagcctccatttaaactcttccagagacaggggcctcactctctctgagggagcacaaatggtcagacctcatcctcccataacttgtaccatgggtcctaggtctgcctgtagaagccacgtggaaggtgatgtccttccttcttccataaaaagtgccttatgttcttgaaaaccataccacatctgcctgcattctctttcctctctgataaacatgaccaagtttttcaaccacctctcagacacgtccctctggggctcttctctggtcacactctgtctgaaaacatccttctcaaacttattcccgaaagttctcaaatataggatttgctacttttccaaaagtcaaaatcccttcatattgtggatgaagttaatgtaaaaggcaaagtgtttttccaaaattaaagacttatacacagataggaataatacataattgcacaaatgaatgttcacacatacttccatatgtgtggactggaccacgaatgagttaaactcaccacagaactcattaaggagatgagattaataaaacattgcacctattaattttgtctgttttatactatgatgagcaagttcaagagcagagaagtcttttttttttttttttttttttgagtataaaggtttaattctatttaaaaagaaagtccattaaatcaacttcaagttcttaactcatgggactattttggaacacttctttgtaaatatcattttgttaggttattggcaaaacagtttcaaggttcacttccctcccttgaaccaggtccaggtcattttgctttggggtaaattaaaatcagaattctaaaagttgagcaactttgtttttttttaattgacttagctctaacccaccattacaacttaaggacggcatgacttgataatgatggacttgtgtgaggttttgagttttcaattaaactttgtatcacatgaggtaattgtcagcattcttgagtctggttatggaataggcagatagaaccctgtagtaacaagagttggaaattggctaattgacaacgcacttgccttaaacatctcaagtagagaacttttacattagtgagatgtacttgaatttcagaactcaacaaattttaattactttttactgaaaactgcagtgaatgctaaatgtctacgtttacaataaacaaatacagtaacagtaactcacactgaaacaaaacatacttctgatagccattatttttctgcttgggacaattttaaagtttttcttttgtcacaaaaacaggaatgtatccaaacaaaggctcaaaagaggccatcttttcaaacaaaaaggcaatgattcacaaaagactgtgaatagaacatgtaactagttgatacaaatctaataggatttgttaaaatcagtcacatctaatacatctgaagtgctcttgtataaaatatcacgtgaagaaaagaagactttatcaatgtctaaaaaagtgggtttgttcatagacaatctgacaagttaccataaaaagtgtttcctgagacataaggaaatgcaacattattcttcttgaaccgttttagctcaactttccactcaataaaacagcagaggatctgaaactgagaaaatgtatttgagtacaaacagcttgtgaaagttaatactttttttttgcatcagagggtttttactgaacttacaaccaacttgcccactcagtatgcagttcagatgtgagagatgcttctctgtacaggagcctgtactgtcttcaatcctatgcgagcaagtgtctaccacaggcaaacagttttctccccattttgtagtaatgtaattttcctattagcaaaaggaggtcaccagcccctgtagacttaagggactcaagtcacaggatggggatatcctcttaatattttttattttgttgtttgaactcttgatgcaacattgtagagcagggtgttcaggacctgctgtgcccaagggactgataaaggaaaaagctctatttattctttgtgatttgatgcacagatgaaaaacttaacacacaataacagaagttggtcgttaataaatcacatcctagtctttcagcgcttccgtaagcagacgacatcttcagttttctagctcttgtagttttaacactgcagcatcaatgatgcataagtccagaatcagttacaaagaccatcatattctttttctcttagttcatcatttttcactatctcttggtcccaaatgtatctgaatgattaccttccggcattctctgctattgctcgttggagtgctctcgattgtccccgtgttttgtgggctggttgggagagggcgcctgggaaggatgtgccactgttgggaggttgtgagtcactgggatgcctccagggatgatcccttccacggctgcaggaagtcctcctggagccacgcccacgatgcctggcggatatctgtatgtggcaccattgagctcaggatgaattgcttgctggtctattactgaccaaggcgctgatgtgacagagaattccttgttcacacagtttcttaagctttctgggatgtgacctgtgatggctcggcggatctcagtggcagctgcctccctcatctccagtgacgcctgcttgctgtaccaggcagtgtgaggagtgcagataagattcggtgcatctttcaacggaccctgagcaaagctaaagggctccgactcacgcacatagagggctgcccctcgtatcctgccctccttgagagcttgtgctaaggctttctcgtccaccaggccaccacggggtgcgttcacaaggaatgctccctgcctcatctgctttatggtaaagtcattgatgaggtggtggttatgttcgttgagattgcagtgcaaggagacgcagtcgctctgatacagcaaatcctacagagtgtagaccctctgcacgcccagggatcgctcgatcccatcctgcaagtaggggtcataaaatatgacgctgaatccaaaggccttggctcgaactgcaaccgcctaccccctgcgatcaaagccgatgaggcccagcatttccccacggatgctggccgatcccgaggccaactcgcggttctgctccatgctctgaacccgtgtgccttaccgcagtgcttggtacagccatgtgttcctctggtacagattgaggatgtggcagatggtagagtccggtgtctcttccacggctgcagacgggatattgcacacagcaattccgagctcgctggcagccttgatgtccacgttatcgtagccactgcctatctgcacgatcactctcggggccttaaacttttctaggtcctccctggtgaggatgatggtgtggtacatcatggtacccatggcttcgttagaaccttctcgtggatttcctgcgtggactgcgcgtcacagaaggccacagtggccaggtctttcaggatgggcatctccacagtgcagtcgcggccgtccagcagcgccaccagggggcaggagtgcagggggccgttcatgatctgggggcggataccttcacaaattctgtccaattgctgtctcttgactttgtgcttatccacaagggccatactttatggaactttgcaactctcagatcaaaaggcaaagcagtcctctaagaacttaggggaactcgcaggagtctccgtgcatgacgccactatgaacccactataaatctgtacacactataaatctgtacactataaatctatagttcacacgatgggctgtccgtctttttaagggaatacagcttcattggttcaaaaccatttaaggtgatgaaaccctcgtcccggacggtcagcgtccacggcaaaaggcgcccactctggaggccgcggtggcggtggctcccgcccctcccaccccaccctgcggcggtggcggtggcggtggctgcagctgtgcagcctcccctcagcgcagcatggctcccttttcggtccctcgctcctccgggccgctcccgagccaccttaaaatgacgctcgcacacagggacacacaacacaaaaacttaatctctccagctccccaccactccccctccctccctccgctaccccgctctccccaccctacccctccagagaagtcttaatgaggaaaaaaaaaaaaaaagcacaaatcacatttccaaaatgactggagatcctgccaccactagggttatgaaaatgggcacaattttaggctctggctattcagccttgaagaagtctcagtatccaggcacctgagtttgctccatacccacctcctccagggctgcgacaaggattaaaagtcaagttagtgaaagcactgcatgctgcctcatatgcagtaggtgcttaataaatgtttactaaacctgaacacatacaaatcacaagggaaacagataggaataactgccctctgaaaagcagggcttttctacggtggcttaaagctgacatggcagcatggcagatccctggttctcagaagaaatctcggaaaaggaagagatgatccatggaagaaggaatttgaggccattctgatatagaggaaaccctcgatgaacatcagtacccactattctattattcctatttttatcctcagttaaacatagtgaattagccactgtgttttcctcctgaaattccacaaaataaagacaaagacagtaaaaagaaaagcaaaagatattaaatcacaaggggaaaaaactaactgtagacacatgagcagacaagagatttcatttttttttttttaagacagagttttgctcttgttacccaggctggagtgcaatggcatgatctcggctcactgcaacctctgcctcccgggttcaagcaattctcctgcctcagcctcctgagtagctgggattacaggcgtgcaccaccatgcctggctaattttgtatttttagcagagtcagggtttatccatggtggtcaggctggtcttgaactcctgacctcaggtgatccgcctgcctcagcttcccaaagtgttgggatcacaggcgtgaaccactgtgcctggcctcaaaatttttttaaaacataaaaaatacatgaagtagggtttcctggcagccacagcctacactcctatagaggggatattctagaaaagtgagccaacatatctgcaggaacctgaagccactcagaatttgaaagtaccaggggttgcagaaggcagaacaaagcatggcactgacaatggggtgactgggtcaaagtctgcacacaaaactgctggacctcagttctcccacatcttcccatctgtgcaagatccaaggagagactctggacttgaggacaccaggggaatatgtagacccagggctggaggtggagaagagcaagagtctgtagaagaaactgtgccactcccagcttggcagaaacaatgttcagagttggtatctccccttggtcagggaccaagctggctacaacttctccccacttagtagcctcagtggtcaacagaaagaatcagtcagagctcccatggagtcaaatcttaggcaataaagtacatcctacttataacgctgggagtaggaattgggactttaaactgtgttgaaaagggtgcttggagaaacacaagagtataaatatgaaaagctgtaaaaaatgtcatcagctcacacacaggttacaaattactcacaggttgttctccttggagccatagggttcagagcaacactagccttagacacaggcaagaggggcctttgaagtttgggccccacacttttaaagggtcccacacttttaaagggtcccactctgtcaactgttcccttctttataggacaagaagactcccaagtgaaggggatatatatacccagagcctacagaccccctcacttctagaccacgctccgagatgtcagactccagaacattctgcctagacagctctgaactcttatcttacttccaaggtctgtgtggcctctttccaggtctggcttcccaagaagaactagacaaccacctgtatactcttggatgttcggtgggggtgggagtgaaaaggctgctatttgttggaagatatgaacagagcttgagctcggaggttagggtgtccatgtagaagcacgcaaggcccctctctttatgggatggagccagcggtggggagaaaaggggtgtaggggcccacacttcctgaccagtcacattttggcacagaattccaagtcgtccatgagtcctcaattcgaacctggccatcctgttcattatgcaagtaactcatcatcagaggatgcaacgtacttggcttaacagtttgctggcctgatttatcacttctaaatatttagacacatgataggcatgccttcattcatactgtttccccaagccagacaaatgtttgtagtgggcctggttcagagcaggtgcctcacagagacaaggctagataggattgcttccttgcctggtcccagcttcaaaagttattctaatctgttgaggatcctcaaaggaaaaactattttaaaatatgcggtttaaaatgaaaattgtgcacagtattttaatgtacaattactccatgttaagctcctgtggtttctgtgctttaaattacctcatttaatgttcccaacaattccatgaagtggacagaatattttattttaattaatgagtaaagtgatgccctcagatcttaaggaacttgtataaagtcattgaaattgccttaaaataaaatcacttttttggtattgcttaaagaaaactggctaacttgtgatagaagaagcccctcaaagcagtcacacaatatgaatatgctaagtctttaataatagcaacagctctccttcatcagaggctaacatgcaccagccttcttcaggcctcacatccatcctgggaggaagacgttatataaattgcccaagaacatatggctagtaaacagcagagctcaagtctggatcacgtaagggccccactgcactctactacctttgctggtgaaaacaaacaaacacagtagaattcaaaagaagctaacagctgaatcaagcatacttggtcaaagagccactcaacacaaactaaatacctttccagctttctacaggagagaaacaggcaatgttcctgggaggctgcaagtatggctcataagaatgtctggaattatctaatctaagctttctaaagccatctattgttggctgttaaaattatagcatgttctgccgtctcttcacgttaccatctccttacttcccgtgcaatctgaagcagaggtgttattcctgtttatgaggtgaagacgccataactcagaaagccctaccctagaaataccagactcaggaccctagagcttcatagccaatagtctcatagcatcctgccatcttttatgatgtacataaaaaaatagaaatcacagggagaatggcctgttcaagtgacctttactagactgtgatatcactcctcacccccagacagatagcacacatgaggtagcacaggtcaatcttagcagacctggttccttacctgttaggataagacttaacgcctagaatttcatgattattacactagttactgcatgaaaaatgctcaagacagagcagaaagcatgaagggtaaggtattgttgttgacattttattagggaagtgaaactcttatccttaattcaaaataattaccaggtttcaggaacatggagcttcccactatgaatccctaatccaaacctagatcacaaaacccagaaacgggaaagcactggacagaggaatacagtaaaactgcgaagctggttacctgaattgttttctcttctgcctccagtggacttggaaataaagttcagcattaatgatgatgttgcatttaataaaacactggtttcatgactcctgggatactgtgtgggcaatacttcccctccaccctccagagataatgaaggcgaggaatccaatttgaactccctgggagaatggcaggaaggctaagctacatttggcactatattagaactttccctataaaacaaggacactggttatatcagtttcatgggggtacagttgtaaggtatcagcatagggcatttatagatttgaaatccatggttttccatacctatactataccagcagctttggtatagaagcccataggtcctatgggctagccaagcttcacatttctcaaatagctttggagacatattttagttgggtggagaattcattcagaggaggaagggaagtgtggaaaggcactgtcgttcgttacacttactatttccatcctgttatgggggcagtttcccctatgctccagggttccataggagcagacctagactgcaaagtgtggttacagacagaaagatccatgcctttccatgttgggaagcatcaactaattgtatccttaggaagtctgtctctataccagttatactgccctgccctgcttgagaaaagcaaagccaatcagtttttctgcaggcaagtggaaagtcagagaggagggcaagtaccttctataagccagaaatggtgggaggggggtgctagaaatcgctaggaaagaggtctagtgtccccaagaaatctagggcagctgcttaatgtaagaatggtccctggggtgggaatgtggggagaaggaaaagcaatgaaaaggccactagagccttaattgaggaagacatcagaatgcttgtcacctaagctctacaccttctatatttgaaacaggtatttcccagccaggatagtacaaagtgtataaattgggcaccaaatggatgtgattttgaattctccttttatgacttcccacctgaacaaccttgaataagtctcagtttccacctttgcagtatggaaacagtgggaactactccctaagtctgttaaccaataccagttccttctccatctagtcccagggtggctgggttatattgttgacctattaactggaataaaaggggaaaaaggagaggacaagatatattagaggaaatcaggaatgattttatggttgtcaaaagcttttaggttcctagagacactttgactttcctgggcctttgccctgggaaaaaaattaaagaggtttcaatgctcgtgtgcattcccacattacataggggagctgccagtcaccagagtttgtttgggtaacctcagaaagaggccacagagacaaatctcctcccagcctctggcagacatataatctggagttatttatgccagcattccttccccaataaaaaactctctgacctggcttgaatttttcttgacgctttcaattaaggaaataacaaaaccaaccctgtcttatacatggttaggtctggcaaaaatggactcagctaattacaaatttggccctggcggttttcttaagatgccctacaggcctgggtgtgagtggttataaaaatgaatgagtacaattattttgcaaaccagcctaacagtttagttcacattgcttctcgtctttcctcatcaaatcaagcatttgaattgcagagaattatcttccacatgtaagaaaacatatttctaagcattgcaaaactggttccttgctgtattctgatgcattatcatctggttgaagtcacatatctgtctatggaacatgacaaggacaagggagaacggtgctcacattaggttctcttcaaagtgacatgcagttagaaaacatccacttacccctattgtagccaaggctactagtacttaaatgctataccactgaaaaagtaagtggagacatcaatttttttaaataaatgaatctgaagtaccaccgaatatagaaaaaaaccatatctattgttcaccaggttggagagtagctctttcctcatctaactcaacacgttcaccctgaaggatttcatctgctcctgggatgcaagtcaccctctccagtccagatttccctcttgatatttgaatttgcatgctcacttttcaccagtctctcctctttcatggtttagaaatgcaaaccaccaaatttggtcaactctactaggtgtctttcagatttagcctcctctcctcactgatatgccgcttgttcaggccaccattatctccagcctccatgactaaaacacctgccctgttcctgtctaattttcacacttcctgctacagaaatgatttctaaaacactttcaatgcctttatattgtcttcagtgtgatattaagactccttaaatggcataattggctaaggtgttatgtagcagcctaggttctagttctatgaacgttcactaccccttctacctaggttggccacttcaaatacagcccctctcctctccagccttggaagatgagtaagagctcagctttggagacagacaggctgggaccacagcccaccttagctacttggtgcctatgcaatgttgggagtcactaaatgtctctatctgtaagatgaggataatggtaatggtaatgcccttctcctatcactgtgaggagtaaatgagataatgggtgccaagcactcagcacaggcctggcatatagtaagcactcagtcaatgctggctactatttcttttttttttttttttttttttgagatggagtttcgctcttcttgcccaggctggagtgcaatggcacgatctccgctcactgcaaccttcgcctcctgggttcaagcgattctcctgcctcagcctcctgagtaactgggattacatgcatgggccaccatgcctggctaatttttttgtatttttagtagagacggggtttctccatgttggtcaggctggtcttgaactcccaacctcaggtgatccacccgcctcggactcccaaagtgttgggattacaggtgtgagccaccgcgctcggccgctggctgctatttcaaggctagtactcaaggttatctacacctgctgtactcagggtccccataatcacaccaaattttatgaagagatgcctcctttgagagggtaaattacaaaaggcttctttatctgggctgcagacagtgcttggcatccccgctcgtgccagactcctactcatcttctggaattccccccagatttactcttgccttcttttactcacccaaactcaatatggcaccccccccttgctcccacagtaccttgttcacccagcaatatgacacttatgacacttattctccatgttgcttctcctgactacttatccccatctctctccctacccatctcctatttaggctgggttcctaaaagccagggactgactcagtcttgttcacagttatatcactcatgtctttgcacaatagatattcattgaatatttaccaaattaatgattatcatccttctttctccaaataactcttacaaacctaaatttcctgtcactctaccatcaaacaagtggtttgctctatattttggtgacattcatactttctttctccatcacctgcctttttacttctactccccccaaacccctgcacacacacccctgaaatccctgtgctagatggaccatccaactctatttttgtttccaccaaatatttttgagcacctactggtgtcctcgcacaagattggatgtaaagcctaaaaccataaaaaccctagaagacaacctaggcaataccattcaggacataggcatgggcaaagacttcatgactaaaacaccaaaagcaatggcaacaaaagccaaaattgacaaatgggatctaattaaactaaacagcttctgcacagcaaaagaaactatcatcagagtaaataggcaactacagaatgggagaaaatttttgcagtctatccatctggcaaagggctaatatccagaatctacaaggaatttaaatttacaagaaaaaaaaacaaaaaaccccatcaaaaagtgggtgaaggatatgaacagccacttcgcaaaagaagattctaatgcagccaacaaacgtgaaaaaaagctcatcatcactggtcatcagagaaatgcaaatcaaaaccacaatgagataccatctcatgccagttagaatggcgatcattgaaaagtcaggagacaacagatgctggagaggatgtggagaaataggaacacttttacactgttggtaagagtgtaaattagttcaaccattgtggaagacagtgtggcgattcctcaaggatctagaaccagaaataccatttgaactagtaatcccattactgggtatatacccaaaggattataaatcattctactataaagacacatgcacacgtatgtttattgtggcactattcacaatagcaaagacttggaaccaactcaaatgcccagcaatgatagactggataaagaaaatgtgccacatatacaccatggaatactatgcagccataacaaaggatgagttcatgtcctttgtagggacatggatgaagctggaaaccatcattctcagcaaactaacacaggaacagaaaaccaaacaccacatgttctcactcataagtgggagttgaacaatgagaacacatggacacagggaggggaacatcacacctgggcctgttgaggggtggggggatgggggagggatagtattaggagaaatacctaatgtagatgacgggttgatgggtacagcaaaccaccatggcacatgtatacctatgtaacaaacctgcacattctgcacatgtatcccagaacttaaagtataattaaaaaaaaaaaatactcagagaagttccaaatgctgtatataaataaatacaaatcttatatagaaataggatttggaactatatacatgtatataaacataaaaatgtatgtttatatatgtctataaagagtgaaacaattaaacttcttctataaaaaaaagagtagggataaaaaggcatataaggcaaagtcattgccctcaaattgtttacagtaaagtggtgaaggcaggtatataaataagtataattccatgtagtttgtactgcattagaagtatatatgaagtatacagtcagcacaaaaagatcaagagttctgagtagaaggtcaagaattgtagcacagaagacacaatcttctggctcaccctactgagaagaggtgatatttaccaatgaattgcagaataggagttcactaggcagcgagataggaaaaggcattacaggcagaggaagccccatgtataaaaagtcacataagcacaaaatagcagggaaagcaactaattcaatatggcagggaatgtgagagggactggagggaacagggaaggctagagaacaggaagggtctaatgacaaagggaagaagcttgccctgagtgctgcagcattttgcttagaggatgttaaagcaaaggaggagattctggcagctgtgcggaagacggactgggatggggggccaggtagacaaagagacatcctaaggaaactgaggcccactgctaacacagttctcagtgtgcttaagacgatttaaccttgtggaaaatactgccaggaggatattttctaaggaatttgtttaccaaagaatctgaacccaatgatgaaccaatctttcgctaacaaagctagagaactcagaaccatctaagttagcaagtgttaaaacactggaaagcaaatgtggcaacagcactttcctatttgaccataatcaacatcaatgtggaaagaaaacaaacctgaaagcaagtgaggaaaacacacagtgggtttctttgctttctctccaggacactgtcagtacacagagcatttagaatagctgatttgatcgttgtgaaaatctacctgcgtgcccctctctctctctctctctctctgaatgcaattagagaagacagcttcattcacactgtgtctaaaaatagatgatggcagagttcacagactgacagctgcattgtcatacagtaaccaggaaaggaaagggatggctaatttaacttaacaacttccaaaacaaacagtgcagagggagtccaggataaagaaaaaacacacaggtcagttcttcaaagagctggcagagggatggggtcgctccatggcagtttattagtcctcccaaaatcctgacgaaaccagctaagtattttgcccagatctacccagagtccttcagacaagagctctggcagatgaaccgctacagagattcaggcaatattaggcagcagggccaggactttccctgctgacttcttcatacatcccctggacacaagtaagctaagaagagtcatgacgtttttctaggcaagataaataaatgagttttttccccctttgccatatctaaattatactctgcctagcctggggcatttaaaaaaaagttatccaggaaataaacatgcatcattaaggggcagaaaccaggtgtctaaaagaagcaaaccatttctttccctcccttcagtcctaaaatgttttctgttttcctcctcagtctgccttgcccagggaagggattacggttgggcttcaaaagaaacaagggaataatgcctgtggacgggtagcagattctctctgcagctctcccgcagctccatgttggctctcagcgctgctgccagccagctaaatgtcagatcacggcaccccaacattccctcactgcatacctccatcgccctggtgactaagctgtttcaacagctgtgttattgctggagtcaggccagtgttattcacacgaagtatttgtttcatacggcttatgtggggaattattgcactcagctttggggttctatttaaagataaggtccttcccttgatcaatcagccaggacattcctcgagttgggctccaggagacagtgggacaatattctactgccacccggggttccagataatggacagattcataatactataaagaaggtggatgaagcatatgtgtgtgtgagagaatgggaagcataatggaaaaccatgacccttggtggagctgcggaagaactctgctgctcctccctcaataaaagccacccacaacacaagagtgttaagctggactccctttctgctcttcttctccagccatcaccctcagcctttcccttaaaatcattgctctttcctttcgggtcacgctagcactgttgcgttggtctctacatgcatcactccacacacctgccccgaatgccatctcctccctcagcccttggcttctcctatctcatcaaatggtttatgaccattgatgttcctatcatgtaggaagcaagttgggcctgttggcctggtgacctcctccactactccacatcctcttctgagtgtgagtaagataagggctgtgttactaactgctgagttaatcaacccaaactcccttatatggagggacaactgggaaaaggaaaaggcattacatccatgagctttatgtcctgtaggtgggactaatttctatttctagctcattctaggctgaatctccatcaaagaggcctactggcctgttctccctccaaagttgttctcaccaagagcaatcgggcaccattttctgatgctgaaaagatctcagaaatatgttttcttataaatgaagtatttttaaaagaaataaaacaatgattcctaagagctcacattttttactgcctactatgtgtagacattttcacccatgcagatgccagccagatggaaaccatcacaggcaatttcaaagtgaggaaactgaggcccatggccatgctaccaatgtgagagggaggcaaaatgagaacccaggtttgcctgactcagcagctcaagtactttccccttatgtctctcagtcatggggtaggaaagttaggacacccgcttcttgctctaaaaaggccactatttagccaaacaatttgagtaagtcactttacataatgtattatttcatgaaatactacagttggatcataggcttactaagatcctttctagttctaatatttcatgaatgtagaaatctaaaacacctccagctgttgactgccttctatacttaaggcactgaggccaaaacaaagagctataaaaccatgcctgtcctcagggcacttataatggagtttgagtgacaaaggataacaagttgagtttgactaatggaagagttaaacaattaacaaatacaaaaataccagagaaccagactacagggcagtgcttgagaaataacaccgcataccagcatgactatacaaggagaaaagtagatttcaacaatggtaacacccctaacccggaaaatacatttgtgctgccagcagaaagaaaagaagagacagaaaacgcttgcaggaaaagccagctactagaagggatcccgtctgtttcacaggaaagctttgtttctgacaagtttcgtaaaggaaaaagtaggctagaacaagcttttttatttccaacccaccttttcttcgttcccatgaatgaggaggggatacaaatgagagcaggcagccagggacaaaaataatatggctggtggttcctgacctcttggattcctgccaacagagaagcctgagaggcaacatttaattgtggaaaaaccagcctggctctcctcttatctttttcctctgtgacttaaacccacaattactggcaacccctagattccgagtcacccagctggtggtggcagcaatggctgtgtctgtagctgaaaagcaaaagggagtcagattttacctgcctccgaagccagccctgggagcacagccctaacccagcttgatgacttctcccattaaaaggttcacagatgccctcccgttgggaaaaccaccaagtgagaagtccagatgggaaaaaaagaaacacgattttcagctgctgtataattcaaaggacaagctacgagtctcaaatcctgaattccacattttatttcagcactagagatgtgatgttcaattccttttcttaagaaacaaactccaaatttcttagctggtcatcaaggcaactcacctaccaggccctctgtctttcagcagctcatcttttttctctaatatggacacttttctacagcccaacaaatgggcttaccgtcctttgcacatatgttatttcagagcatttcatgatagaaaaatatggtcttagtcctcactttctcacctagaaatcactttgaagaagtcacttaacttccataatttcatacttgtttaaatttaaaactttttctccagtaacagcctcacagaggacagtagagatttaaccttgaacatctagcattgagcctgcagaggagatgcataatcaacgtttccttctctatacctaatgcctttgctgagttaccttcatccaaaagaatgttcccattgctaactcttgtcctgatcttttcttaccactcttccactccaagaggttgtctcccatacacctctgctcccatcttaatattcttccatttcaaaatattttaatttacatgctgctatgtttatagtcaaatataattaaatcatgcctgtgggcacattctcctaaggatgctaagaattttccacatcttctattttaggactttatccaattgcttcagtgctgatcagcatgcattttggtactcatggggcataccctcatcgggattcataaacctctgaattccatgggtgagcttcagggcttccattgaaatatgaatactaaatgtgcaaatggggtctatgcatatttgtctcccaaggttaaagtccttgacctgaagttaataaccactgtccggaagtaatgaaaggcctgtggctaacatccatggacggggtcctttttctgaacactcagccctgccacctatgtttctgggcttctatgctctctctggaacacaattcctcctttctattcaagtccgagaataataactactcactcttatttatttatttagagacagaatctcaaccaggcaggagggcagtggcgcaaccttctgggcccaagcagtcctcctacctcagcctcccaagcagctgggactacaggggcacaccaccacatcctgataatttttgtattttttgtagagacagggtttcaccatgttgctcaggctggtctcgaactcctgggatcaagagatctgccctcctgggcctcccaaagtgctgggattacaggtgtgagccactgcgcccagccaactattcacttatattgagcatttactatatgtatccagcacttactatgtaaaagcctcacatacactattctagtttaatccttacaacaaccctataaaggtagtactactattctattttataagtgaggaaaatgaagtacaaggaagtttcaaaaacttccttgccaagggtctcataatttataagcagcaggccaaacattcataatttatgattcagcccaaacactctggcttgaaagtacttaacccagtgctggagttgtctctccaagctctttcactttccagaaaaaaataagactgcccttggactgtttctttgccttcacattgtaagtgatcacagattccaacgcctttaaaactccacctttgactcaatcaaaacatttccttttccgtgagttaatcatttccccttctatgtttatggactcctttgggtacttaatgcactgaacacactggtgtaattttttaattctctctccatgaattagactgtgagctcctaattattttgagtacacatggaatatttactgtgcctggaattgtgctaaggatataacaatgaacaacacagtgtccctgcctttaaataattcactcttaggccaggagtggtggcttacgcctgtaatcccagcactttgggactttgggaagccgaggtgggcagatcacaaggtcaggagtttgagaccagcctgactaacattgtgaaaccccgtctatactaaaaatacaaaattagctgggcatggtggcacacgcctgtaatcccagctactcaggaggctgagacgggagaatcacttgaacccaggagggggaggttgcggtgagccaagatcacgccactgcactccagcctaagcaacagatcgagactacatttcaaaaaaaaaaaaaagaaaagaaaagagaaaactaaacaaaagagggttatgatggtttctgaaattgtattatgaagaataaggacttatctttatttcttaaatcctgagcaaaatgctagcatgtagtacaagtcccaataatgcctatcgaatgaatgaatgaaattgggaaagggttttcagatactgaactgctaaactgaaagatctaccatcccatcatgaaactctttgaggttatttatacactgactcacctaaaaactgcttcctgtgttggtgtctatgatacattttttaatgtcagactaaaaatacacttccagtacaccaaccctgtctgcctacctaaggagtagaaatgaacacaaggtcgcatgtaacaaaagaaaagaaaattcactcatttcaacactaagctcaccctctaacaagagcatctgtcttgactgagcactatcttctagaatggttttcacttgagggtctctgaagtcatctatttacaaaaccaaaggataccaatgagattttttataaagtcagagaatcttaagtgagtcatggactctcaacttcagagagttagagtagatgggaccttaggggtcgtctagtataatttcccactcagaacaggaagcactccatagccctgtcaatagactcatggtgggatcaaggcactggagtcctaacatcatgtacactcatagcctctcgacttcccagctgggagactggcaaatcatgtaaactctgtcatcctcagtgtcctcactctgccagatataattgttccgatgatcagatgaaataaacgttgtcttaattagcgaacatttgtttgcaagtaacaggacttcacccccactaacttaaccagaaatcagctggagggatacaggagtgctttaggaaaatcaagggcagaaaatgctgagaagctggagggtctgaaaccaggaatagaaagctgtcaggaggaaagtcaactcttatagtctattgtaattacactaatagtcttcatctccatttcctctttgcatctggtcttcccactctgccagtcaacaatcacggcttctctgtgcacgtgtagaatgatgactgcccaggtggctctcatggcttttcagtttaagtgctaataaaggtagatctcgaattactgaaacacaatttcttataagagagaatttgattgcttcccctttggccaagggaccactgctagtctgatcagttatggcttggggactgatcatatggccagttgcccattcagtagaggtggtggaacatgctgagggagggggaagttaaggccaagttcaggccaagcaaatgactgacaacaaagacaagcaacagcatctctagtgcgatggtactttgcaaagaaagcactgccccatgccagctatcactgtggccatccttatgatcctcaccaaccatcttctgcttgaccactaccagtaacaggctgctcactactggtagaggcaaccttttcatcagcaaacaacttcagctattagaactcttttccatgtgacagcaacttaagatactaaactgaaatatttgtaatcttctcccaagccttaactttaatgaaggcataatcttgcttgttaggtcaagcctgggcttttctttctagtcaaaatatgaataatgggcaaagcaagatgttgaggaaaagctgagtgttgggagggaaactgaggcagggcttgcataatgtctttgggaatgtgtctagacttgctggttccttacttctagccctcataggctcctaggctcctattcccattatctcaagtagcagaacatgttccatataaatgctaaaccatcacagctgtagatcatgtgcctgctcttttgacctccacattttcaccacctgtttctttgttggattaccaataaatagcatgggctcccagagctcagggccttcacagcctctgtacactagtgatggccccctggtgtcccaactttctctctcaaactgtctttttctcaatcctttgactctgctggactttgtcacccccacaacctggtgttgggtctgatcaccccaacacaagagagatagattcactatgcaattattttagcaaacaacctggaccagaacaaagccagaacctcttcttcctataaagaattactactatctctctactaacaccattactaatgactcactaaagcaaaagaggatctggaactgtttctagcatcagtgtgtagacaataggtagggttggggaaaatggttttttccaatgtagagtccctagcacttttgcaagcagaattctgccttgctctcatttaacttccttttgcttagaaaaatataatccagaaaataatcttaacttcatttttttaagttaaccaagataaagttgtgaattccccataaaagaacctcataatagctatgttatgaccagctggcatttaaatactgaaagacccaaagttagaagaggaggtgaaaacaaaaaaataccttctatacattgggggcaccattaagggatgtgctgcttctggcttctctgctcttcacattagtcaatgatgtcaccaggtttttattttagtaatcaggatatacttgtatggatgcaaagagaatatcctcatttatattctaaactcagagcaggaaatgagacacgtgggtgatctgcagctgtggcactataaacagggccagcctaccacctagtctagattctagactgcacttcattccctgaaatactgattgggagattttaaaaaattgaaaatatatcattttagaaagaccagtgcatcttctgtgcaaggatcttagagtccgctgtttggtagaaggctgactcacctgtatggggtggtgcacgtgttgttaggtaccatctacctatctacaccactgatgtacaacgaggagatcctgccctggctccagccagctgtgccaccgtgggcgagtaccacagagttcaagctttctccagctgctaaattaaaggattagtgctttaacttgggtcaaccacccatttgcaaacctgacaagaaccacaaacactcttacttcaaaaatgcatataagcaaataccactgaaattttatgtagagtatcaaggggttctcttagcccttacactccagtctaaactgcttggttgatgattgttagaccagcagccctctagtattcctttcagcactccaagctaaaataaaacagctgatgtttagtaacaatttctgcaaattattcaacaccatagaagagtgttttgttaagactagagactaatctaacacaatctactcaacaatgttaaattgaccagtaaccaatagatgactagaagaaagtgtatgtaactagatataccaaactatagatactaattttaaaatcttggaaaggttttggaggagccctactgtttctgaattggaatttttcatttgcaaatacttaacaaaacccaccaagccagatagagctctatagcgatgcctatggaggagccttataatgatgttgtccaagtaatgtgcttaacaataatcacactcaaagccaaaggttcccatgctcctgccaatataacatgctcacaacggtcaattccaaaggaagagctgtcaagaagtgcctgaagatttcctcaaagggagagataattcatgagcaaacaaacatcatgtccctaatcttctctatcctggggtaaacaaaatatagttttctcccatgatttcagttgctttctataccaagtcagtaagtaaaactgattcatactggtaacttccaggttccagccttggtttgaaggggcacacaattcaataagagtaaagaagactggccatgtaagcccatcttgaatactgacaacttccgtaccatttacctaacactacaaaccctactccatttaagtctctgagatctttttgatgtattttgagcttttcaacttgccttttttggtgggagaggagggaggaggagaacaaagggagaatttgaagtttttatttctgcttgcattgactcaaattgtggtaaagaaacttaaaaggtaactttaaaattctagtgacactagccaacaatgaaaactatctaattagaatgttagaggttttttttgtttgagacagagttgctctgttgcccaggctggagtgcagtggtgcgatctcggcttgctgcaacctccacctcccaggttcaagtgattctcctgcctcagcctcccaagtagctgggattacaggcacacgccaccatgctgggctaatttttgtatagacagggtttcaccatattggtcaggctggtcttgaactcctgacctcaggtgatccacccacctcagcctcccaatgtgctgggattacaggtgtgaaccactgtgcccagccaaaatgttagatagttttaacacaggctataacatagtcataaattaaagaagacatggtcgtaaatgaaagaagacctctttttggtgggagtagtagtaggggtgggagagtagagttatacatttcttcttagcagttgcttcaacatattttattaataaggactatctgctgaagcacagaaatacaattatgtgaatatcatactaccaatggcctgttccatcatagcagggatagttcttatagtgtataaaatcctctgccccattcagctctctttatggagctttcctcagaagcatcagaaaacacagaattaaatatcacaattcttgttgaaggccaaaaattagttcccagaaggattctttgactttcatccttctacaaattcacccatcaccattgtagataatgtgaggggtgaatttgtagaaggatgaaattcagagaattgtttatgatcaatagattgttccctttattccagttgtcttcccttgatgtccacttaacattccataataaatggacaaatggaaaagcacaattactctgccaaaagtcagtcaacattctcccaggacactcagccatctaacttgaaaactgactggtaataatatcattctaattactttaactagaaatttgttatacagaaatgctttcagtgtggggaaagaaaaatcacttgccacttatagaaagaattctgcttcatgtgaccatttgcaataatgaaacaagtaagacaacactgggttccagtgtacagcacaaggatcaaggcgaaacataatgctttcattacgtaagaataggactgacattattctggctttcccctacccttcatcatttaccaatattttttcagtctcaggaatttttcaacccctgaaactcctagatttactactcaagacacagctatccatcttgaggctttctgccaatggctctagtgcttctatttcaacagcttatagatttgaaagctggaaagagagatatgtaaacaaattctctaactttgatctatgcacccaggtttctcaaaagaagcccttggagagtctggggtatactaagtgtatgacttgcagttgtaatcattagagtgacaacccatttccagtgggtaccgttttagccaacccaaacctttcttttcctaatgcatagagtgactttttaaaaaatggtatatttgggaaagtattttagaatggcatgttaacaaaacaaaaacactctagaatatattttcaaataacagaacttggccttaccaagaggtctaataccatcaggtaaataatcatttttatcagtgattcataatacatccagactctaaatgttaaggctgacttttttctgacactcttctctgcctattcatactccatttcctaactcctttagagtaaaaattgaaatcccatatccctaacaactagacagaagcatcatgtttacatcctgacaaattcattaattctgtacctctgaaatatttagcaaaaagccagcactgactcaatcatagatttccacagacaggtctgttcatatttgtaattggtattcactgaaaggtcaatgactcctgttcccaagtatctatgagtctctagattttcttaattggcctcttttcctcagctcttacagactattgttttaaaactaccaccatttagaagttgaactccgagtgaggggaaaaacaaacaaacaagcaaacaaaaaaaacactttttgattcccactccactcataatcaacataacacagactacttctgacccaggtgtgatggaaggagcggggcacagagtcgggggaggtttctccacacaccaagcaagcaatcaatcacttccacagcagacatcagctgggtgtccaaaaattcaattttgacaccacttacctggaaatagcatcaagtctcataggttgaaagctcagtcccataagactgctccccacttcagatgcccatcgaaaaaacaggttgtggcctgttataaatacgcgttcccatgaccctcctccttaggattgattgatttgctacagaggctcacagaactcagggaaacacttaacttatgcacgttataaaggatatgacaaaggatacacatgaacaaccagataaaagattgatagggtaaggcatgtggtatggcagggatccctgaccctctggcagcagacaggtaccagtcagtggcctgttaggaactgagccatatagtagggggtaagaggtgggtgagcaagtattatagcctgagttctgcctcctgtcagatcagctggcattatattctcataggagtgggaaccctattgtgaagtattcatgcaagggatctaggctgcatgctccttatgagaatctaatgcctgatgatctgaagcggaaccatttcatacccaaaccatcccccatcccctcatctgtggaaaaagtgtcttccatgaaaccggtccctggtgcccaaaaagttgaggatggctatgataaggcacagagcatccctgtcctctctagggtgccatgctccgggaacctctgcaagttcagctgtctggaagctcccagaacccagtccttttgagtttttatggaggcttcattacctaggcatgactgattacattattggccataagcgagtgactcaatctttaggcctcttccctcctggctgttggtgggtggggctgaaattagttccccacccttctaatcatgccttggtctttcaggtgaccattctgaagctatctgggagtccccagccatcagttgactcattagcatgcaaagaggcattcctatcactcaggagattccaagaattttagaagctgtgtatcaggaaatttattactataaagtaccttataatgccatcatttttctcccaaaggcactggcttgattaaattcagaaattaaaacaatggccagcttctatagtgtaagtcaatgcttttctagttttctgagggtttggaaactcaaatcctagctaaaacctgtatcacttttaaattgaaaaatttaaagggaataaacatttaaccccaagtgactagaagtcatttaaaatatgtagtacttagattattttatctactcaaagactcttcaaaagtagatgaaaacactaaccagatatatattataaacccaagctttaatttcagagcccaaacatgaaatctcttctcattgtttgaaatctgaaactcatttcaaagactgccacgaaaagttaaaaaaaaaaaaatggattggtcttgacttttccttacatatgaagtaatattgttacaggtgaatctctgataagcaggaagccatcatgtgtaataggatcttgtttgccacactcccaaactcttctctgaagtcctgttcattgctgtcagaaaggaatccaaagtaatgataaacaatataaaaagtagagagtctcatgcattcttaataccaaaatcagagagaaatctagacctgatgtgcctgttatactaaaacatgtgtgtatatgtatattgctgaatatatataacataatatatataatctgtataatcaatgccttgctcagtgtccataagcaaaggtagagaggataaatttaaggaaatgaatattcccacaaacacaacatgtaacttctcatataatagttagcagctggccaggcatggtagctcacgcctgtaatccccgcattttgggaggccgaggcgggcggatcacaaggtcaggagatcgagaccatcctggctaacacggtgaaacctcatctctactaaaaatacaaaaaaattagccgggcgtggtggcaggcgcctgtagtcccagctgctaggggaggctgaggcaggagaatggcatgaacccgggatcgtgccactgcactccagcctgggggacagagcaagactccatctccaaaaaaaaaaaaaaaaaaaaaattagcagccaaaatgtgttgctgctactcatgaaaagtattttttggtgtggttttcttgatagctctattaagaaagttattttatacatttatcaaatgaataattagtggtccatcttgttaactttttagtatgccccctattaagtgctagttctcatgttataagaaaattaaggattatttttaagtcagaaagcttgagtacagtatttttgtagatgaagataaaatattttaaagcatgaagatgtacatgagaaaaaaataagacattaatatttatatatagaaatgttttaaagctttgccaacatgggcatttttgttgtttaggattagtatttgctgggaagtaattcatctgtgaaattatttaacatgtagaattatttcttagtttctggtttgggagaaatgctcaagagttgagcttaaaatcattttattcacactgctaaagctgaaaaatgtaaacagggagctttcaatacatttcaaatgagtttggagaattctaaaatattcaatccatttataatgaatacaaaacatcattagaaactggcaaaaaaaaaagtagctaaaagtattcgagttatttcacattactgggaaagtttcttttaaaaagttcagttataaataacattcactaaacatatttatccttttttcaattttggtggtataattttagaaatttatcgttgacttttaaaatttcacctaaacttacctgaggctctgcattatgttactcaatgattctgatgccaagttttgaaatcaaattataggccagtcaccttcagtgatgtaaaaggtagaaccacaagataatccagcactttcctcacaacctgaaaacggaacctgtggcaagtacctgcccaagtgtcagactatgctctaaacaactgcctgtcatgtaacaggctgctcgaaagcagcaacatactactcctatagtcaattcttaacttcttaaccacaatttcatcagtgtaaaaaatataggagcagtggggaccagacttacatatactgaaatgttaaacaacagaactcttattttgaagtgtgggaggggaggaagcacctcaatcagttgctttatgttccttttagtggcagaagaatgatacaatccagtattttcatccacagctccctaaacacaaagctgtggatttcataaatgtaaatatactgcgtaatctgcccactgggagttcatagtttagtaaggactcagagaagacaatttcactgtgcagaacacaaggctgataaagtaaacatcacaaggccagtaatgaagaatgcgtaaggaaagacagattatatccaggaaggaatgaggacgggagataatatagaaaatacctaggaaggctccaggggaatgtaaaatttgggatgttgtgaagaatgagtaggtttatctgggaggagcccttcatttgtgagaagaggaatcacaagagaggaagaggcaggcaggatcaatatcagcgaagacgcaaagggagaaactctctggatgtgtttacagggcaggaaactactccttttgaggatgcagagaatggttactggccagcagtgaggaaggaggctagaaagaagccttgagccaggaagcgagaggactctgaacaccgagtcttatttgttagtcactgaagatgttttgagcaaggaaatgataaattaaagctaaaagagtctcctccttatcagaggtttcaccttcagtggtttcagttagcagaggtcaatcacagtgtaaaaatattagatgaaaaattccagaaataattcttaagttataaattgtgcactgttctgagtagcatcatgaaatcttgtgctgtcccctgataagaatcacccctctgtccagcatctccctgctcctgcctgttagtcacttagcagccatctaggttactagatcaactgctatgtattacagtacttgtgtgcaagtcatccttattttctctcattgccccaaggtgcaagagtagggatgctggcatttcagatgtgctaaagagataagtcaagtgcttcctttaagaagatgaaagttctcaacttaaaagaaaaaaaaatcttatgctgaggttgctaagatctacaataagaatgaatcttctgtccttaaaattgtgaacagtatattttttctttcattattaattattgttgttatcttttactgcacctaatttataatttaaactttattctaagtatgtatatatgtataggaagacacatcatgtatgtatatagggttcagtaccgtgattttaggcactgggtggtcttagaacatatcccctgtggataaggaagacttacctctaccacgtgcttcttttataaagactaatctcactaaccaaggtgtagaagtaagaattggaaaaatggctgaatttcagcaataaggataaatataattggataattgtaatagctacttttaatttttaactgttttaatagtacttactatgtccaggctgggtgcagtggctcacacctgtaatcccagcactttgggaggccgaggtgggtggatcacctaaggtcaggagttcgagaccagtctggccaacatggcgaaaccccgtctctactaaaaatacaaaaatttagtcccagctactcaggaggctgaggcaggagaatctcttgaacccaggaggcagagattgccgtgaaccaagatcatgccaccgtactccagcctgggtgacagagcgagactccgtctcaaaaaaaataaataaaaaataagtacttactatgtcctaaaagttttacataaactaatttattccttagagtgagttggttaattaggcattattatccatattttacaagggaggaaactggctaagagcggttctgtaacttccccaatactgcagagcttttaaaaagtggcacaaggatttaaacccattgctgtaggactcctaagtccatgctcttaaaaaactttctatcttaccccctaatctagatataaatcagggatcacatttcaaatgaaactgtgactccattgaaaagtatgccagcaggtagtcagcctctaagatggtccttaatgatccccatctcctggcattcatgctcttctgtaatcacctcccttgagtgtgggttgaacttactagttcacttctaaccaacagaatacagcagaagtgatggaatgtcgtttgcaagattcagcggtttccctctccagcactgctcaggctctctcttggctcactatccctgggggaagcccgctgccatgttgcgaggcagtcttatggagagacccatgtgggagggatggaagcctgccaacaaccatgtgagagagcttggaagcagatcccccttccccggtggagccctcatgcctgatgagactgcagaccaggccaacagcttaattgcaaccttgagagagtttgagccagagactcccaaactagattcttgacccacagaaatgaggagctaagaaatgtttataggtggccaggcacggtggctcacgcctgtaatcccagcactttgggaggccgaagtgagtggatcacctgaggtcgggagttctagaccatcctggccaacatggagaaaccccgtctctactaaaaatacaaaaattagccaggcgtggtggcacatgcctataatcccagctactcgggaggctgaggcaggagaatctcttgatcacgggaggtggaggttgtggtgagccaagatcgtaccattgcactccagcctgggcaacaagggtgaaactcagactcaaaaaaaaaaaaaaaaaatgtttatagttgaaagctcctaacttttagggtaatttgttacccagcattattaatacagtcagtagacagtaattatttattattacagggtaaatctttttctttatacttggagctagaagtagggatctgtctaggagagattatacctgaaataaccacaaccagcccaaataacagaataccacgtcctttacctttccacccaaacatacataaatcaggtaatctacctatctcatcctcccatggctcttcttgttgtccttattctcctttgcttgaatgcattcttaggaatagaaatgctaaaacccaaacctgcaggtttcaaaaaaaaatttttagacatacagttttgaatctcatagcaaactctttccttcccaaggctcctcacattacattgtgtattcttattatagcacataacatgttttttcttatttgtaggtttaagtgtctgttttccaggcaccctcttccctaacccgttacaagaatcatgtctcgtgtgatcttatatccccagtactgagtgttcgtatggctgggacttaataaagtttaaatgaactcatgaataaatgtgttgcacaaccaatgagtgagtgagtgaacaagtgagtcaataagcaagagtttagggacatgggaaccaccacttaaaagcttgaggctgttgtgcaaatttggaccttcatataagccatttccttctatatagaatgctctttcttttgctcatcctcacctcctcaccaggcttttctctctttaacattcacctcaaagagctgtctgattgcctctctacaactctccccgccaacacacacccacacaccctaccagggaagtcttccttttctctgctgtgaagccttttctttaagtttccatatcctcctgggcataacttggtcacagcacccagcataccacactgtaatgattagttatttgcctgtcatttccacttagccgtaagttccttaaaggacagcatattcagctaacagcagaatgcctagcagtggtaggcactcaaaaacagtttaaaataatgggcaagagaatgaatgaatgagaaaaagaaaactgtatctagaaaattatctcagcacaatctatttatttcaggtaagctatcagtcaggtatacatagtgctccaactcctaaacagagtaaaaataattgtacatcaagattattacagatacatgaaaatcatatttagaaatagtacttcagatcaggcatggtggctcacagctgtaaaccaaaaatttggggaggctaaagtgggaagattgcttgagctcaggagagacccccataaaattttaaaatttaaggccaggtgcagtggctcatgccagctactcaagaggctgaggtgggaagatcgcttgagcctgggaggttgaggctgcagtgagctgtgatgacaccactgcactccagcccaggcaaaagagaaagaacctgtcacacacacaaaaaaaaaagaataaaaaattacaaaattagcgtgcctgtagtcctagctattcatgaggctgaggtgggaggatagcttgaacccaggagttcgaggatgcagtgagctatgattatgctactgaactccagcctgggccagcattcgagatcagcctggggaacataggagactctgtctcttaaaaaaaaaaaaaaaaaaacagaagaagaaagaaatagttttcaggccaggcacagtggctcacacctgtaatcccagcactttgggaggccaaggtgggtggatcacctgagatcaggagttcaagagcagcctggccaacatggtaaaaccccatctccactaaaaatacaaaaaaaaaaaaaaaaaattttgctgggcgtggtggtgggtgcctgtaatcccagctacgtgggaggctgaggcaggagaatcacttgaacgcgggaggcggagattgcagtaagccgagattgagccactgcactccagcctgggcaacaagagcgaaactctgtttcaaaaaaaaaagaaaagaaaagaaaagaaaaagaaataatgtttcaatctatggacaggccctagacagagctgcctttaacacatctttttccctttccctcacatccttgatcccatctcagtcaaaaaggaaaaaacaaaaagttttcttacttctcagcctaagattcctgatactgtccccagatgccatacatgtattggcctcccagaaatcacccagtgattttctccccatgaaaagtttatatgtctcatgccctcagagtttttaactgcaaataagctaaaaaaaaaaaaaaaaaaaaaaaaaaaaaaaaaaaaaaaaaaaacgaaaaaaaaacctggtttggtggggaaatgggtgctcatgggttggcatttccattttggtaggcatctttttctaaggccatagctttactcaaagcccagtggaaaaagacatttaaaaaaaaataaaaacctttcaggaaccctcaagtcactccattggggtgaactcccctgtgacactagagaggtggtgaagcttggtggttagggcagttttctgagtcagaaatctcagcttttccactctctagtcttcagatcatgagtaacctcactggtgcccaagtgttccatctgtaaaatgaaataataagactacctcaaggaacctggtgggaagattaaatgggttaatacaggtaaagtacacagaaagtgcctgggaagtagtcaataattgtttgctattactattaccatttttacttttattagaattggctcaaaaagaacccaaagagggcaatgctcaaagggaagaaagggatgagaggagagtacacttaactgatttggttgtttagcttgaaggcaatgtccagctgcaggataaacagcatgaattggaaccaaggactcatctccatgtgggggaggggaatgtgaacagaaaacacgatgtcattggcttcaatttcccttggaattgcctcttcaatgtctcggatcttgtcacaatgattgggtccccaaggcacgaaccattttgtcttgtgatggttcttacgggcatccacacatttcaccgacatgtaggacactgccgttgtgggccctggagctgaaaagagaaagtttgtctgttttagaaaagccatctattgaaactactgtttctggttaatattctttccactgctgtgttccctccagcttttgtatcgccttctacaagtggggctcagcaatacttagggatcttccaaatctgggtgaggatctttcactgacctccagaggtgtcataacagtatctctgagaaccttcccattatgttttcaattgctgtgaaagaatacatttgtaaccagtctagttatacttccccacttcaaaacaatgtcacaaaaaatcaactgtgctacagttcccacctgattgaggtcttggagagctctggtgcttcatagagaacagtatctaaagtcagaagaccttagtcttcaaacctggattcgaagcctggttaaaaacctactgtcagtgaatcttgggtaagtcagttaaatctgtaatagcttcaggaccctcatctgagaaacggaagagtttctaagattccttttggctctaaaattgtacaacattgcttttgcttaagataaagaactaggggacaccagttagcttggtacctagcagagaatgggaactcaaacactgactgatacttcaaaagtgtactaaaatataaacgatgcacttcaagacagcaaagcaactttgaaatgtgtaactttaaaaacactattttgtgattatataatggttatatgattataatattaataacttggaaaatacagaaattttaagttcaaaacaacatttacccaaaatcccactagagggaagtaaccactgttggaaaatgtcaaaatgccatctgtcttttctatgactgtgtaattagataaaaagtttacacatgaattaaattgtgtaactttaaaatatacgcaaatattaacacatatttataaaatagttatatcatgcatagttttgtagtcttttctttttattcacttagaaaagcagagtattgtgtgataacaccagctctggaggcgacctgtctggtgtcaaatcctggctctctcatttttagttgtgtcaccacaaatccacactaggaaagttttgggcaaattactaagcctatctctgtatcggttttatcatctcttagatggcaataataatagtactgatctttccaagtcactgcatattttaaacaagttaacatatgaaagcactcagagtagtgcttgggcacacacaaagtataaaatattagccattatatcatattttctttataattaaaatctttcagttagtagttgcaaaatagtcaatcacacaatacaccaaaatcaacttctccttcatcagtttgtaaaggctatctataagaataatcctttgcctaatatgttttgttggaaatttctcctaaactttccatctgctatctaaatttgtttatgcacatttaaatagagaagttccagatcttatatggaatccctcttttatgtttttccccccatgcttttgtgtttagagaaactgaccttcttcatctcaaaattcaatagtcatctatattgacttctatttattttttgcaatttcattttttctaatatttaaacagttgatccatctgaaaattgctataagagatgcagtgaggttctagttttatttcttaaatatttaaattatagttgattgaacagaccctcccttttgttgatttatcatatcactgttaatctttatgtatgtaagcatgtttctgaacatctgttcttttccatgcattaaactgtcaattcacgggtcagcacaacattgctttgaattttataaatttattatttttatcaatatctgctagagtaactctcttccccaatccatttcaaatttacatctttttgctaggatattgaagattaaattaaatttataaataataaatatataataataaattaatgtggacagaattagcatccttccccagcgtttagttttcccatccaagaacagtacttgtttctccattgtctacaatctgtttttaaatttcttggaaaactttcattgttttctttatgtgggtcctactagtatattttaaaatagatacatctataaacctttgaaagttagtagttaaaagaaagtgtcatcaattatggtttatgtgtgtggtttaaatatgtgtatttctgtgcatctgatacttggtatattatgtttgcagaaattctctcttatttaatagagatcagatagcaatggagaaacatgaaaagcaaaaagaaagttatataacgggaaaaatgtgtattattaatattctgccctacttctaatgttcgaatccacattatttttctattctattaaacatctattttaatgatacatttttagtaaaatgttatgtttgtaagaagttaggacaatgcctattaatacttaccagaaaactcaacactactaagctctagctgaacatccttcatgtagaaggctgaacactgcaatacaagttgccactaacccctgctacagacgtttttctttaaaactcaaaactgtatcacgaagacctcacatctaatccatctaaaatcagacatctgacttattcttagaaatatgagtcaatcaaactttggttatcctgactcagctaaatagcccactgacattagaaaagccaaatggcacatttaactgaaccctttttaatgtggttggagaaataaacagtgagacaaaagtcatgaattctattttcggctaacatactcaaactgactatttgctgcagaaaatagttactacattttaaaacttctattcttccaaaatgaacctaacctttttttctttattttttaccttcttgaaaaacaagtctctcacttctcaggccaaaacgaaaaataactagctgagttcctcagctaagctccaaaaccacattccaaacttaataacagagaagctgaacactttatggtcacaaagtccgcatttttaatgaatgcagtgaacgcctgcctttttaggggcctgcattattttcatcctctcattagtctagtgtttcttctataaagaaaaaaaatcccagaaatactaatattttcataaatatcatggcagtgaacttggagaagcctcaagtgcatctcaagctatactgtgagaatcacaatttttttcacttgaataaattagtccttgagtctcaaaaatgctttccataacttcaaaacctgaagataattcaacattttccgtttttctaatagtgttcaaaagagaaaacacaagtattgcttgagaaagtaaacagacatcctgatattcaaacatggacagttaatgttcccccaataatatatttacagctcagtgcaatgtcctactccagctaaaagtgaattcccaagtgtttctttatatagacagcattatcacgtaaaccaaaagcaaagcttacagctggtagctggtcacctaccatagaatgtgttttcattagctatagtcaaaattttagctacatgggtcacaaattgtgtctagaatcaaaaaaagtttgatctgtctgtaaatttttttaaagtgtgtgggattaagagaaaagagctaaatggaggaagtttaaatcatcttcaacctttgaacaagccacaataacaggtatttgtaatgaaggccttacttagtcacttgcgtggttctagggattaatagagtttgtgtattcaagagggggctggatagattcaggtcaacaaactgagtcatgtttgctcaggtgaaagctaaaaataaccactccccagtattcctaggagagtaatgcaatattacccagctgcctcagcacacattataaatgtctcctccacccacccatagtataaggtttaactgaaaacaagtaggccaaaaactacttctacaccagaccaattcaatgacagaataatttggccaaaactaaatatgcctagtcactgtaaactggttaactcatggttggttaagatagccttgggaatatgcacagaagttataaaaccatgagctattcattgaaaatgcagtccattatgaattcagttctttttactttatcaaacatgaccattttattttgtctgtatttcaatacagtatttttggcctccacttttccactacagcacatgaattgtgaaatgtgattctatataacatttaatgttaaagtgatatgaaatcaataagacttctaacaaattcaaggtgtgaagaaatgtacaaacacaacctgaagtctctatgaaaattcagtggtccctcagttacacacattactatggctcacagtatattgtccaaatttgtcttgagtatctaccatgcactagacactgccggttctggagtaaacctgataggcaccaaccatatggaacgtacaaataacggaggaagcagacaataaataaacaatttcaggaaaaaataattttgatgaatgttatatgtaacctgacattccctgagaaagggcaacagtcagatatttgggaggtgggagaaatgaatacaccagaatgacagaaaaatccagtcatcgttacaacataaccttgaataaaaatgtaagtgaacaatgactaaacctgtagtacttcttttggaagaatattcattgactccagtcagcttcctgttatttcacttcaaatggctatccagtttacaaattactatctagccaaccgctagcatttatcatgcttaaaattgagtcaacattaaatcattagcccctattccttccagaacctgtaatttaagagttagagagagacaagacttggttgcctcttagaaaagttaaaataaaactaaaacaacaggctgacatgacacattgtctccatttaagccaacatagactatttatttctttgctttattatgagtaatgaacatttctttagcaatcacctaggagcattactattatgcaggtaccgtactaactaaagacagagacgaatggcctcccagacccccatttgctcacaggctagtgtgggaggctgagaagttcacaaagaattacaccctgattggaaatttctttgacagaggtttgcacaggatgctccagttgtaaaaagagctgagggtagctttcggcagggcttagccttggaagagagcaggtaatagccaagggagaatgggggatggccaaggagggaaggtgctgaggtagagatagaacatgtgctgggtcatagaatatctaaaacaatcatattttctgcagatatctgtgcttgaatattaaaaattaaaaagagatcatttaacggtgaaaactgtagtactactcttatctctgtgtccacccttgccttttctaatcagtggtataattctactagagtgccttggcctctgctcccaatcatccctgctgtactctatagagcaccataaagaaggaataataaacagagccacacataacaaagaacttttatttggcaggaatgtttccttttatgacacctatctctgccctgtaagtagccacaaggccagaccagagatctgctggaaggaggcggagtgagagggtagtcaggtgggaatgaagaagctccccgtcctattcccacaaatggccccaaagagcctttgaagtctcagtcatcaggtaataatagccttcctctaaattagaggaagaatgtctgccttgcaacaaagatgatatttaaagaataatctgctttggggtacaaggggaaggaatgcagagaatagaccagttgaaaaggtaattcctgtttataagaattaataatcagaacagcaccattttaaaaagtaatgacttaaagtaaaaatggtcaaagatttcagaaatgttttagagaattttatgtttacaatagaatttatctaacaaaaatgataggaacaatacacattgatttaaaaacatacaaaaagttggtagcagatactttctcctactgacttgagacattgatttaacacctgaaaactaatctcagttaaaaagctgccagcaccatctctccacctgtaaaaatgtgaatatttatttatattttataatttcattttatttattctctatcttgttccataaaacattttggggtactagaactggttattagcctttattttttaaaaataattgggactgatttcaacggatagaattaatgttggggcgggggtgggcagagactacaaattacttggtctatgtctatatcttcaaaagtttggggagcttatattctccagctattgctttttttttttttttccagctattgcttttgaaacaacagctgggaaatataagctcctcaaacttttgaagcaatagctgaagaatgaatataagctcccaaaacttttacctgatctatgaagttgaatggctcaatatccattttactttgaaatgtagagaaaacctccattgcactatgaatggtatttataagaactaaaaggcatatgcccaagttggttctaagctctgcctatctaaatatctctgcttgccttatgagaacttatataaaacatattgagcacttaaacccttgggcaattgcagagtgtgctttggattttttgagtatcaaggtggggagggtcgaaaagagggagaaagggaacacaggtgtcagaaaagactagatgaattcctgttatgtaactactttttcaaatgcccccaaagtacttatttaacctaagaaaatctttagctaagtttagaaattagctttaaatatgctcaattgattttccttagacattccacatgcctttcgccagctcaaaagccttaattctggttaaaaggaaacatgtgaaatatactgcacaacttcagtggccagatcatattaactggctgagctgtgaggtcttatgagccaaacctgcttaccattcactgaaagtcagttcctaaaaagatttcttaatatctgccataccacttatctaagttttgggtggctaattagaatgagctcttcaaaaagttcagctaaagaaagtgcaaatatttgcattaaattgacttagtacttaaatgattcagtgtgttaattcttttactgaaattgctctgaagttatagtagacacttatgctttctccaccacctactttgaagagaagattctcctatatttcaaccatacccattaaatcttactagcttactaaatgaagtattatttcacaattcaatctcaattactggagagctgaaagtgtgtctacagagactagaccagaagtgatttttacaattatcaaagctatgcccttgtgcatgaaatggggtacgctaagtgaaatgaaattcattcttgccagccactttcagtcagttagttatgctaacatctgttctaggaaagctaattttttttaatacagcagaacattcctttacactgaaccactaccaccaaaacacaaacatacatactacatagcagagttgaatgcaaaataatttgtaccgtacacacaaaagtcaagcacttatttaaaaatagttctttacaatataaacttatgaaattatggacattttgacagcaattttccaaaaattgtagcaaacacttgtaaatacattccgactcaaaaatattgaaaatatcatatgtttacattttaggcagatgaggattttaaatgcttcgcctacaacctcaattgttgtggagccaaagatgcaacagctttgaagaatagaagaattactctatatttgtcaggatctacgtggcaaacaagcgccacttggcttacattacttgcctggcttggatcccatggaatggaggagcattggaaccaagaggaaaaaaattaaagtgctttgggacagcgagccaaactcttacatagtatttgaaatggtgtggcaaacatgaaattattttaggctcaagattggtgctagttttttaccctctttttgaaaaaatagtaaaatgcacataaagggccctgccagaggtttagctcataaaatctgccaatcattggatgtgctaattggtgtagcaatccagtggtggcctggattaggactcaaaaactgacccttaccacccttggtgtcctgcagcaaagacagcctaaatcgaaaagactgatggaagtatatcaaattacgaatttctctatccctgaaaaatgcctgcaatttctgtttctccatcactccagaaatactcaaaacagcaaaaattaaatacatatgaagtgaacacaaaagacctccacagaaaaatcagtggctcatctgttgacgctattgctcattgctcggctggccagtcatctgggctaagttttgactttgggccagtgcttcaaaatcagcaacctttcagccaaaagactgtggaatgcagccaagaccacctgtggaaagtgaattatagcatctttaatttactaccttgggctatgatgtcagaaacccagcatggagggcgcaccagttcttgtgtgggaaatctctcagagcccccatggaggcccccaaagtggctctggcaaagctgtaggggtggaggtaacaaaaaaggggacacctggctctccttcttaaatcagctcaccatgggcacacatttatattggaattttagggtcagaaaataccaaaattaaatcttctagaagaaacacagtcagtggctttgctctaaagtgcctattacactctacaagtttccaacatttgttatttaaaataatcagacatttattattcataaattacatatattcttttatcaatattattgttaataataaacatgaacaactagtaagtgaattgcaaagaactttcacatacatagattatcgaatccacctagttaacaagtaacataattagcaccattgcatattcagaagatcagtggtttttgtctcatcagtaaatagagttaggactggaacccaggtctgatttcatatctaatgctcctttccaatacaactatctgtttatttattaacggttactatttattagcactctcagattacctgagatagttgcagagctgagggatgaatgaagacgactgtggccataagtagcttgctgaagctccacaggcaaggcactaccagcactgggctgggtgtcactcaaagggagccagcaagatagcttttctgggagacttacagtcagggacagagtacctctaagacttccataaagaaatgatggagtaataggctcatgaaaatgcactaaactcccttgaatctgataccctcccagtttttaccgggtcttggttatgacttcatattgcaggtaggcagtgtttaggatgttagcctagagaagatctgactcaggaacacagcgctgccatggaagtctatgacagcacttgcaggcatagtgagagacaggaattcaagttagagaaaatctgactccagagcaacctatggaagaattacttataattcaggtaggcaaacaatggcacagtttgactcaggaaagggtgggttcctcaaccatggaaacatttgggaagtaaatggatagataagagcaagagcctgaactaaatataagttcctctcagtcacaccaaaataagtctcctatccatgcatatggtatgtcagggaatggagaaattaaggtccaacaaagagctgcatatagtttattgatttgttttctattttctgaccagttccagataaacagataaaagcaattaaagtacagggcattctgaatggtcaaaaatttagtattgtacattgtaagttaaggctaagggcaagtaagacctgttaatgtctttatctggaatttcacaaatgccaagaataatcatatttccttccttgattgattattcaaagaaaacacaggcccttataatttgcaaatttcctagaattgagggtagaggtacattttaagggtaacttgcagttttaacattcacattcttaggaattattattattattaatttttttttttagacggagtctcgctctgtcgtccaggctggagtgcagtggcgcggtctcggctcactgcaagctccgcctcccgggttcacgccattgtcctgcctcagcctccagagtagctgggaccacaggcgcccggctaattttttgtatttttagtagagacggggcttcaccgtattagccaggatggtctccatctcctgacctggtgatccgcccgcctgggcctcccaaagtgctgggattacaggcttgagccaccgcgcccggccggaaatatttttttaaaaaacattgaaatcacaaaattaaatagtctatgcaattatttagtattttaaatttcatcagttttaggttctagctcaagggccgtctctccttcattcaatttgttaaatgcctatagtgtgccagctggaggcctcctctgattttccttcagttgacaaaagatccttacttcctttggtgccagtatcacctggtctatgtctttattatagcattctactttatttgcaggcatcacttctgaaccctacaaaattataagctcctaaggggaaggactacatcttattctgccttgtgccactaagcacagaaacttaaacatgcaagtcctccagacctgaactgaactatttattatatggcttttgtgtcataataaacatattaatgtaagttatgctcaatgtaactaacaaaattttatcaaatgcctactaagcatcattttttaaatgccatagtggattaatccttgtcccgcctgtatcaaagtacacttagactggcactcagtgacagtttgggaagaagccagagctgccttccgtgaggtcagtctcccaaggtcacacatgtgctcatcagagactcacttcctacaaatacttatgacggttcttccagatccgtgtcaagcaatatattaaatgaaatactgaattttgaagatcaaaatgaacttttcctaaactataacccaatccacacaagtaatttacacatcaaaagaaattagatagtaggcaaacaaaacaatggtaatttttttaaaaaaaactgctcccaaagggtttgtggccaacattaatattgcaggaacatgtttagataactgctgttcagcatagttcctggaaacaggttctcaaagccaggacttacagttatttaccttcttccagcactgccctgagggttttaaggcctaaatgaatagaaagcaaatgggggacaaaatgaaataaaatgttcacatctcagcctttagtgtatataactaatgtttgaagattttatgacaaaatgtgtcttcttaagaacacatgtagggaagattttggccatttctttaacaccctttaaacagtacctaccagagaaaaagcaaacactcccttctaaaagcatcaatattctacttctgagatcaaaactacaaaacaggctcagacagaaacctgggcaaaggaaccttctgctgcacgtatgtactatttcccagagatgtaaatgatttttttctctctgccccagtgaatcacatatgaaagttctcaaagaattagtaaagaaaaatggtgaaaatcttcttggtgttgaaggaacagtggagtgtagctggtatcagaagttctgaagtgactcagagattcagaagggtgacaggcaggggcagtttttactagaggaaagagcgatgtaggatgaacaatttactgtccctgttgattcacataggatgtaagtacaagagaagtcaaggatgtccccaaatttcttgcataggcagcagatgagtgatgtcattcactaagacaggaatcaaagaaaaatgaatgacatgtcatatcacacgtagaatttgtagaagctggagatgtatagcttgtttaaaaggggggtttagtatggagggttgaagataaaaggtcaaatatgtgaatgactaaatgtggaggaggaattagatttaccctgagtggttccaatcttgcaagttctcaggaaggaaatctgagatcaataaaatcaaactggcccacagttcaccacaccagttgaagaaaatgagctgccggcacctgtgtgagtggaggtgctcctcagttaacacttggtgagtgcaaagaatgcagagggcatttgagcaccgggtagggatggaaaggtgacttttagggtctttgttatcattattattctatgggcattcttcatatataatatttagagcttcgattctgggccacaagttgatctgctattcctgaactactacaaatttgagcataagaatcttggcagaataaattatcccaggactcatgattgctgggttctagcaatggatatgcattaatcaggcaaattattcaatcaatcttgggccttagttttctcaactgtaaaaggcagtatttaaactgttaagcacttttaactcagcaattgtaggattctaaaaagaatgtatgtacttctacgttatgatgaaagtcactcttttaagtttaaagaaaaagttcctacaaattagggtcaatttatattccaagagttctggctgtccctatcaggcccctcctccccctccttgtccttatattttcacatctgttagaagaacagatcttaatggtcctattctcgttctgttactgtttgggatctgaatgtattctgagtgttttctgtcttccaacagctggagagatcaaagaactgttcctaaaagcaaggacaagctacagccaactgcatatgtaaactttcatactgatgtatttagcacagtgaattatacccccataatttataatatgagaaggtaggtctaatccaataataataaagacctttaggagaaaacaacaaaaaacaccattccagcttccagccagtggtctgaatactcacagcctaatacaacacaaagacattccaatacaatgaaataatttggatcatgtccagcctctattttttaggatgatagaaataagctcaagagagctaagtctatttattattcagaagaaatgaaagtcatagcatacacttctaagccaagagatcattgacaaaatttgctaatgaaatcaattcataactttctttcagattttcatttaaacggctgggttcctaatatatttcaaaatttacactgattaccctctacaaaaagtatgtcataagagaaaacaatgattacagagtagcaagggacttactttcacaggaacggtgctttatgttgctgaaggcaattacaaaaagagagtaagaaaaattaaaagcaagagctagagctcagaaaaacttgggttcaaatcccaactctgttactcactagcaatttagtggggcagcttacctagccttgtagaatgccagtttcccttttgtaaaagtgtactaaaaggtactcgcctcctaaatttattttgaggataaaatgattaatataaaaaccctattacagtaccatgaaaatagtgaagccttaatgaatgttagctgataataatagtgctgtcaacacatgagaagaattagaatctggtgggagatgaagacctactccatgttctctgttctgtcttcttgccctgaggggtgtgttcatcaatatttaaggaactagaaggtgtgcatcttggatgttaaaaacaggggctcccctcacctatcagtgaacagccccaataccagagatgattctatacaaattttaactggaacatctaagataaccctgagaaatatcccaggcatatcttaagcagcctgttatttgagggaacacagaattaacccttggttttatccttagaaaaatgggatgataacatcttttttcacaattatcttcacaaattattataaaatagttatggcagagcaaaaactattgacatgggtatttgctaccctttcccctcctctcttcagataaagagaatgctggttttgcctcttctgtcacaaccccctcacctgccccccgatgaggattcaactattgctagatggattctttgagttttcatgatgcacaatcaaaagacaggggataggtagaagatatgggcttgagctcggcagggagaggggggcggtttaccagcgggagtgttggggagattttggaagagacgttagaaacatcaaagtagatgggaaagaaaatagggattgctagaagtactgctacagattatatatcccctttaccatgctttgacagttaaagaacagaagttgttaggtcactttaaattcacctttggttgactgcctgtttctttgacagaatccctacttggagactggaccaaagaggctatgtcttccatagaggcaacatgagaaagtaagagaggtgcaaacacatcatgcaaacgttaggcagaatttattgtgttcatacatgacatggggaacattgaaaggattgatgtcttagaaaggcgtgttaggagtgtgggtctagaatgcataaggttagagatatgcctgcactgggccatcatcttattttaatatttggtccaaattctgggcttctcacaatcagagagctatacctaccaatttcctcttattattcttggctgcccggtccccatccctctactcagagatttctcaagctttgcactaatggcattttgggttgaataactgttgtgggggtttggcttgtgcactggaggatatttagcaacatccttggcttctacccactagctgccagtagcatcttcatccccactgctggcaagttcagggggggtgtgggtgggggaagtcttctccaaacattgccaaatattccctggggagcaaaactgcttctggtggagaacctctgctttaccccaatcatccaggcttacaagaaaaattcatactccatcaagccattctacaacacttcattttcagagtttccaactacagagattccaagttctcagcaattcataaccattacagtttgcctcatgttacactgactgcatcaggctgtcatttagaaattataataatggctaccacttgttggatattttttatgtgctaggcattgtgctagggacttaacagggtgattttcattcttatacagaagtaagtgtggccgggcacgttggctcgtgcctgtaatcccagcactttgggaggccgaggtgggcggaacacctgatgtcgggagtttgagaccagcctgaccaacatggagaaaacccgtctctactaaaaatacaaaaaattagctgggtgtggtggcgcatgcctgtaatcccagctactcaggaggctgaggcaggagaaatcacttgaacctgggaagcggaggttgcggtgagccaagattgcacaattgcgctccagcctgggcaacaaaaatgaaactccgtttcaaaaaaaaaaaagaagtggtagatattattatctccattcagagatgagtaaaatgaggccctgaaaaattaaaataactcatccaaggtcacagccaataagtggctgaactggggtttgaacctaatctgtcccaggtccatagtctctccttgtctcaggccacactgtttctcctgatgagaaaaactaatgcagggatacacaagaaatacatttacccaaagttacatgagttcaaatggcaattccactgtatggactattgtagaggttgttgatctcagcactatgtggactcagcagtatggatgtctttgttctagggacatcaacaagctgatttttgaattatgaattttctgcagaaaataggaaaatggtgctctcctttaagtagaaacaacaaacagtagctggttgccatggtagcagaggtaaacttaaccttgactgggaaggcaatcaccagaaagggacagcaagtatggtcaggagtctaaaccagaccaggggtattttaactggagaagagaaagtcaaaggagagaaatgatagtcatctttagttatttgaaaggctactgtgtaactgaagtgaagcatacattcaagattattctaaatggaaaatccagcattcatgagtggaaattacaatgcagtcatggaagccagttttccactgaatgataagaaagaacatttaaccatcgtaatgttccaactggattgaaaaactaaacaagctgtctagagagcaataggtcgctaaaatagaaagatcctaacaggaaggtcatctctcttgggagacccagtgtgggtgagactgggctaaacaaattctcaggccccctccccaagcaaaatctctgtttctccagagaattagtaaattggggttccctgttgaaaacagacaaatggaaggtccactgggcggaaagccccagccgctcatcactacaagaggagaggtaaactacaatctcacctgggaagaaaatgttgtttaggtgacacaaaccaaggggaggagaaaccttgtggaggatttttcccctctgttctgaatagatgatcaaggggtaaggcagtaagggcaaaaccaaaaacaaaacaaacagaaaaaaacccaccaagaatcaagcagctttctgctgtcttccaaccctcagacactctgatgcctctttcttggaatgtaccgccacctcccactgctttggcctaaagactgcatttaattttaaaaagaaaataggcaaccatccagctaggggacagttagagtaacagttgattagtccttttctaaacactgtcttttgtttcattgctctttatttgctgtacaccaacaattcattaaaaacatctcaccactagatttagtgaatggagaggacaggtctaaacccaaacattcctcttggaaaaccgactacattgtaaatttgcagacctgtccaggaaagtaaaactgttacaaagtcaacctctactgaggcacacagcctcctttgtaaaagaaaaaaaaaaaaaagaggtgctaaaaaaatgacaggtttttcttaaaaaacaacaggtttttcttaaaaaacaacaaaatcttattcatctttccatattcagcatgaagaacacctaagagaattttccctatcgcctcatctccagggcactcaaagcatttacaatctcattattttatacaacacccattaagtgggcaccaaagattattacccttctttgatttctaagaaagcaactacagaaagtttaaacaagttgcccaaggtcgttcagtaaattgagatgcttggattttccattcagtgattgttctagggacatagtgcaaagtgactgaatcctctaaactcaccaaaacccctaagtcttacagatctcttccccatttctcaccactcatgagattttcatcatctaatcacaaatctgccaccatgtggatcttggacatgggtatcctaccaggccagtgccatgtctgcaagaagcctggtgctacacctgacagctttcaaatcaccatcaaatgattcctttatctagtgaagttgattctgcctggctgcatctgggaaatttttaacccctcgattagccattgcacagttggcttaacttggatgagacagaggacaaaatagtggtggtttaaaaaaatacctcccccattctgattacaaaggaggcatgattaacgaagtaccctttgtatccgagctccattctaagagaaagagaaagagctttccttcccccttttttgatcgctgagtcttttcctacttgtctcatcacccacacaatctgttcacagcccaaacagacaatccagccagtctgtggagagttcctaaaacatttatgttgtgaaagcagacaggatgaacaggacctcatctcgacaaaggatgatgggacattcagcaaaagagttcacgaagggaaatacagatggagtcccagagctgaatgaatttgcccacaatgtctaacacaatgccagcccttatgggtacttgtaaaccttctggtcaattcacagccacctccaggttttatcccccaaattccattacttttagaacaaagggttttaaaagaaaatacaattaacaagttaaggaggtccaaatcagtgctttaaggatccttcaatttctctagacctttaaacataaaaatagcaagttagatgaagattttagttccaacactaccagatcgggagttgacataatgcacataaaatacttaatacattgcctggtacatactaagtactcaaataatattacctaatattttcatcttacactgctctattttattaatgatgtttttatatatgtcattgcctgtctactcagctaaatagttccaccttatctgtttttggtataatccaaaagataaatgccttcatataattatcttatttaagctttcagatctatagtaggttacagatgagacagtaaaagcaagactaggtctcatagctggcaagtggtagattcccatactgagatctcaactcactaatttaacatccagtgctttatttcaataacaccacagatgaacagattatcatctctcgtgcctctttgtattcttcagaatttagctaagcgctaagatataccttaatgatcatctaaaataaatttctaatgataggtaacctaacatgtctgaagatttattttagtgcctttaataaggaagaaaagaaatgggtggaaaagcccaaccatacttggctttgaggaaagacatgcctctgtttttatttgccaagggaaagcattaccaggtccatttagaaagacaagaggaagtaaagccgggcgtggtggctcatgtctgtaatcccagcactttgggaggccgaggcaggtggatcacctgaggtcagaagttcaagaccagcctggtcaacatggtgaaaccccgtctctactaaatatacaaaaattagccaggcatggtggtaggcgcctgtaatcccagctactcaggaggctgaggcaggagaatcacttgaacccgggacgcagaggttgcagtgagctgagattgcgccattgctctccagactgggcaacaagagcgaaacttcattccaaaaaaaaaaaaaaaaaaaaggaaagacgaggaagcatgagggattcaatgatataccaaagagataaatggggctagagccagaactcttgatactctgctcatggctttctgtattaagttcattattaatttggcaccttgagtgagatgaatcttgccttggattatgcacatcaagttgtatttcagatggctgtcccatactttaaaggcccataccaaacccccatgtatcaaaaaaaaaaattatctgatctaaaaaatgcctagatcccttagcccttaacaacaaactgtcttattttatggatcttgtcttcccaaatttaagttgctggagggcaaaatccatgtgtttactccttctgtagcccatggctaacctagttcagaacttgtagcaacgtgtgctgctcattgcttcctcggcctcacagccttctagatgtcccaaagaaacctcgagtcatcataacatctactgaatttcccaaccatccccagcactactgctcggcttgggcagtcattaaagcttctcttctgccttcaggatcttcatttcagctgctgggacatcctgttgccatccatttcacacagacatccagcccagcaggaacccgtgttgcaatgagctttgcttcaaagccagcagcctggccaagttccaggaattgtcactaatgatcttcaccagcaacttggtgctcaacagtgatctctgaacacacacacacacacacacacacacaccccatttccaatactgctctagttagaggagctgcctaacagaggttggttccataacttattttattctttaattgttacagaggacttatttcatcaaaataagctaactgtccaaatacactctgcaatgcagcagtggcctccaccaacttactccttttttttttttgagatggagtctcgcactgtcacccaggctggagtgcagtgttgtgatcttggctcactgcaacctctgcctcccagtttcaagtgattctcctgcctcagcctcccaagtagctgggactacaggcaggtgaaaccacattcggctaatttttgtattttttaatagagatggggtttcaccatgttagccaggctagtctcaaactcctgacctcaggcctcccaaagtgctgggaccacaggtgtgagccaccacatctggttccaccaacttatttttaaactgaagaaggcataacaagtgtatcagtttcttttggttgtaagagacaggaaagcctgctcaaagatacttaagcaaaaactaaattagtaagatgatactgaaaaatatctagagataaagcagtcttctagtggttgttttgagaaatcagattatgtcaacagatctcacttctctacagtcattgaattccaccctgtattttattagcttcattctcaggcttcattggaaagactccaacaattccaggcttatattctgtgagttgaaattcagtaagaaaaagagaggacatctcttcctggtagcctccacacaagtctcagaattcactctaattagactaacttgaggcataaatccaccgtggctagtgcttggcttggtcacatgtccatcactggaatcagaagtgaagattctcttaaggcacatggactgagagtggggaaaaaaatgctccacaaaggagattcaggcagatcctgctgccaaaacaaataggcgaaacactaggcagccaaaaaacaccaatcatcctctccaataaatcttccttcttttcctaatctccaagaagttgtattactgggatgatccaactttgaaaatagtatattaaaagaaaggaacaaccacgcaagtcatataaaaatatatgtagccagtaggcacatgaaaagaggtttaccattactatcaatcaacgaaatgtaaattaaaagaataagatattatcagcacattgggaaacattttttaaacaaaagtaatcaccagtactggctaacatgcaaagagatagacattcccagatttggctaatgggtgatatgatgattatcactgaccatcaaaatccttaaaaatgtgcatttcattttacctaagataaattcacaaaagtgaatttactaaggaaataataaaggatgtacataagaatttaaatacaaagaagatttctccagtattgtttataatagccttaaactggaattattctaaatgtccaacaatagattgagcaatttaattttatccatactatgggttatcatactgacactaaaaataacctttcaatgcatgtttattagcatggcttaaataagtagaaaggcactatacaaaagaattaataaagtgggcaacaatagcatcattcactaactaaacccagtaaattagtttcaccctcatctcctaggcactccctggttccttctttaagatttaccctggggttctaaagacccagattccacccggggaaagagaaaaactctggacaccctcagcaggctaaaatgtgttgaataaatatgtaaagagagaatcaacaactgttcatgggaatggcttgctacacagaggagggtgaagaagatggaccacaactgtcatttacttgtcctggaagagagctcaaaaagaaatgtttggccaatacacagtgatttctatcacaagtagttcatattttttaaaactactcttttttcttgttcttcaacttgtcataatgtagcaattaatattcaaatcccgagttattccttccacaaacatagctactgccttgccaaataaaccataccacaaacagttactccccatctcagttttcataagtttaaaatgtaaatatccctgatggactggcctatcttagagtgttgttgggaagatcaaataagatgatttctactaaagtaccttcaagaaggataaaagcactatacaaatgtgaggtatcaggtgtatcagtgcattacgcagatttcacaaacacacaacagagcatgggagagttcatggcaagcctctggctcctccattaccctcatgtccttttccctgcagtcatttcagaaaaccagatgtttgtttgcaaagtttctctgcagcaaaagggcaggccctctctacattcaaattggctgaagctgtgtttctagctgttgaaacttagacaataatgggggagatgccaaaattaatccaaaaagcagacaggcacactttacagactggagccctgagatggaaaaaggcagcagcatgaacaagtagagggttaatggttttcatattatttaattcaagccgcaacaatgacagattctaaagatataaacttctgagagtgagcattctttcagaattagtatacaggggtcctattagcaatattttatatactccaaatatcttcccaaaggaaatcactgctgaaaaagacaaagttctttgttggtagggctgtgcgtttataccatggacttaaatacttttcttctacagtctcctcattttaaaaaatggcaaaaaatttcaataaaacatggatggagcaataagaagtacactgaagttcttaaatgcccttctttttaaatccccaccccaattacgtccctcccttgaggatatttacagtcctctatgacacatgctctgtaccttcttggttcaaggaaaacacacctacagcatttcaaattaactactgacccttactctcacactataaacaaacccttttcacaatctcaattgcattgtgtccacattgattaaagcttgaagcctggtgacctcatgtggtgttaacttctcccatgcaccaacagcattccgcctttctactcaattaccccctttggtgccagaggatcgctacccaatgaacacatacaatggacttctgcttcattacactaaccaacagcaggatagaaataagcagaagaggaataaacaagctaatttatcatgaggacagagcaagctttcaccagtctcgccatggaaaacttcagtggttaacgggaacatcaatagtctgggggtgatgtttatgatcttacagattatggacaaagccataacagaaccccaaactgactgaagaattctgcagattggcaggtgtgaacacacgcacacaaaacccatgccttaaaactccggggtcctacataaaacctactcagtaattattttgggaagcataaccctgggctttggataacgtgggctgacactctggtaatttgctccaactgttcagcttaactgtggggcccctcttatttatctttgacaaggtggtcaggaggaacccagcccctttgtgagaggggtctggttcccccaccgccccctgcttcattaggcatggcaaggacacagcggttgattaaattaacaactttggagggcttcagtcccagttcccagacattagcaccatcatccagaacaaattaaaagtctcacagcaattaagcagattttgaaaatgaatttcccatggttcaatggctcaaccacaatcttgagttaagtatcagagaagagtattgaaggaagagaagaggaactgactgctgaaattccaaagtaaacatacaactggtagaagcagcatacacaataaacttctgagcctctgctaagtaggcttatacatttcttttatagaaaattggaaatattcagtcacataaggggaaagaataaaacattaacatagaatggttgtatcaaaatggtggatttttttttcttttttctttgtttttaattactttaacatcattttattcttgttcaaaaatataaatagatattgagaggggacaaaaatacctacttccagtcacaggcttttaaattcaaacaagaaatcgtacatccaagtctggaactggaatcatctatatttctctgaaccagtacaactaggttcacagcaggcaaagaccttttatgccagcctccaaagaaccctgggtgggtgatttacctctaagaactcatttctggatcaaaagaataagattaatgataaaatcatacctatcacattctaggtgtgtactctttgccaggcactgccgttttgaggccttgtcatacttgcttccttccctttcagtttacatatgctcctttaatccctgttcccgcctcgcacctctgcctggctctacttgcaagtcacaggcctccgttcctctttgcctgcaggcagacatttggcacagcttgtgtgcaggaacctggaggaatcctgaaggaatgtgcgaatgaattcattcccactcaccagatctataagctgaagacagtggaatgcagaggtagttacttgaatgaactatattttcctgtcaagggcatttataaaagctgacatcataaatacattattggtctctaagtacaactgtaaataaatctacaaaattcttagaaggataactttcaaagatttgtttttcatctttaaaagtttatagaaaattaagcaaactatgtggctcttctaaaagaagccccttcaaaatagccctcacggaacagaagaaacacatttacttcttaaagacagtaaatctcaaaatttgcattacagttcaacagttccatttggatattcaaaatttggaaatatatatacttctgtgtgttcccttcttcccactaaactttaatcaactagtatagacaaccagccacagtcaattatctggctttatggccaagtagggaccaaaatatataacccagacataataacaatcagcataacagtaggcataggtaatgaaactctccgctagtggtcagaaagctcagttcaaaccttatttctcactatgtcttccttggaccttagtttccacaatataatggaaaaacgtccctttccaactccaaaattgtaccattttagaaatgtaagcatgtatattatgaaggtaacacaatcttttatgttcaagtgaataataaaaaccctcctcccatttaaataataatagcctggaatataatgttataaaacttagggaggacctcaaagccttaaagtagaagcattttagttacctccacaataggtccaaaatgcaaggcattcatctattcacctcttcaacagatattattgggtacctacattgcattgatctgtagtaacagccataaaggtgagtatattagaccatcattattctcatacagcttacagtttgacagaggttatattttaatcattattttttgtttaaaatttcttataaactataattctagctaatgtttcagaagtaattaatattttatttttaaaaatcatttttcctcaaagtttgactttaagaagtctttgtcattcacgttattatctagaagcaaaaaaatttcccagtggatgatgactccaattttataatgtaaaacagaagtacaactgggattcacttcgcagcaagcaaagagggaataaatctcttccacataatgagtgatatccatttaaaaaagtcatgctacctgggcttatctatgctctaaagagccatgaatactggcccagaattttaaaagacaaacatttagattcaaattaaatgttggttaaaaagaggaaaaacaacccaagttaattactctaatttaccgaatatatgaatgacctgcttattggactattggctagcatagatcttgcctaataggaaggctatcaagcagggtggctgggtttctaattttatccaatcaattaagaggcagaaataacctgcccattgaccttacgagacacaagttgactccagaataaacaaacaaacagacttgaaaagttaattatgggcaacctctccttcagagaaatggctcacatatattaattgatctaacacctatgtgcaggctcccaagaagatggaactcgttctctcatttaaatcccacaacccccgtgactcagagatttttggttcaggaaactgaggctcacagaatttaaatggttagtctaggttacaaagcaagtttgataacaaagagataaatcagatcactgccatttatcaaccataaaaccacattccatcagttattatagaaatccatcactttgaatggagagatcaagtttctcaaggattaagcttctcatttaacatgaactatcaaatggaaaacctcgagccaacacttatttttatagcgtgactatttctcaagaatcctgtaagaagcccacatcaagaggcaactttcaaaattactaaaatttcaaaaatttcaaaattacaaaagtaacagttctgtcaagtgggaagagttaatgcctttcctttacagagctgctttatgtaactagccgaagttttaacatagaaatattactgtttcatatatacattaatcttgactttgttaaaatcccaaacatactgctcatcgatctcctaaactttctctttttcaagaagtaggtgggggagggaaggaaggtattggaggaattcttctgatatctgtaaaaacagaaacaaatgctaattaaaagatgaccttagtgccctttcagtttaaaaatcttgagcatttacaaattatcttttttttctctttcatcaactattacccagaaataccacattctcatagagcaaagctctgtcctgtttgggcatgttcaaagaatagtgccagggatttaatactggcatgctcatggacctgcaaattctgaaattcagggggaggcatgaataaaaagatagctgaggtcccacagttgcctgtcacagccaagccccaccccacccacatcctcatatgatcctcaagaagcaaaacctttctgagatattctataagtgacagcaaggcccaatgtgcagtcttttcaaagcctcagtaaaaatcttatctatgacttcacttagcccagacacacaggagctaaaaggtaaaagcctggttcacacaagccagaactagctcaacagaaccgaaaaaagaaaggaatgtcttttctatatcttttccatgtctgaggcattctgctctggggcaaattacaacctaaataagaacagataaaatatatgggaactgagtaaaagaaatagaacctcaaaaagggctgctctgcctggaaagaaggctggaattcataaaacatggaacgtaacttttttagtgatcacctgaaggcaagcttgttaaacagagacttaaaagtcaagatttatttcagctaaattagatggtgcagaaaaacatagtgcttcgtgactctgctcagtttcaacaaaatgaaaagacagaggaggaagaatttacagtataatacttgcaccactcaaatcacaaaaatacacttgttagtcacaaaggaggggcccataacattgtaagccttattttggcaatgtgaattttctgcttgcaattaccttcaaagtgaagaaatggcagagacgaagaatgaggaattttgttgctgcttttgtatgtaaattcgaccaaaatatatagtgctatgtgactttaccccaagctcactagaacttcggaattatgcctgccacaaacatcctccgaaagcacaagaattagtcatagatttttttagtcaaggaagcctcagactgataaagtcttaaaactagacgcaaggactgtgctttggattggataagtaatgactatactgcgtggttttggtgtgtgttttttagagttttaaatttacatttccccaagcaggaggaagggaatgtaccacaccctcagcaagcaaggaaggaatttagttgattttttttaaattctgtagtgttccttaaaatccacatagcatagcataacattctatataattctgttgttccataagggattggctaagtatattaaggatacaaagggaagggggagatgacaaagttattgctattttattttcaagtgacagaaaaatcaatcgagctataagaagcaccagttgggaatgttctgcacattaactctttaatagccttagacagaaatcagatgatcttcacactgaaactctgaaggacatatatctttggggcactgagtagcattagaaactgcgtccaagccatggctccacctctaattgcatgaactgaatggcttccctttcctgggactcgaattccttctaaattaaggtagaacaagatagtcttgaaggccctttcatccttacgatttaatactgacaagctcttcagcttctattcaggacaaacaccaccaaagtgtatggatacaatggattcaagtagccacactcatggacagtgacaaaatcccacagctttagggtggaatcaagtatcatattggcctagaatgtattgatgctgccaaggtgtggggtgggggtgggggtgggggtggggggcaggggtgaggtaccactgatgtgtgaaatgacttgcctaatatcccagagacccctgaatcccaggcattcttattctgaatagagacttttaatcaatttcttgtctcatcctatgtcctcatgttaccatacttctacaagtctgtgctgccagtgagggttggcaaatcatcccaactcagaaggacagacttacaaaatggcataatcaagcttcactaacactgtatataaagtaaaagtaatagattgagtaaaagcatgagagattctcttgggagtaaaatgtgcatgctttaggagaagatttggacttgtgttcttatttgttagttttctgcaataacattaatatttatcatttgggggaggttcataatgaaatacttggttatagcacaggaactaatgttagaaagcaggatgacctccttaaactttcaaacccaaaccaagtaaggttttgggtcattcccattccttctgcctcaacagatctacaaatctgtaggtgttgggcaaagtggtggtgactcaaagaaggaaaagaatggataataaacagtgtcgtgtgtaagtttccccagatctaagaacagagagggacaaagaaatgtaggagagatggatttgggattaatcaaatggtttcagtgcaaagtcctctggaaatcacatctctgataggcctggctcaatgagacactccaacaagtgtcaagtcctcaagatagtagattccagtgatattttatgcttgtagcaatccccatgaggaaggagggctctgtttcacatcgcagttgagagagggagtcaatgagattttatgacttttttgggatcattgaggccacaggttgtctgcagagtcctagccaagtttctctccactaaatgacgctgctttgagaccagaagctctctcttttggagggggtcagccaggaccaaggcagcagttaactggcctccaaccaactttcatgaggctggccttattaaactaggtctgaagaaaaactgagtcaaccatttacagacttattatcttctttctaaaggaaaatcataatgccttgccaaaacaaatgtaataacttggccttttctttcaattacctctgctttcttggaaatgtgtatctgtggataaaacctctgagttaacccagggaattaaccagatgtttaagaagaccctgtgattcctgtgggccagcaaagaaagaataccccttggccacattatgagaatggagtactaaggagaaagggggagcagaaaattaaacttgaaggcccaggatttaaataggcatagcagatagaaatgttagctcagttttgggggattgggtgacactggaagcaggttttggaaatccaggcacaagctgtgtccttgaaaagacagtctcatatatttccagagcccttcatttcattttcttcagtctatattctacccccatcttcctattccacatcctcattacactcccatttcttcaacagctaccttcaggacctacgatgtatgctaaatccagggaacattcagagggcccactatctcgacaaatttcctattacaactctaagccatcttttgctgtatgcaataatttcctttggggagtgttggcatgtaatttctgaggttcagccctccctagcatggcccagaaacactgccaatatttacaatggctggtgtaggcagttcttatgtctcaggagttggggatcccttgttaaggaagtaataggccaatgatcagtaaccatgcagtgatatgagtgcatggtttggggaaggggtggaagcaaaacgaaaaggtgggggggattgagctttcatcttctgctctatctgtgtagaatcagtttcaccacactcatccctttgtttcccatagaaatggaaaggacaatgggaggaaggtagcattaagcttaagaatatggcttaggattcaatcaaggactgtgggcttgagtcttagccctctcatttactatctctgcactcttatttactatctctgcaacctcaaaaaaggttcttaaatgagcctcagattcatgtgaaaattgaagaaagtaaagtatttacttctttgggttgatgtgatcattaagtgaatctttacatgtgaaacgctttccatagtcccccagtcttccaatatgattactgcttttgctcccctacaagatttagtcagggatagaatgtggggggtggggggaagaggtggtagtaagaggctatagaaatttagtatttttatattataaattatacatcattattttctttaatttagcaatccttttagattcatcattttatgagaagaaaacttagaaaacactaaagtttgagatcattaagtttgagaattggcatgtctcaagctcctcctctccttcccacatccccatacgggcactttctctagaactgtgcagagctggcacatttattaggccaccatcacaacccttcagagaaaaagtaagacctaaatgaaatagtcgtgatcatttcgtgtcttgatgctccctgtgtctcattacctctcagggtctctatcaaaatcaagggctgcaaatctttcaatagagaaatctattagcatattttccaaagaacaaaatgtacctattcctgctgtcagggctgctgtttgtaggagtctctggtttaaaaggccctcgttattatgcatgggtgtgcatacaaacaaaacttctccgcatgggaaaagaattttcagctttcagtaagaggctcttttctcaattcctccaccatcactaccaacctacaccctctaaaaacctctccaacctccactgattctttctttcctctcctttgaaaaagtccggacttactgtataactacatatatgttaaaatcaccaactagagaaaataaaattgagtaatattcttgcaagtagcagaatctcaaacatttgatggttaacttggctgctttagtcaattggatgattcatacaattatggggactggttagaacttgaatggaattggttggactggcacaggcaaacttctcaagacatgtcctcccctcagccttggcaaggcactttttgggtctgtacagctggactccatttcatttatcatcacatttaatattttcttccttttgatgttacctgattataaaaatgagaaatcagttttagtgctattctcatgtttccctgcattcagatttttattcaggcctaaaagtcaaggttttggggaaagtgggaggatcacctaaagttgataatctaggctctgatgtccgattgactggagttcaatcccagctttgaccacgagtagctaggtaatcttgtgcagttttactagatctttctgcacctcagttcccttacatgtaaaaggggtacaaaaataccaatttgccaaggttttgtacagatgaaattagacaggctttggcacatattgcacattcaatacatgttaaacattttatcattttattaatatatctatttcaagatgaaatattaatataattagttgatggtataattagtaggggttctaatttcatacattctcgaattcccaataaataagtgaaaattatcttgatgctagaaaactacatcctaggaaatcttttgttgtaaacttagatgacgaggggctcttttctacccacagctcccctagtttactcaagctccatgtctcctctttaccaaccccgtgtcggcatgtagccccatcctgagcacacagtacaccctaatagatattttgcaaatcaggcaagtagcacacaggagttttaaggacctttatataatttcaacaaattcaaaattctaaatctccatagaaacacctttatgaggaatataaggtaagaaatatttctgcagtttatatggatttaaacattttaaggtcaaatcattgtaaaatgtcatgtaggaagggaaggcctgaagtctcaatctgggtttcaggcagggaacctgaaaacctcacaaagccacacataacactattagctcaaggaaatgtttctcactgtaacaggaaaagggaaagttcgaatagaagtctagacaggttgtactgaaagaacaatcagatgaaagagcaattcaagccgggcatcttgtgcctgtaatcccagcactttgggaggccgaggcaggtggatctcctgaggccaggagtttgagaccagcccggccaacccggtgaaaccccgcctggccaacctggtgaaaccccgtctctactaaaaatacaacaattagctgggcgtggtagcaggtgcctgtaatcccagctatcgggaggctgaggcaggagaatcacttgaacccgggaggcggaggttgcagtgagccattgcacttcagcctggctgacagaacgagactccgtcacaaaaaaaaaaaaaaaaaaaagagcaattagagattgttagcatgagcatgattacactgcaagaaccaaatagttaagttttttttaagtcaaatattgtaatttcaattactcttttaaaaaagagtaattgaaaactctttttaagagtttacaaaagagtaaattaaaaacatgctcttttaaaaaagattaatttataaggttgcacagtactcctacaaaccacattagatacttctagtagttaacaaagaggaaaacaatgacattttacaaaataaaaagcagaattgaatacagaaaaatatgacttaacatcaaccaaaaaccaattgattaatcttgtcaagattcttgtcaagattctcaccagacacccaaatactgaaggattacaactattgcatcattaagatatattaaaagaaatgcaacaagcttaaaatctaataaattggagagtaaacacatatactctgcataactgtaatttaatttcttaaaattctgcaacttccaaataaacaacagcagcagaaacaaaagctcacataaatgggtcacagtaaagaccagttgcctccacttaaacaatactagcacaatcgtgtgggctacatccttgaaagaagtagataatccatgcacaatttgagaaaattgattacatatgtgtgtatgttatatcttatacagtatacattacatcctcaacattaaaaatttaaaaaggccactcacataagttaccttttggaagaaacaatgatcttttctaaagaaataataattggtgatttgttgatacttacagtttatgtttggaatagtctcatttatgggtatgctgaaaacaatgcaacaattttctattaatccagttctgatcttcatactcttagcagttttagaagagctgagaacagtgacctgctttttcaaccattatatttctgagacatgactaatttgaagctgagcaaattgcacataatgggattcaagttcatgatttttagtctgcactctcttttcagggtacatggtctccttccctccctgcttctaccaccacccccaaagctgccttttcaggagctaaattcacccaacatgaaatcaaaagagaattatttttaagttttctgcaggcttatttttaaggaggataaagttatatttttaaaaatatttatcttttccttcaggtactaccgcatttttaaataatttctaaatatttagaatgtatttagatgtatttagaatagtagatgtatcagatgtatggtttcatagtggctcaaagtttttaaaaaagcattatataaatcagtgaatttataaataccctaagttctactatgtaagatgttgctttcagagcctttttgcaaaatcccattaaaggtttagcttacagacactggtgccaaaaaaaaaaaaaaaaaaaaaaaaaaaagcaagcaaaaaaatgtgtttttttttgtttttttttttttttggtaagaaggatgttgaaataggagaatatttaagctggctaaaccaaagccaattcctggaggctagttgcttttatagtgaatgtttaaattttctccatcaaatctagaaggctacaacgaaacaacagcctaaatgtcatgtacaattctctaagtactgaaagagttacacaattttagaaccgaaagggaccttaaactccttcctctaccaatgaggagcctgaagcctgctagttaactcacttgcctggtcactctggggttcacggattgttattgtttggtggggtggttgtttttgtgctgtatatttgtgtgtgtggtgtatgcagtactcacacccttacaaacaagagctttgccatttatattctccccttcctaagttgctcttcctaagtttactttcatcagcaaaaagagtgatcaaaaagaaaaatatattctggccagttcaaaggggacatttctttttctcacttggcctactgcagatatattagagagacacttcacacccaggacaactgactttttaagtggcaataacaatgagcagcggaggagttctcttctcactcgagagagcagaggaggtttctgaactttaccttgacttccagcctacaaactgttccttcaactactgtctccgcttgcccactttgttgctattctttccttagtttcctttgttttccagcttagggaagtttggtgggaaaatttttcacttacattttgttgatatttatttcccatatttgggtcctacccaaattttagatttaagagcaaaaaaaaattactgtttaagtgaaagaggaaaggctaagtcactgttcaacatgggctagatctgatctgaattggagacacagcctttgcaattgaggaaggagaggtaagcagtaaacttatacagtttcctccaagaagtgttatacatagatatttttcaaggaaattggaataaagcagtttattaattgaggggaagctagttacagttagcacctgccgcggactttttgaggttgtcgtcattaaccaaattcttcgggaaaaacaatctttggcaccacttactccagacaaaccctgtttggaacagacaagtgttctgaccctatagtcgctccaatgtccaccagccactcacgagtgcccttagggcttctccttggtggtagcatcccagaaatcctactagtttcagaagtgccctaggaagcctacttcttggataatgggctctgtctgcaaagctaggagatcagcctagaaaaagaaacacaccaacaaacaccaggaaactatgtgtaatggtttgctgcttgtgcaaaaacctcaaagaggatgaaggtcagacagggataataggccaatttaattctgaaagcacaaggtgcaagaaattttaattatggtctgccactgaaatcacacaagatccaatggcatctaactgcaactgctcatcaagggagacaagaggtgtaattgtaaccgctgcataatcactgtgagggcacagggaaggctgccttcagctcccagcagagaaggtattaagagcctcgaaaaatccaatacggggaaacgagattgcatgtagccaaacagaagctcctaacacaaaagccaacccgtgtgtgtgtgtgcgcgcgtgtgtgtgtgtgtgtgtgtgtgtgttgagggtgagggttccagaaagaaaatgtgaagctgtttggcccacactggggataagagattgtttgaaaactctgaacccttttctgttttgtggataaatgcacacagagaaaagagcactgtctcctttaggtatttctctccttgatgaagcttcacccactctcctttgtttaagacaattggcttggatgttaccgtgatttacagtaccaaactccctttaatttgttcccatcaaacccaagtctggagacaaaacgccaagcacacgactggaggtgcccaagcctgtgcagctctggcagcgacgccgccggcgcccccgggcgttttccccgcaccccacatcgcgtgggcgcccgtaaaggcacgcgcggagaaagcccctccgtggactccccactccgcaaagtttaacaaagccgtgaagtaaggaaaccgaacctcccgtccgcgcccgctgcaaagttggcattgaagtttgtgccgggatgtcccaaatcttgagggggcggggggcgcgagtgtgcagagaggcgggaggatggatgcagatggggagacagtgaggggaagggagtttttccgagtggacggtccgtgaggcggttttcttcacccggaagcctgtttgactcagagaggtccgggaggtgcacgccaggggaggtctcccggggcgggcgctgtcgccgaggaggccggcgagctgtcacctgcggggggctgtggtgggagctgagggcgctctcctaagcgccaaaagaggacggggacattcacagtcaccggctctcggggctctaagtagtgggggaagggatattcacgagtgggcaggaggccaaaagcaacacctttcggatacgcttttcccctccgacctctccaacttcccgcggcgctggtcaaggactccctcccaccccaccccatcccacccaacctcccggccgacaattcggacctgtccacggcagagcgtggggtggagtgcggcgggaaagcagagggcgcgaaggtcgggaccccaaattgcaaaccctcagcccctagcaaagacgaccaaatgcatttacaaccgtgcaagtatctcagccttgtaacagagctccgggtttgcgccgggcacagttccccgactcttctgttgttcctaataaagtcgattacgttgccctcccggagctgattggaagggaaccgagaggaaaagggggggaacgcgggaaaaagcgggggggggggggggcgagcaatcaactttgtaacccagcgcttcctcgcgcgatccgtcgccatgcttaagattcccacccccgccgcccccctcttgcctttcaagtggatactgaaactaggccaaaactttttcccctccttttctcttagccactagactggattgtgccccacggagccccatggagctctgctttcttaagcacaatagccggactaattagatcatagaagcaaggcagtgatactgtaacaagtagcccaagaggcaaagagggaaggggcccgaaaagacagaaagggggaaaagtttgcagctctccgcacttaccaatcaagcctcccaccagaaaggcgatgatttggaacacgagcagaatcccaccaacaatgcacagcttcttggtgctcatgttttctataattgccccagccatttttgcgccccccctttttcttttctccttgaaataaatgttttagggtgagctttttgctccctcctctcacacactccctccttcctcgcctcctttctgggcgctgcaaaacttcagaggtgctggagcgcggcgaggatgggaccgggacggaaggcgcccgcacggattcccccggcgcagccggctcgggttcccccaatgcccggagctgtgattgtggccgctccgccgcctgtggacgcttaaaggagcagggaagcggatcacatgacgccgcctccctccctttcttcctc

SEQ ID NO: 2465 - DNA, 134089 bp, Homo sapiens
gtaagagaagtaagacaatactcaaagaatatttattgttgacgcttttttccttatatttaacattttgagataaaggctaaatgagtgtatttgtgtgcgtatacaagtacaatcaatgtgactgtgacaactgcaaatgcaaagctgataaacatgtgttgccttgttgactcaaataccagaagctgcgttgtcattgatgaaggaatatttcgaagcgctgaacaattcttgataaagttccgaaacaaacaaagcacaatcttccctcgatttacatgggagttgcattcctggaaaattcagtatattttaaaaccatgcaaaatatccttttaaaaaaatatgtaacatggagtttaggaccaaggctcaggtaactataaaaatttttacctacataaatttctagtggagtgtttgaaatttgtttaggactgtgtccttcattgtgggacatttgcagatttctcccttgcccactaaatctcaatagcacctcctccctcaattattgtgacaatcagttcctccacattcaacaaattttccaacacctcccgagcagcactgccatccttgttgagaacgtgtatctagttcatcttaagatagaactgcccccctcatccccactttctctcccaaatcctgtgaaagcccagcacaggcactgggggatacagcaagccacttaggaggattcccagcttgtgtcattgaatcatctttaaatttatttttatttttttttatatgtcttatcatcttccaaaaaggatgttttggtgaactgcaaagagatatactcagagacaggaaaaagatctggtagggtgaagaatgaaagaaaaacaggcaggcagaataaagctgaaagctgagcctagtatctaaaacgcacactcccagggcttgtatactcaataaagttgagaagtaactgggttgtcaatttaaagaggaatacttgatcagacacacaattctatgttgataagattaaaaacaagctctagtcatccttccgtacctgtaggagattggctgtaggacctttgtggatgccaaactctgcagatactcaagtcccttatgtaaaatggcataagggaccatttgcatgcaacctatgcccctcctcccatatactttaaataatctttagattacctataatacctaatacaatataaaggctatggaaatagttgttatactatattttttcatttgtgtcatttttattgttatttttaattttttagaatatttccaatccatggttgggtgcggaacctgcggatacagaggactgactataatatcaaggtaaggacatggattctggacccagactgcatacattcaacttggcttcacttttacaaactgtaggaccttgagcaaatcaccacatgcttctgtcttgttacctataacaggataatatcactacctacaataccacacaagtctattgtgaggattagataaattggtgcacataaagttcttaggagagtatacagtagttacttgtaagcactatataaacatttgccaaataagcagaaaaagttctcagagaaaacagtttttaccagcagtttttctcactaatagatgtggaattgaattacctagattgaaaactcagaggaaacttgacattcatcaattctaatctgtttgtgttacagtgcaggaaactgcagccagacactgaaagtctaggggccaagctcacatattagttgaggatccacaagttagttgaggatcctggtcccctggttcttttctgctgctcttgccaatatctcggcctggagctggcctgtggaggggtgcagagaagcagcctattgtctctccttcccagagtgtccacaggttccaaaattctaccttctcccaactgttctataacaccccaaactctcatttcttcctaaaggacagagagcaaagaataaatcaggtgtgaatgacccctaaactcaaaccctcaaggaatatgcaaacacatagtagagttcctttaaatatagtaaatcttcaactttgaggaagagggcgaatgggtaggtgggaggcaaaggttttaaatttagaaattaaaattgaattgtctaaactggcaaaagtctcaccactttccagttgtgagactgcacacaaagttacttgagagtctccaagcctcatttttctcttctgtaatgtcaaaacagagatcataaggctgtcggaatggactctttgtggcaataagataccatattataaacaggacccaaggtcatgccaggtaagaatgaagtcacacacccttcctcttaaggaataaactatattgtaactgcctcaaggttttttctttcactctagcagttaaacaagcactgataagtctccagcccaccatgaacatgggacacatgcaacatgcatgtttgctttactatgtatgcgagcatcccccacttcctaaatatttattgccccctgtaacctgctgaatatgtaaacataaacgtggccaaaccgttcagcataaattcctgctttacccctctctcccttgaagtgcctgcttttggtgtctgctggaggctatgcttcccagcctatcaggatggccacctgcaggctgtaaccttttgttagaagtaaagctctcctctccaagtttctgaaccttgtgattcttcagttaacagtaacatggggatgataataatcaacacctcatgggttgttgtgaagaagaaatgaaataatacaaagcacctagcaccatgcctggcagagaggggccaataaatgttcatcatatttgctattattattattattattataggcatcagcaacctatcagaagagaaatagttttcctttgctctttgaagaaaggaggccgccccagaaaggctttattcgtgtcctcttactccatgaacttagttaccttgtagaggggaacgggaatgtctggaaagaaagaacctgaagctcagtcccgataggatcacatgaagcgtcacaaagacagaagggttgcagggctgaatccaattcaaccactcactctagtgtgttcctgagagtgctgtcttctctctctgacccttaaacaaatatgtctacgttcactgtccagaatataatataagacagggcttggtattattaagatgctgcttactaaatgaggaactctgagatattgcacaagaaatctagaaacttcatgaattgggggtgagtctcccaatggtgaaagttcaggaagactggctgcaaggggctttgcaaaatacacgcttataaacacactttctcttcctttaacaaggaaaatgataaaacttcatagttacagcgagaaatactgggaaacaaaaaatacgctcttaaaatttcaataacttcatatattcattctacttagctgttacgggagagaaatcaaatatcttactgttgattttcattttccaagggactttgaactatgtgtgtaggtggcagtaaataccttcgttatagctgctgggagctgcagactctgcacacacaggtgaaggtggttagacttgtgtttcctgggaagcaagggcaagtaaggagtgtctaccatgggccagctatatgcctttggtattccattcaacaccctcctccctgtgttagaggaaacatttctcctcctgcattcttcccagcctgtaacaggactttctgtcctctgggggattgggaagttatttcctgccccttcctctttttacttcttcccaagggaaagaatgacttctcttcttagggaggttggagaagggtcctaaacagcgggctctcttgtttaggctgactgtgagacaattttttcattgcttctgctttcctatggggagaaccgttgaatcgtagcctgggatctggaggttgatgtctctcttcttgctctccagaattcattgatttgaggcatgcatctgacctccatgtttctgcaccacagactcaattctcctcatgtgcaggtccagacccagctggggttgtatcattttgaaggtcatctgattgcaggtccactttaagggctcctactcaacaaccaataaaggtcctatattcatctgtatttgctgaaatatgactatttctcaattggttcagaatcagagaagctctactacccagaagagttggaacgggccttgaaatgtaacccaagcatcttattatacaggtaaaaagccaaaaatcatatgcccctcttgccagctgaccttcccagaccccacccaggtctggccacataataatgtgcattgcccaaggtggcttgattgcctggtctggcagctggaggagtgggccctgcacctgacctcactgtgtcttggctttgtccaagtagaccccttgccttcgattgttttgtgcctaatgttttcactcatttagaaacacctgcatctttcttcccctggcagtgctctgaacccttttttttgccgggggcactgtcaccagtgtcttgagatatgttcctgttctgtatctgaccccagtggaccggaacctgcacgtaggtctgctgcctccctgcctagcgctctttctgctcccaccagggtgcatacctctgtgaattacatggctggacttctcttaacatcagactctattaactagaacaatagttttatctcatcctgtgattcaaagacggttgctagggaaaccagtggggatatgtttaatctgtaaatcctgtaattgccctaaagtagcaacaattcatgtgcttgcttcaaaaggatttggactgaactgactgggaagcaggtgagtgaagaagaacaatcacaggttggctccccttgtgatctgttcacattcctcataaggtgttttttcctgctgctttgccaaaaagctaaagggattaaagagggagcactgcggtgcccttctaatggaccaggaaagctagaaagacaaaattatgcagttcttctcttcttatggattcaagtggtcagagctgagtgattggaggctgtactggtggtgatggagagagataagaggataaatactccattttattttaaaatggattcagaatcctataattgtagtttgtagggggatactaactccaaatgaggagaagcaaggtatttgggaagtcttatcagaagaggccagggtggtctaagcataggagcacagagtcgggtttggaggcgtgcccagcatcatccccgccaagcctttccttaatccacagcagtattcagtgggtcacccacatgctgcttgggcactgccaaaaatggagaacttgctccttcccagagcagctcattttgtgtttaaacagccctgattgttagaagatctgccttaaattgaactgaaacatggggtgctgggggcaggggacaattttcctccttgacttggctgtctggcggagctcacagaggtttcttcataagacatgccctacctctgtcacagggcccacacccagcaagccacactggctcaagggcccagaactatccagaccgttgaagagtcccaccttgaggcacaggacagaagcagtagggagaaaactaaacattccttgatgtagtgtttgattaagaataaaatgcacagcttctgtctctcggggccctgcaatgtttgtgatttaaaaaaaaaagcaaaatctaagtgcagaccctgtttcccaggagaaaagtcacacgaaactcttctttatacaaaatggttctgagaatcatcactaccattatcggtggagatgactcagtattctagacttagctagttatgcaaagtccagggaggtcattgtgctctcttttggaaacataatagttccattaatgcagctgaatatcacatttgctctgagcagctgcatcccactgctgactcatgttgagctctacaatcagtgaaaacttggagggtatttctcctttgtaggtgcaatatcatatgatccctcctaagcccagctctattgggactatgggtgtccagggtccctcctagctccttgcctgcttttgctgtcaagtttgtgagttcaccttctgtattttaaaattcaggattgcagcctggtgcgatggcttgcacctataatcccagcactttgggatgctgaggcagaaggatctcttgagcccaggagtttgatcaagaccagccagggaaacatagggagacctcatctctactaaaaataatttttaaaaaagtagccaggtgtggtggtgcatgcctgtagccccagctactcaggaagctgaggtgggaggatggcttgaacctgggaggccaaggatgcaggtagccatgatcgtgcctctgcactacaacctgggcaaaaaagcaagacacctgtctcagtaaaataaaatttaggattgcagggattgcaccctcctgtctctggttctttgttacctatcctgatctgtgaagtcttaggcagtcactgcctgtgcatagttgatgtatctatgtggtcccattctcttcagctctaatttatccagaccagcatgtttaataaggttagatgtctgatctaccctttattaatgtctattctcttttccaattcattgacagaaaagttggaggaaagccaggagccagggagttttgctttctttgatctgttgaagcagcataagtagtttacctaagagtatactgcccttgtgagaggtaacaatgcaagattttggaaaaagacatctaacctgagtgcttatactttgcataacccttttgcattgtttagtactactggtttttatgctacttaattgttttaaaacagggatttataaaaatagacacaatttgctaaattctcattcagttcagtcactcttaatggaaagtctagttttatatgccacaaagccataaccaaggtgccacctcattgtagaaaaagaatccagaaagaaagaaatggttttgagtagcaactttgaaaattccaaactatgaaacaaaggcagaaatcactgttacaaggtccttggctttccaggaagtccaaaacccaaatgaaaaaggcatcttgattttctctctgaactctgctcaaggtttactaagaaactacctaccacgtataaatgggaaacacacaaaagatgtatttcttggaaggtgaggggtgttagtgattttggcctcacattaagggagccagaacctgcctgaactgctagaaataaggggtggaaagacaggactgggttctggggctgcatccagggaaaacatgtcagtaccgtacacctaacaccagatgagtggacagagacatgtcaggagaaaagaggaaaaaggaatgccccgggctccaaaaagaaaaggatatgggattggtgtaagggtctgagggatgagagaaaagaaaagatggtgatacataatcacttctcttttttccttcagaatgatgacctaaaactaaacattggtcactgcaatcaaagtgttaatatgaaaaatcaagtacctcgctctgaaatttcagaatttcttggtggggagttaggactaggaagaatcacagccaaaaacaactaacagtaactcccatagcaatgctctatatttaagatgtagatacatccataatatatatactctggagtggtttattaaaaggcacttcgagccattcataaagaaataaatgatagtgcaaggcagccggactcaatggccaggaggggagttagcagtgagtgctcttgaggagatgccgaggctgggtgggcagagggtacttcgaggggggcctaagggagccctcagtgggcctgggtgatgatgtcctcagaatttcccagtgtgtgtgacctctgcagcttgagtgttcctaagggaagtttggaggataaagacagcatctctgggacaccagaccagtgtccttcaggtctgggagccccacagagcaacagctgggaaagtatacggttattggaggcaaaacaatcaaaattccattccagaaacgtgtcccttgcaaacctaggtacctgctgctcactgttcaatggtggcagacatttcagtgtaggcagctcagtgcttctcatgcatagacagactgcttcccacttccccacccaaggggcacctggaaacgcgtgtgcatgtgtttgtcactgtgtgtgtgtgtgtgtgtgtgtgtgtgtgtgtgtatgtgtgggtaggtgggtgggtgagtatagaggctactggtatgcagtgtccaggacaagagatgcttaatgtcctgcaacacgagatcagttcctcagagcaaatatggaccccattataaaacaatgtgctttggacactgtcaagaggaaattcccttaaaagaactaaatgtataccttactgaaaccaactaagtcggtatgcatttgaacgtgtatattccaatgttttctgcttttaaatttaaaagctcttaaagttagaaaatacagattagcataaagaaaatgatcaaaataatcctcattcctactatttaagtaattaatatgttggtatcgattaatgtgtctttccatttatttatgaaaataagacaaaattatgcatactatatttttagtcagctctttttaattactatattgtgaatcttcattgacttaaatagatccttttgtatataatttttagttgctgcctcatactgtattttatgtctgtaccattgttgaactatcctccattgttgaatagctagattttttttttttgctattaacacaatgtggcaatttatctttgaacggttttttattgtcagagagcaaaaggatgtttaacagctggaaggtaggaggatagatagagtgacaagagtttaggttctgcaatgagaagacattgcttcaagtcccaactctgccacttactagccatgtgaccttaagccattcagctcaacctctttgcctcagtatcctcatctgcaatatgagaataacaatacttacctggcaggatagcacaggagattaactgaagaaatacatgtgaaagtacctttcaactgtacctcactctgagagagaagggggaaaaaaacatgatcttccatttactgtgaatctctcatatgccaggcactttcctgcgttttacgtgctttattgcatttgatcctcatggcaaacctgtaaggcaggggctatttttttattacccacatgttacacagaagggaaatgagacatgtggataatctaccccatcatgggcacaacggtagaagcggcagcacagagattcagacccgggtctgcgggacacaccccaggctctgaggtggatacaatgcagaagagaagcacactccccagtgtggcaggaggccagttctagagccttccagacccagctccccgggagatgaatcaccagctagggacaatcccgaggccaaaaagctcatgatagcctgctcacagtcttgaatcaataggtcttttattagtctttaaaatggggaccacaatctttatatgtatacaatattcgtgcattccagagctctttcccatccattctctcactgttctgacaatagctctgtgctgtgggtggggcaggaatcggcttgtgaagcatcatcctatatgttaggacagggaagactggaactctggatgcctggtcccaaatcatttgaaatttgaataatcccagcttattggaaaaggaatcctgtcttttctacttggtatctgtgtagctttgggtaactcatttcatttctcagattttcagtttcttcatctcttaaaagagaccaaaagcaggaataatgtttatgtcaaggattgtcctaaaatccaaatgaagtcatggaggatattaaaaatgcctaccactgtgtccctcccacctctaaggcagtgtacccactccagccacccagcccatagtgtgctatggtctacaccagatgcccccttcccactccactgtgggtgattggactgaggtgggcaatgagctcaaagagtagttcactggccttaaaggaattcatcaaatactgaactgaatcaccttgattcttttgagattttttttcactgataattgaatttttaattctacttagttttaattaattttaatttaatagccacatggagctaatggtgaccataatgtacagctcaaggctataagtttattatctggggaaagtaaaacagaagtcaaagaacattaaaaaattgagagcttttcttatggggaaaattggcacactaaagataccacggacccagagaaaggccaaaaaatatatatatgagggaaagaaatggtaatgcctggaggggcccgtgttagtagaattcaatatgaaagtattaaagagcacttctggtactataaggaatgaaatattatgaaatgcttagtgctataaaataaagacaacctgacaaagtatacttttaattttattcctgggcttgcaagaagttatgtaccacttatgcactaccaccttcacccccaacaaagacctgaacacacagcaataagtgctaagcataggtgaaaggcagggttgccctgctggcaaatgctgatgttaaaactgcaatcaaaagccagctaacaagatagagagattaagcctagggtcccagcagtgggctaaagtttctataggtgggtaaccctctggctctcaacaaaaacaaatctctctggagaaaagcttcctcaatttgggtccttagatttccgtggattaagcaacaatatatgagcactcaataaaatatgatcaatgaaatataatcaaacacacaagaaagcaaaccactataagcaagaggtagaagagatgaggtatgccagacttctacttctaagaactttaaatgttggaatgagaatatttgaaatgtataataattacaaaattcattcaaaaaatatgaagtcacagaaataggcatgcaatgctagactataaaaagtgaaatggtagatttgaaaaagacttaaacataacttttagaaatgaaaaatgttattaaaacagcagaggaaagaattagtgaagtggaaaatagagttgaagaaattaaacagaatatagcacaggaaaaaaagattataaataagaaagaaggatcaataatcattataggttccaagtaaagataatatattgaacacatacagctcattttactaccttctccaaacttattaaaactacagcaaagggattttaaacaatcatataaacccacaagaatgggcaaaatatgagatgagataccagcaacaaacttctggaaaatggaatataaatgaagaattgataacaatgttaccagagctaagaaaaccaaatcctaaactgatggtggggaaatcattgaatcaactgaatttgcactggaacacaacacaaaaagtaaaaaaaaaaaaaaaaaaaaaaaaaaaatacagtaagaggcataaattagtaggaattaaagataaaatagaagaactaccaaatcaaaaattctttaaaaagactattagattaatctttagtaagattgagaaaagtgaaggtataaatatgtatgaacaaaggaatatatctacagataggcaaaattaaattttaaaaagatttttaaaaaatttaatttaaaattaagttgaaaaaatattttaagtgccaaaagagatagcaagaataatctacactactttatgtctatacattggaaacaatttaaaatgcccagaaaaatataacttgtgaaaccaattgaagaaatggaaaacctaaatagccttataatcattaaataaattaaaatggtagtctaaaatttttctgcaaagaaaataaaagtctcaataatttcagtgacatattattattgcattaaataaaaaaccaaatgtccaagaagagccaagacattctgaggacaaacaggatgaaggaatgtgcttttctagattgcaagccttattaaaaagctaaagtaattaaaacagtatggttttgaggtaaggataatcaaattagccagtggaacagactaagaagcccccaaaaatctctgtctctctctctctctctctctctctctctctctccatatatatatgtgtgtgtatgtgtatgtatatatatgtttgtatatatatgtgtgtatatatatatatatttgctcgataaaggatattgtgttgtagatcatgagtggcttattcaataaatggtgctgagagcattagttatccatataggaaaaaaattaaagaggctccttattctcttacatacaaaaattaatttttgatggaacagaatcttaaatatggaaggcaaagtcttaaaactttttgaagaaatttagaatatttttataatcttgaaatttatttaaagaatttttttgaaagacacaagtacccattaaaaaagaaaacattggtaaatcaactacacaaatcatcaaagataccataaatgaaaacataaggaattcatatctagattaatcttgaccgtggtcttaagacttccagcctcctgaatagtaggaagtaaatgtctgttgtttaagccactccatctatagtatttttgttatagtagcctgagctaagacagctttatataagcctttggggaccatagatgaactacatcacttggttctagcatgttctgtggtttcaatgcagaaacctagagaataactaaggctgggagaaagaaggaccacactggtgggagaagctggtgacaagtggtaaggagtgggcaacctgggtactaattcttgttttttcttccccagccttgtggtcttggccaaatcaccgggcctgctgtcttttctgtagagagaagggctgctcggttctcatttggattcaacctttccaatgcagcatttaaacacggaggagggatttttttggttgtcacaaggactgggggaccctgctggctaaatatcctccaatgtgtgagacagttgcaccctaaatgccagtgtgcccctattgagaaacatcctctctataacagtcctttgaacgagccctttacatctctctacacatacatgatgtttgctggtgggtcgggaaacatttggatactttatgaagcatgcaggtctccacccaaacccacaggtcagatggctgctgtccaaactttaggatctttagggctgcagatgagatgctctgttctggtgtatgtcctgcttggggggctgcccctccttgccagaagaagatttagttgaattcaattgaagtgtactattaccaaccatttgctcccttgttctgacagccagcaggagcagaaaactggcttgctctggtactaactgcattctcagaaccgtgcatgcagtgctttatcgttctgttcaaagctaagcagtgccctccttgggacactctgggaatgtacagtattcattgctctaagaaaatgccttggccacaaggagaaaacattcgctggctgtggcttgagccaactgggtcagcgccagcctgtgcagatgtctttgtggacagagaagaagtccctctgggagaaggcagcccatgctagggtgcatagattgatgagaggagtgacaactgtatttctgtccttacttgctctcctggccaggtgctcttatgcagtgcactagctgtacaacagtacctactggctggaccctctcattctctaccaattcagcagtctcctcttggcttcattcaggaggctgtctccccatggttgcctgaacccaaaagcaaaatgtgtgggtcccacctacttctcacgctctagttctaaagaatgggcccaggtgtccagcctccacggcctgacattcaatgctgtgtacactccggttccaagttgcttttctactcactgcaccccagactctctgctaaacaggctactttagtcattgccacccaaataatgcttgtgaagttgcatctccacactctcatactcttcccttaccctcaccttttatccaactctttcaaggctcggctcattttcagtcttctgggaagccctctcaattgcccccaatcaggagttactgaaaagtgtccttgtacctcccattggtcaccgactgcacggttcatgtattgggaaccttgattgttaagaagattttaagttccttgaaggtggaaacctaatgagaagacttgcccttcaggctcctctacttaagaatcattccaagcaattaccatggaaacaaatatcttctcttcctggcctcttggaccaaaacaaacagacaaactgttaaagagcaaggaatttggctccctgcctaggttggcagtgagagcgtcagaacaaggttgaggccaaatccatgaacctcatttagttagctgcccacgaacttggcttggaacgccttggccccatcttaaagaaagcccttcattctggggacgctggtcagcctgaggcccatgctccttagtcccaccacaggaagccttctctctccatctgtcactctgagaccatattggctgaagctctgggcttactcatatcctgagtcatccaacctcgcatgtccgtaaaaatatccgtatccttataggtggaggccttatagataggttgttgagtcagatttatgagtttgagaaagagatgctttggatgcaaaggacctttggtgagtttgcagaagccctggactcaaatctaccaccactcagaacagtgaatgccagaaaattcctggaaaagggcatctctttgctgaatgaccctagtaatctactcattccccaggtaattactgagccactctgtgttccaggcacagttctagtttctggaaatatacctgagaacaaaacagacagaaattctgcccttatgagcctccacttcagctcctggccaagtctgtttttcatatgatccaagcactttggcaggtgttagggctgtaaaagggatggcatgggacccccttgggtaggggacgtggcagacacatctcttagaaatattgccgcaagcctcactgttcaagtctggtgtgtggagcagctgcatcagcacctccagggagcatgttagaaatgcatcgtctcaggcccttcccaagcccttctgagtaagaaactgcactttacaatatgctcccaggtgaactgtccgcagggaaaggcttgaaaagccttgctacaggacagcaaatcccacaagctgtcctacagtgaaagggagcagaacgataatgtgcatttgagaaagagtacatcccatgcctcagatttagaaaggtggcgtgttcaagactgagatctcctcagaaagaaacatgcttaaaaatccaatgctactcaactgtatttgatggctcaacaacaaatcaccgactgtaatcactcaacagaaccagcatcctgtgaaacacaccttgagaaaccagtagtggaccttctggcattcccggattcaactttcttggcttcaatgactgcagatggagtgagcccatggggtgataactggcagttttgctgaggaacaaatctgaatcatgcctactgccaggctgaggctctgggccaaggtctcagcttgggatagggtgaggatcagaaggctggaaagatagagggactcggagactgccagctactggttaacttgtggcataaggaggatatatacagaaaacactggattctatagctgaaatatgtcatttggagaaatttaggagccaatataagcattccttatttgtcatttcatgggctatatatattccacaggtgtcaagaatctataatgatgatgatgatggcaaagacaatgatagatacctttttaaaacttactatatgccaagcactgtcctaattcatatgttcccaacagcaatgctaagtggtataatcctcatttctgcagatgaagaaattgaggcacagagctggctcctcgttttaatccgtttcatgctaaatgtgacttctgagacctaggtgacaggcatctgactggtgcagactaaactggccagatgatggagtgaccactggtcccctttatccctcgagccagcccctgaaggctgagagacttgctcagagccccgtcccagaagtgggcaagattcatatttgtgccttagcaaaactgccagttatcatactatgggcttattccttctggaatagggtaaagcaagaacagagaaccccctctgggggtgccacttaggtgtgaagcagccctaattgggcaggtataggctggagtgacctcagtggtaggcctgggaggggacacctggtttgctctggggcagtcgtagaaggctcagcacagtgctggactgcaggtaggactaagcttggattataaggcctgggatcttctcataatgctggtctgcagccactgtgtggcctgtgacaggcctttccctgggtctcagtctttgaaaataatgatacaccccccaccacacccggtcatgggttgcaccttgggtttcaactcaatgactgcttttcaggaggtccctctggggctccttagggttatggctgctccaggctggcaaatccagatcatgcaagaggtggcttaaccctctccctctcagggacacgaagaagatctgttgcttccagattgcaccaacacacatgcctagaaccccagtaatgaagctggaacctctgctgtgtggtcagacaaacccaaggataaattgcccctgcttcttgggatgacactaggaattcgccattcttcacgaggcagtccctggggcctagagccaattcattcagtttaacattccctccctttgagacaaagtatagggtggtgataatgaagtcagtcgggcacagccttgagtgctggctgtgtgacacagggcaagtcactcaacctctctgagctccagcatgctcattggtaattggtataaatgaaagtacctatatcatgggactactgtgaggtgccagcacattatcagtgctttgtaaagagccgctattactcttgttgttgcttggacatttgttatgaggggggaatactttttaaaatttgctttttaaaaacatcaacaaatttctgaaggcattttcaaatgagactttaaaatatgtttttctcttcttataaagttaaaatttttgtatgaggttaggcataatttttttttgttttaaattaacaaatagcaatcaagggcttctaagcaattccaaggacccccttgctgctctattccactagtcttccaccctctccctcctggcagcagtcgttggcatttttgtatgtctcaccctggaggctggcaagctctgcacctcctggtcgggagcttccagctctcccctgcagctgtcctgaattcctcttgctgtaggttgtccctttgtcccagagcactcaccctaacagggaagtccctcatttcttcattaacttccaggttgctccctccccattaatgctgagctggagaagcagggttcacaggaccttacaatagggaccaggagcagcagctcggagattcaggccgcctttggcttccttgaccctcctgtacccagggccagcatcagggagggaggaagaggacagggacaacaatcagcagggcccgtgtaagcatacacttcttatggatgactcctctgacaaccacacggggtaaggccaggctcacggtcacacagtggctgagccagaagatcagtgtttttgcttttccatctaataatggctccgtctatacaaaattttgggcaggaagggcaatgcatctatcagaactcattggtgacaggcgcagcaggagctaaattggctgagttgaaccaggctgttacttcctagctgtgtgaccttagggaaatcacccaagctctctgtgccaacaattgtgcctacctcataggattcatttaaggattaaagaagttgataaatatcaagtgattaaaatcctacctggcacatccatagcagggattctacatgctagatattttaattgttgttaagcctcatgaaggcaggagtctttgtctatgttggttattggtctgtgttagaacagtgcctggtacttaataggggctctataaacagttgttgggtgaatgaatctatttctttcaagataaaaactcttttgcaatgcagccattgtttatcttggccagcagagggcagcaaatagctgtggactgattaattgtggacaagggtggttttaattttgaaggctaacagaactgtccctcctgagccagttagggaaataaaaggttgccatgaacctgtacgactggccccgacccctcccactcacctttgtgcaggttagaatgattgtcaggcattcaactcacaaaaaatcttggttccatttcttctcaacttactttcaatttccttcctccctccctccctctatccctgcttttcctcctttctccgttttctctaatcatatttccccctgcccccacactcactcctctgcatcaagctagtatactgtacacactcccaaactttatctgtacaattgcagcttgtactgcaaaccatgacatctagagtggatccttatacagtattcttcccaaccaatgaatgctgctaaacctagtataattttttaaacaacatgtaatttgataactagacccagagaggtactatagcttggccaagaacacacagcaattaggggtaacgttagagccctagccaaggccttctgctgtccattatacagcctcatcacacatgttctcttttgccaacaggaggctcgtgtggtccctgtttgtcatccagtcaatacggccatcagcttctggccccagacacctttcctctgcactgtggcacagaggagcagactgctttggagggcagcttcctgggagctccagggaccctggccaggcggccactgccactgacttcctcggctcactgagcccgtgcctgcagctctcgtgtttcctctgtgctgcagtggacgcttatcttcccccgatggcacatttctttgtcacagacaggaccctcactggcagtcggaggtgagttcccggggagcttctgggtcttgttggtgccttctggcaccacttgtggatgggatggctctgacacccaagcctcaccactgctccgggggtaacccaatgacatgatctccccagcttgctagatcctgtccttcccaattatgatccaaaaaatcatgctaggataactgtctggaaaaaatatttaattggtcttccagctgggaaacaaattctatatgaattgatgagaaaaaaaaaacagaatttttaaaactagaaaaaatgtgggtgacctattatcttaggggatatttctttaagcatgaaagcaaaactagaaactataaaagaaaaaatgtacaggttgactacatagaaaaaagctctatatcctggtaaacatccaaatcaaaataaaagctagtgacaaatggagaaaagttgagctacccgtgtaacagacaaaagataaatatactaaatcagactctcaagaaaatggataaagaatctgaactgacaacctaaaaatatcaagtcataggaacatgaaacatgctcagtgttactggtaatgaagtaaatgcaaaattcaatttctgcatcttgaagttgcaaatttcaaaactacgtagtgtcagtgaggatgcgggccacagcctctctcattctgctgttggcacagttctggagggctctgtatgcttacaggtgtccatgataaatgcttttctgtgtagccttcatcgctatcaccttactatctattgcctcctccctcccgccttcctttaccacaccaatatacttcacaatgatagggatattgtttactgatctgccccaaatgcttacaatagcacctggcccggctggttgtggtggctcacgcctgtaatcccaacactttgggaagccaagacgggcaaatcacaaggtcaggagttcgagaccagcctggccaacatggtgaaaccccatctctactaaaaatacaaaaaattagctgggcgtggtggcagatgcctgtaatcccaggctactcaggaggctaaggcaggagaatcactttgaacccaggaggtggagattgtagtgagccgagatcacgccactgcattccagcctgggtgacgagcaagactctgtctcaaaaaaaaaaaaaaaaaaaaaaaaaaagcacctggcccaatattagatgttcaacatatgcttattgaatgaataattgatctttaacccagtagttcttaggaattgatactaaggcaacaatcagtgatgtacaaaaaagatttatatccaaggatgctcatttcaacatatattgtaatagtcaaactttgcaaaccactgaaatgtccagtaaaaattatgaaccatcctttttagagactataatagtaaagtcatgaaaatcatgttatagaagacaacacaataacatagaaagatttcctagatatattttgaaaagggcaggttatataactgtccagaaatttattttctatgtataatacaatcttaatgtatataaatctacacatatatgcatggaaaaacttgtgtaagaacatactgacattttaacagtatttatctttggatagagtaattgtaaaatgtttacatgtttttctttactctttcatgtatttttgcagagtttctgtgataggaccattttgtttttgagactggattaaaaacaatgtagcagaggccatgggtgcctcacccatattcctcaagctggccctagttccaagtagctaagagcctggcggtggccctctacctacaaaggatgggagtggagtggctctctctcacagcttcctcagccccaggggacaactctgcagcatgttcctcacagcttgacagaggccctggccgtgcaccttggtggctgttctttgcattcccttcttctcagccttgcttctccatgccacctcagtgcttcctggaatcacctttcaagccagctacttgcacacaaatccttgtcccagagtctgcttttaggaggagcccaggctaaaaggcacaaacgctgttttaaaaatcctgcccactccgtgtaaagaacatcagccaagcatggtgctatagaaataactcctatcttggctgttcctgtgtgtagttcactttcaatctctcagcatccctgagttgaagagagatcttgcttaactgggagggaaggccaaggggtttctggatacaggagccaccttggggatcttagagcctcagaagaggcaaggatgtacgttataagaaggggctgtccagatgataaatgaaattaataaaccacccctgtgatgccagcacatggctcacagcagatctgcatcaggcgcctaccattgccctaggatgccattaacacctactcttccttatgaggcttagaatcagggctgctgaggacttcagaaatcatctcattcaggtggggtgaagggggtgggtagcttccctgagggtcccacagcaagagttagagacacagccaggaccagaacttactgaaaagcaataatccaaggtctgacttgggttctgaggatttgctcagttatagatgtcattctcgatttggcctgaagagggcagacacttgccattcatggaggtgaagagcttgtttttaaggctggactaacatctcccaataaggtcatttggttctagtgagagttgcagctcacaacattcttgactcttctgctgcaaatatgctactggaaagacactgaagttcacagactgaagttcctttagttccaactctggcactgtaataggtgaccttgcacaggtcacttcacctctctgagtctcacttcttgtgaagtaagatctctactccgtgactgagaaggtggtattggggagtgatatgtaacttacaaagttgcatattacaacacacatcactgctgttaagttctgtgtgtgtgtgtgtgtgtgtgtgcgcgcgcgcacatgtgcacactcgtgatggagagagcttgataaaggagagaggcctaggccaaaggagctttttctggcctcaggtgaatatatatttgtaaattctctagcaattggaaccaattcactttgtacttggaaaagacttaactgcttttactttatatttcgaactgtacttttttaaaagctaaagatgtcccttaacctaactggtgtatgggaaaaaatatacataacagggatatatgtaaagttctaccattaagtcaaaaatattgctgaatacagagaaggtattggtaatacaaatttttaaaactaagtatttagtggttgcttggtcatgagaagcaaaaaagtaagaagtgagtatttttaaaaatcctgtaccattttcctaggacatcaagccctagtacaggaagggacattttcacactaatctgtgccagctggagcagtcctgccatctgaacatcatattttggaaccctgagaagctaggatgcagttaacaggtaagtagtaatgggagaactttctagaaaccatgtctggaggaggggttcaggagctgagatgctgagcctggggtagggaagacttgagtggggcaggccctacaaaaaggggttccatcaatccaaataaggaaaagtcacaaaggaaaggtctggtctcaatagtgaagggcattgttccctgagagatcagtgtgttgtcacaggagacaggaagctctgaacacttcaagacatgcttagaaggccccccgatgtcagcagaaaaggggctgctaatgtcatctcagaaaccaagttatccccatgcaacaaaatcaatcacgtatcaaaacatgatggagagacagcctgcagaagtcagatggttcccggagcactacaggataaaaaggaccttgaaatacagaagacaaagtacaggctcatgaatgtctggacacaccagcaaattgagcctgaccaactgcactgacatcctgatgagtcagcttgaatcaagaagatgggtcccaaataactcagggtcacgcagcagagagagatggggattagtcaagtgtgttcactctctcaccgactcttcctgattgaattcccacactatgctaggcactttttagggagctgtgtatattttctttggaggcacagggttaggccattatctcttccaaggacagcagtttctctgtgaatttattccttgtccaccaaaaaccttctatttcctcttttagcctccatggttacctgaaaataggaaggaaggaagtctacgatgatggagccataagatatatgcattctttactgtaaaagatcacacagaaattctagtttatagattccccaatgttaccattcagcctttggaagcctgattcaatttgaaagagtagataaaatatagtttctagaactgacaaggtgaggatgagacccaagaccagggtgtggccactaccatgtgaacactgggaggtcctccaacctcccctgacatttctcttgaacttctcaaagttacctgcttggaccccaggggtatgagttccaagggcccgatcagctatgagattataggctgaactcaggcatcagaattgttagagctttatctcagttctgagaaatggttaaaaccacccttgggcagtcacacgtggaatcacttatttcattactatggacattttcttgtaggaacaatacatagtgaaaatccactgggataaccaacataaaactgattttgttttcagtttgatatagcaattgcattttatttgtttgttgtaagtattggtaaactttcttattttttaaaaacagacatctgtaaaattatatacttttttcctataatatcctttaaagctgcttgaaaaatgtttattatgacaatgtataaaactggtatacatggccaataataaattttttctctaggttgatggtccttactaaaagcattttctcacctcttgagtttccacttctctttccactgattgaaatgggttgcatccaacctgcattcttgaaatggagacttctttagtgaaactccaacacccactacacatcggtggagaaggcagaacagccaggggacatactgcaacccctctcctctggacctcaagtttctcctccactgtctatttgttatttctctcctgtctcaggatgaaagtgtcttttcactccttcgatgctaactcatcaacttgtactcttggtcccaaaactctgatttggcttgtggcttacattagctcctcaacatctttccttcatggctggatctcacccttcaggtttacaaacttagttcacttccctgcggactaaaaaacacaagtctccattttactctggctcttctcggagcaaccattttacctccttccttcccaccacaattgcccactgactctgctacacttctctgtctaccttctgcccttgccacttaagaaggttacacacatccaaaccaccaaatccaagagacttggatccttaaatgctgctgaacctctgaggacatctaacgttgtttctttcgtcttttttccttatgaatctggttctttctttgaaaccccacatttctctgatttatccaccttatcttcttcccctttcctatagaatatggccatgtctggctcaccactcttggtggtcatctgcttgatgttttactgctctgcccagttgtccttcttcctctcaatggtggtggctgcccaatctgctggacccctcagttctaattgttagctcatttcctcaaagagatggcttttaaaacctagcccaggcaaacccaaactcatcatcttgcccactgtgctagatcttttctgattgtttgcccaattcaaaatggattctccattctttggagatggacaccgatctataaggtaggccccaagcagccatttgacctgacttcctggtcacaggtgactggcacagggacagccacctgcctaagactcctgtttttaagtgagagaaacaagaactggataaagactcagtagtgaatggtactgctctgagagaaaggtgcatggattcctggtgctaggggcccttagagctgccccacttcccatcttcctggttaattcaactcttccatggatctctcatatatgctaggaaagttctagtacagtctgtctcttagctaagcttgctagagttggctcctacttagaaaactttaagtagtgaatccactgacatttgtcatccaagaatctctctctctgtccgaaaccccacccattcccttccccagcgagggcttgaaatttgactctgatcgatctttctgtgcaacccacatccagaacattcaaaccttgtgcattttatctccaaaataatcctctcctccaagtcctctgctactgtcctggttccagtctctgtgatctcttttctgggcttgtccagcctctccaggctccagtgatcattctgatcgtatcacttttctgcctaatatctgaggctaagtcttgtaactcttaccacagcattaaaaacccttctccatctggctcacaggtgcacagggctcatcatctgctatttccattcctatgtgccagccaggcctgatcgccgaccttatccaaacattgtccatgctttgcatctttcttctatgatttttgtactgctgatccctttgcccgttggctctggtaaaatctttctcctttaaggtctatctaaagtccttttcctaacccaggggatagagaaacgttccctctatcttctgggacaggagttccctgctggactgggaggcacggctccctttgattcctggcactgcagtggttgattggtaagtggatattgagtgcacaggatcgtacaccatcccaatgtccaccaggttaggaaaaggcctagagagaatagccaaagtcaaagcattttctactgtcactgcttaccacgctttaagccaaagtcaggaaaaggcaggctaggggtgctgagtggtgaattacatggactgtgccccagacctccagacctcagtgtctgaaaaacaagttactcatgaaactggttttagactccaggaaaaacacatttatgtggcttgctgttcataaaacacttccatatatatgaactgattgaaattttcactgtgaccccagtaagcagttaaagtttatcgatataagtgaggaaatagccaggtcagatgtaaatcacagaccttcaacaggaaacagtgttccttctctcggctatctccagtgcaagtgttaaaatacaacgaaaaaggctattggggaaagtctgaatagggcagaggacggctctgcttctaaagcacgtgatgttctccccacctttgttgtcacgcatatgagcatcccttgccagcctagggaggctaaccacacaggacagaaaatgtcactctttctccaggaataggtattatccccaaacactttgatttgatgataaagtatatcagtttttcagaaacctatttcccccatcaactccccacctctaggttcaacctggaaaataatctgcacgcatgtgtatgagttttagcaggaggggatatgcatgtacacatatgcatatacatacaggtttatttaaatgattggatctacacttttggaggctatttgaagtatcttatcaaaataaaacgcattttaagcaagaagttaaaaaagcttttcagacccgaaggccatttaatacagtaaatcttacttgggtagtttagcaaacattttttaaaacccacatccaacagattggttagtattagatacacagatttggtttcaaagctgaaatacccctggtggaataaatcttctcatgaaattcagttatattatgccacaaaacagggacacttatctattgacaacttaaatattaactcagtgggctacctggtgatataaataggaaaaaaacagtggtcatggattaggagtgagaagactatgacaccagcctaccttggactgggaccgcaaaggatgttaaaatctatcctagaatttaaaacaggaaaaatgtcaaatattccactccccattcggcccaaaccatcccccaaggaatacacccccaccccacccccacatgaggtttactaaccagctgctacagatgttactatgtcactaattaacaatgatcacagaaaatgtgtcataccagagtttttgttatcatacacaatgcattagtggctgcaggaatcttcctccaaaagctaccgtcagaaggcaaactgacaaatgtccatgccgctggtccaagaaaccacagctaagagccatgaggcattcatttgtacattgagctctctctggcatgctccccactctagttagaggggctggggtatggagagaccgtcccagccgggcgctgcagcctcctactcctgggcctccttgcgggtcaacttgtagatctcagtgggtccgtccacatgggtgatagtggtggtgagctggagttcttccccactatggacacccagatcgcctgaaacagggttttcggtgttagatgcattcaaggaggaaggagaagcaagctggggttcatctcatggacaactgccctgatgctagccctctttgacattctgagcacacagagacacctagggcacacaacattcagaacaaggactaactccaaacctgttcacttggactttgcagaactttttaaaataccatttttggctcctagatgacagtcattaagatacgtgagtcagctcactgctgatattattcatagtaatcattaacatttaatgagcatttactttgtgcctgacgctattctaatcactttgtaagtgatcttctttaatcctcgcagaagccctctgaagtaggcagtatgaacgtgccagccttacagatgaggaagctgggaggtaggcaaggtaattgtcctgggtggaggagcaggcccacaagagagctggcaaaggaacatctgatgccaagaccaatgtgatgggctaaaccagcataacacccctcccaacggatgggtcagtcaggcaccaacacatttgctatgaataatttacaaaataggagccaggtgcagtggctcaggcctgcaatctcagctactcgagaagcaggggtaggaggactgcttgtggccaggagtttaagatcagccttggcaacagagcgagaccctgactctaaaaaaaaaatttgttttaattacctgcgtgcagtaactcacacttgtaacctcagctactcaggaggctgaggcaggaggatcactggagcacaggaattctaggctgcagtgagctatgattgcaccactcactccagcctgggtgacagagtaagactttgactctaaaaaaataaaaaaataaactacaaagcatctatgtcacgtgaaagcaaataagacctgcttatatctatccatagattggggaaggagccatgtctaacacatctaggaacaatgaggggctttattctccaggaaaaaagaagtgccagaaacgtgctgtgcatttccttctgccctcaggattgtcctaagtgttctgaactcattatcagtggacagtgttctgctaaaatggaataatttgaacttttctaaattagtaggagaaaaaaattttctctaagttaaacctcgaaaactctgctacctgccataagacaagtgaatgtataaacaacaaagggaaaatggaaaacgcaaccacgctcagtctgactgtgtgtgggggtgcacgtgtgcacacatgtttgtggagaggggtgctggggaatagaaagttaaacttgtgtcagtgatttttatattgtgcacatatcatatgataagttttctggaactgaagtttttctaatttaaagcatagaattaagtaactaaatgctgttttccattgaaatgccataccataacttagaagcagccttggccctacccttaggactagtaatcttatcactaatttaagaactgctaggcatcaatgaatctggtggccttagaaccccagatgtcactcccacccactggcccagcaggctgcttggctggttcccttcacgtgtgccacgcagtattagtttctcatcgtagacccatttctctgtggctgcacagcaaaatcagtcctattattaaatgccaccctgtaagctctctacccaggagattccctggcctcagaagcagactcattggctgctgcagaggactgctgaagacatttggggctgttttggcaagggtctaatccacaggactatgggtagagaaggcattaaaggggcatcagtccagcctccagcacatccacattcatctgccctcaagccagagcatagatgccaagtaaggctggtgagaggctttagctgggctactttgggccaagctgaaccaccacttgtacagtgagcaactactcccaggccaataacttgtattctcactgctgcaacatctagtccacacctcagtcaagcacaagcagtctaagcttcacatttctcagtcaaagctatttctggatttgcatatctgggctagccatcagaacttcaaagccagtttcatgatctgcatgtctgtgtgagtcatcaaaatttcaaagagtcctgaccaccccagtggacccattagcactcataaccgtttacctaaggaatccctttccctgaggacttcttagaaatagatgctagagagtaattctactcaggctttgaaccaaagatgttaattctttaaacttaaaatatgactccaattagcagatcttagaatatgcatatgatcctacagatcacttgaaaaaacagccaaaattgccttggcttctttatttaaatggatacctatgtcataatgcttaacacgtgcctgacacagttctaaatactgtacaaatattaatgcacttaattctcatagcagtcctcagaggcactattatcatcactcccattctgccgatgaagaaactgaggcacagagaggctaagtaacttgcccaaggcccaagctgctaaatagtgtgtgggattcaaataaataggtgccaggatgcaggctctcaacttttgggttctgctgcctcttcttaaatattcaagtttccagcagccagtgagactgccagtgaggtatgaagtccacacacacagcattacagctaaaaatatccgcatacagccgggtgcggtggctcacatctgtaatcccggcactttgggaggctgacggcggcggatcacttgaggtcaggagtttgaaccagcctggtcaacatggcaaaaccctgtctctactaaaattaaaaaaattaaccgggtgtggtggcgcatgcctgtaagtcccagctactcagtaggctcaggcagaagaatggtttgaacccggaaggcggaggttgcattaagtcaagatcgtgcccttgcactccagcctgggtgagagagtgtctcaaaaactaaacaaaacaaaaaactacacataaaataatttgaataaattgtttagcatatttactttgcttttgtatctgataaatttatagcatataaatcagtgcactgacaggagagctgttataaatttatgagtattggccatatgcactgttaggggtttagcatgccctgtatttccttgtacgatgtgaagctactgtggcataattaatttctctactgtgctggatgaggacccagataatgggactccatgcaccaaaatctatgtttcacatgtgattttattgtaccttgaaggccaactgttcccccttggggaatgggtgtgtgaacgtggcagtaacatagcacgagtggagatccctccacttgcctcctaattccatcacctcctacttctgccaaggtcttgctccatctgttagtttccccctctcttggctcctgctgttcagtgcacaaacatgctcaaaagtctcttcccatctcagacaagaaaaaacccttctgaaaatgtgatatgtgtcttggggtgaaaaagagtgagaaagaaaaaagaaaagaatgctttagtttgcagtaaatttctctccctggttatgatgtcaaattcatcacagctcattaacaattagatgacggtctatttcttcctaaccttgtgaaatgagaccaatctctggcacagatttcatcccaaaggactacggcaatgcatccatatgtgtggagtcacatccacaggtgtgtaagcggctgcttggttgtaactgcctggaatgcctaatgaggatgaagaaagccatatgcactggagacagcttcttaggaccggcagcattttaatgacaattgtttgtgtatctgtgcccacttcaataaaaatgacaacagctactctcattctgaggatgtattacagattccgggagagatcggaggtaccactagaggtcttctaatattaataaggcctacgtacttccatcctcaccactaccaatgcaaattaacaccccactgcccaagtgtgaaagccagggagctcccataccatgagttcatatttgttctcaaggtcatacacaatgtgtgccggagccaagattccaaaccatctgtgtctacctccaaagcttatgttctttccagaacattcatgacctatccttttttgtagaattttccctaggcccacaccaacctctctcctattcaccttcaaagctaagttcaaatgataactttttgtaacgaagtctctggttcacagcagaatgagaaaaacagaaaagtgtagtattttaaagccaaattattttcatgcaaagaactgcttaagaatatgtctgccttacatttttggtgttaatatgattgttatgttaaagaacaaaatagtgtcgctggtgcagtggcttacatctgtaatcccagcactttgggagacagaggcaggaggaccacttgagcccaggagctggagaccagcctgggcaacatagaaagatcttaaccaaaagaaaaaataataataaaatggtgaatggtaggtttcttcttctttttttttttttttttttttttagatggagtcttgctctgtcacccaggctggagtggagtggagcgatctcagcactgcaacctccgcctccagggttcaaagagattctcctgcctcagtttcctgagcagctgggactacaggcgcatgccaccatgcccagctaattttgtgtgtgtgtgtgtgtgtgtgtgtttttaagtagagacagggtttcaccgcattagccaggatggtctcgatctcctgaccttgtgatccacctgccttggactcccaaagtgctgggattacaggcgtgagccaccgcacctggccttttttttttttccaaagaaagtaaatacccaggacagtatgtggtatatagtaagtgctcaaaacacccatgaaagatttgcctggtgcaggcaagggcagttcctctgtactctgcatggctgggtctagcctagcatatcggcactggtgttcttccccactggcatttaggaaaacaccctcagttagaaaacaagtgtgccttgggatagctcagctttgaggatcccttctgggagatggggcagagtggctttggtggacagggttaagagccctgggtccagttgtctctcggtgcctgtcaaccccagaggtcatttattccaggcttggagcgagccattgcccatggacctccaaagcacctcctgacacttactgccaggcagtaactgcaagtgggagaagaacacaatagaacttattagtttgggggtaaaatcttggtgttacaggctgaattgtatctcccccaaactctcaaattcatatattgaagttctaacccctagaacctcagaatgtgactgtgtttagagatagggccttcttaaagaagtaattaagttaacaatgaggtcaattggggatgggccctactccaacagactggtgtcctttgaaagaaaaggagattagaatatagatatacacaaagggaagaccacgtgaagacacagggagaaagtatccatctacaagccagacagagaggtctcggaagaaacccacgttggtgataccttaatatcagactgtgagaaaacaagcttctgttgtttaggacaccctgtctgtagtattcgtatagcaactctagcaaacatttaggaagccgaaggttcttcccaagaaggtaactgagatgtccctatcatggtggggtgacaagaattctaagactcagaaaaaatgattttaattgactgggccaggaaaggtcaggtcactggcacagcaatagccctgggagaggcagggggcagaagacacctgattacaaacagctgagcaaggggtgccaggctggtgacggtccatcagttggttcccaccttcactggggaatgggaaaacgcttttaagacctgctttagggtctgggtccagcccgtgtgacaagaccaatcccatcagtgctcacagacatcaagaagctcagctggccatgggcagatcatctaatgtacaatcagggagatggcgtcaataaaagggggcaaccaatgtcagggcctcaggacttaatccaacgctttaccgaggcaacaaagccaaagccatctttcctatgaaacaaggggcaggagacctcagaaacctccaggagtaaaactgacatcacactgtagctagctgccaagacgcggaaccagtgttgccgcttttgctccccgcagagtgggtgcattagacagaaaatgcttagcgtgaacagaaataggagggaatggtggcagtgagggcatcttgtgttccctctgccacagtcatctagttgggaattctgtgtctcacttctttttttaaaacattctgacaagaattttataatcaaaagaacacaaaaatcaaagctattatcaagaattgtctgacttcataagcagctccaacttcttattcccacctgaattgtggttgagtgggtttgcacagtttttcatgtgtgcagggctttgctgctggagccccgggaggtggtatttttgctctgagaagaggattcactttagcctgctgcaattcatatctgcctgggaagacatccagaatgattcacaaattggttatggcaacaggtaaaaagaacaactgtcatgaaaaggcagcagcagcaacagcaacagcagcagcagcagcagcagggcagaaaatataagtgttccttgaaggaaaggtaactaaaatatctttgctaaatttaaaaatctatatgtgcacgtgtgtgtgtgtacactcagacacatatgcataaaatgattacacatataattctatgtacataaaaataaaatgattaatgtgaatgagtttgcacattcactgccgctatggtccaccagccaataggaaggaacccaggggaagtccacgaaagcctgtggctataaagaatgtggcgccacactcccgcagcacctatctgctggtgagaacactccagtgtggagttgtcctgccacctttcaagaggtagatgaggaaatcttgtcccccagaccaggctaaagaccccttgagagcaaggactatgtctctgtcactccttcgagcttcacttcactccatctcattcaagatggcacaaggctaagtactaaggaactaaggtatgaggtatgagctaagtactgaggtgctccgtggttcatttgtaaagggtcactttctgatccatactatgaaagagaaacagaaatatatgagaaaatgctctttggaaagtgaccttgtcttgaacctgtggcccactttgttcttctctgtccattctatgaccaaaagagagaagaaaaagtctatcgtgaaatgctcaatgattccatttccttcctacccacttctacttcctcctgacacttggcatgtccctccaactcacataccaaacaacctccatcaaagattctttcccttttcttattgcctttggcatcagaaactgcttgtctgtgctccgtccaggatccatctaacaaaggctgaagccccacacacctgggattcactctctgtagcaagatatctgaattcctagctctgaagcttcaaagcaaaggagagaaagaaatagggagggaaaggccaaagccaacttaaagacttcccatgagaatggaaaaggagcatgggaatgctggaggtggagagagaatgccatccagagactcagagaatgtaaagacacatgtatccttccttgcaagagttcttctttgaggtttccacataatattccaaactaggtctttccaaggaacttcgaaatcttggcaaatgctccgtaattcctaggatacatcgtgtgatctggtggcagatgaagagatgaaaagtgaaacaaaatagagaagaaaaataagcagaatgcccaacatggaagagaccccttccaaatgcacaaggtcacagcaccatgcaggaaagggaagggcccacaagctgccaggggttcccgggggtgctgggaaatcacagatcatgttaccaaaggagaactgctaaatcttatgacttttgtgtttaggatcagcatatggtccccaaatagtttgcccactaaattgcctgaagaatgttttttcacagagggtctacttggcatttcacaggcaggacatttctttatgacatgagccttgttttgcctattgaacaacatttagtagcacccctagaatctggacactaaatgccaaaggcatgtcccagttatagtcacaaaccaaaacaactgtgaacatttaaaaacacccacttagcagaggattcaggggatatgacctcttgttgagaattatttgcaagttttccatgaaattacagatcaagctgtctttgatgaaaaactctgttgaggaagagtgaagtgcttttctcaattgcaacatttcaagcctaggagactggctactgtgtagggtgggaagtcctgatgggagctgcctaatatatggctcaaatctcaagaatctgtccaacatggtggtctgtagtcatcctgcctctgcagggttggccacagctctgggctcccacttgctgaacagtgttaaagttggacacgttctcaccagtgtttggaaatcccttacctatgacagatatcactctctgggctgccacttagtggcaagaagtgttcttctgccccttccctgctaataggaagaaagacaaccatggactttcttttcttttcttttcttttcttttgagacagggcctcctctatctatcacccaggttagagtacagtggtacaatcatggcttactgcagcctcaaactccttgggctcaagggatccttctgcctcagcctcctgaatatctgggactacaggtgcacaccaccatgcctggctttttttttttttttttttttttttgtagagatggggtttcactatgttgcctaggctggtctcaaacttctgggctcaagcaatcctccagccttggcctcccaaagtgctaggactataggtgtgagccattgcacccaggctaaccacagaaattcgtagttcaaaaggacttttaggagatcacttacatttgggagcagtggtgcacagagggttaagtgttttgccaacagtcacacagtaaaaacaaccaaaagaatttatgtacataaagtgctgtagcacacagtcagtacttgataattatttcccaccggtattatcattccatcatccaggaagtccagccattgctttaagtggtatttctctggaaggtagaaactctacctactcacatcaaggacaaggccacatggtttccttcagtgtcccccacaggatgaccatggaatgaaatcaagattcttgtccacaagcccagcagtgcttgctgctcgtgttgtggaagcccactgcttgacaggctgaatgctcccattttccacatgtacagtaaaaacaccgagtggtgtttttactagaaatggaaaggaagaaggctgcctagctcacaagccttctagcaaaacagtcagtcaaaccaaagttgggcagggggtaggtaagtaaatattctgtattctcacctcagaccagagatgggcttgaaactgattgtaacatgtctactccaaagaggtcaaggggtgagggaaactcatgtccagcatgctctcgcatggacatggcaaatacaggatgaagacagacagtggctgagaccactccacgtcccttgacccccagcacagatgccttcctctcctgctccacttcatctcatctctcaagtaactacccccctcccttctccccacaagatcactgaaggctaatctagaactcttacttctaagcattaattcactcaatattttaaaagtatcctaaagaactggtccttgccctgaaggagtcgatgatccagcaggagcataaaggcacagatgactcatcttccacctctacacaataaatgtcatgtggaaagtagactcatgatcccctaggcatattccttaggacaacagtttcaagagatacactgcctaaagaaagggtgccagggccaaatgatctaataattctggaaaatgctgttaccaccccccgctttgtaaagactgacagtacaaattaatgtactaaaggcattaacatgtattgcagtgaaaagccttattagtgctgatcaactcaatcattctcaagcatgtttgactacctaaatttatcaacatttcatggagacaatattccattgaatgtcatttgctggattctaattggggtgattgggaataggtgttaaagaagatgctgcattttgactgggcccaaaagatgagtagagtttcattagtcccagatggaggcagaatgtgcaatccactcatgcaacacacactcactgagtacttcctaaaggtgaggccaacccttggctctggggggctgctaccctggtttccactgcaaggcagagtgaaaggcactagagcactgatttgagaaagggcttcctatgtttggggaatagcaaatgcatggctagagtaaagcaggtgtaaaaagagacagaatgaggaataaggctgaaccaaacagaaaaagcatctattagatcagttgtttatcaggccacctgttacctgttaacagcactggcctagacagtgttaatcatttctgtctgctgtggctagtgaagaaaccctgagcaagatcttcccttctctaggcctcagtttctttatctataaaatgactggattctctaaggctacttgcagcatccatgtctcagtgttctgtgattataagatataaaaaggcagcagcacataccagcactaaaggacaggaagaactggggacaggagaatagctattggtttagacatacatcgaaaaatcaccttgaagaaaaatgagcagaagaaaaatgaagcctattccatcttcagctctcagggcccagactccctccacctgatatcttaggattctgcttctcaaatgggaagaataaacatggcatagtttccaacagtcaattgtgctcaaaaatgtaaagaagaaaatttgactcttgttctaaaatcaagacatattttagacttagcatgcaatattctcaatgtattttagagatttaaaaatgaggacttaaagaaagatctggcttgtgtgggctttttgtcttatgggtgagtcccctgggtgctcattcaccgtctcccagtgtgaggagtatacttggagggaaagtttcactgggcatctcagagctttagccatttaaatcttgtaaagacagaagcctatttatcctgacttaagctgttctaaagagacagaaactcaccattggactggtcttctccatagtttttatgggatggtgcatacaagaacatcagagcaaagacatacagattccacatcccatagatgcctgtgaaaaaggcactgttcacttggactgtgacgccgccccatttccaatggccttccgttacctgcggagaaaggatggtgatattcaattgaaacagagaagaaacagaagaaacataacaccaataaaggaaccaaccaacatgaaaaccaagtctcttctacatgtgggaaacatgaagggccatgtaagactccatcttttaatctgaatcatttcggtgtaaattaaggtcaactgaaggttctctagctttctgtcaggcacagtcagtggtccttaccttgcccacagattagtatcacctggggagtgtctcttcctaaaaacagcaattcattgctatccctaagttaaacaaactgtgtttgagcccatcacttattcacaattataattcctcctctgctgtctgtcttcccagctagatgtcaattccctgcaggcagagaccagttctctgctgccatgtctttaaggcctgatgcaccatagattaattcaaatccagtgtctaccactcactcggcttaatgtaagacaagatgaagactccagacttcagaacttcagtgtccgtaagtgtaacataaaagcttgcaggttatcgaagagaattaagtaaaaatatttctagaacctgcctggcaggtactcagtaaatattagttatttctataacatcccttgaagtaagccactcatgaaaataattatgaagctttcatatgcttcaaaattctgcaagagatgttttgaagctgcttttgtctgtgttaatgatttggtaattgtcttaagggctgcctaaagatatatggattacactaagaactgtcaacagagctgctgagctaagtgactaatttgtgccagctctgagacaaatgaaatgattttgaccacttctgcttactacgggacacttaaaatggaaatagaagaaagtattgggtaaatattcctttgacagctgaatgaggctgcgttgtataaactttctctaggaatcacttttaaattgtaagatggcaggctagattgaaatgttaagaactttaacaagcaggtggatttcattgcctgtttatgatacagtgggtctgtgttcattatcttctgtataatccataacccacttggggccctaggccaaattaaggtctaagtataggtatttttttctgaaagaccaggagtgtcagttaaccacattagccaattatagacttagcagttttagtttggccttggtgatacataattcttcactttttgtgactcataaacaaaccactattatgaactcttatttattttggaaaataatgcattttatataaaatgcccagaagtgttttctggcaaagatggatttcataaccattactaattttaggacaatgtaccagcattcaagctacttaggacttcttagaaatgtctccaaatgtcgctcttctttaagtgcagaatatactaactttataaaaactatattacttagagcatcttatgatgatttttattgcatataatggaaaggaaaagaaagcattaagatagtttccagaaatacaggtacctgctgtcataacacagagaactcttctgtatgtgattaaggaggggaggctaggctgtcacgcatcctagctgcaagagagaatatggcaatatggcagctcttctactctgttaaggcagtggacccttcagctcagggaagggccagtaagagaccctattcctgcgacagaagctggaaatactcaatattgacaattttagtgacattgattcttgctaggattgacatgactgacccatctaaggaaacaccaacctatgtgccttgcacacagtggtgctcgatagacatatgttgaatgaacagaggtaaagtacaggtatgtgtagggactccaggacaaatacatggaggtagaaagtggagatggaaagaaccactcttaaaagtacttgattgaaaagtaaagacaaagtattgcagtccacaagtcataataattgaatttaaaagtgagaggagatgccaatgtgtgacaagtgttattcatttaaaacattgctttccgttatacttatttaaaataagtggttaacacaaatattagcaaagctaagattcttttgtattcataacaaggataagcatatttattcaatgctaatgatgtgccagatacaatactaaatccttttacatgaaacacattatttagtcttattaatgacgctgtgaggtaggtaggtaatatttccattcaacacatgggtaaactgtggcacagaaagatggagtatcttgcccaagattgctcagccagaaagccatggctctgactccaaaagaaggtattcttaaccattatacaacacaagggtaggaatgctatcttaaacaggggttgatctctgaaggtagcacatgctctgaaggtagcacatgaggcaacgactatgtaaggtcaaatttccttttgaaattcacttcattgcccataatgtacattacaaatacaacatacatgcacacatttgtctattcaaatctgtatagtatgcactatatatcctggacatagtaacatatggtataaactggatatataaacaaaataaaaacttacagtagaaccactggaatgagatgcccatagtatgagaggcacacaccaagcctgacaggaaatatcagactcatgctcccgtctcgtacttgctctgggacacatgcacattgtttagagtggagttgcagaattacacaccctactgaatgtgcaatctgtaaatgtggtgtttcctgctgtgggcaaagagttgaactgcagaaataaacggtatagatagtgtaactctgctctttggtggctggcttgtttttccctctcctctcccaattattcatgcctaagacatcctcagctctgagcacattcccaccaatatgtaccacaatgagcagcctcaacagagcaggccttgtaaatccaaaatcttactaatgccaaggcggaggtaacagtctccccccttttaactttgagagaaaaatcaggtagccccagcccccctccgccaaaccctcccccctcctcaaaatccccaaatctcaccctctgcataagtcttatttctaaaagtccctgtttttcctgattttacatttgaacaatttacttttgtgtgaaaccacccaattatacccctggagccaagtgaaggtcaaatctctttacacccagtagtcttgacaaccaacattccacttaacaacaagatttccaaatcccagacacaggctctcttaccggaaacatttcctctgtaagtaacagaatgaagtgatcacacacacacaaaagagctggggacaggctctctgggagtttgctgcatgtggcttgacctgaatgtcaggcacctgggggtccccttaatgaaggtcggtgaccttctcccctgcactgcacttctgttccctactgccgccacctctaaatggaacgcctctttcttttccagagggaaggggctgaaataccagactgcgatgtaccatctcttggttgctatgactgaggccattaaaatggcaggcattaaaagactgcacctcagtacccagctacaaagcctcaaggtcactgcattccacagcttcccgtcgcctttcattcctggcctcagagcttcaatatcctggcgagatcccctcgcattatatttcatgaggcttaaatgcaagctctcccacagcaagcccgagagtataatgggggttttaatacattccttttacctaaggctgggatccatttcaaaaagttacccaataggtttcctttcaggtgagctcattgctctgacattccaaaatgacattaaaaaataaatcctctgatgactatattaatacagtacctgggacactgagagttatgccggaaaacgtcttagatgtctataaataaatcttagaaaaaaaacccagcaggaggaatgtgaggagctaatggaattcaaaaggcctcattgctacccccttagagttgaaatccactccgggccgactgtcgcagcagatataaaaagccagccacaggctgaagctgtattagaaaatactgaggcaatagaatattaatctttttctccaaagaaaagccacggactatgctccttggaagatggcttcctttgctataagaagtacactaattaaacatgtacaaggttaaatcctggcaacatgcagctgcttcagggatcagtccttcttgacttcaggtgggaggcattccccgcagaggcaagatatacatgaggcagtgtggggagaatgacgtcagcctcccaaactggcacaaggacctgtgtgtggccttaggatcaaaagcgtccttctttctgctttcctaaaaacatatcttgaaattgccttttatgcctcaacccatcttccttgagatgccgtttctccaaggaagtgctctgtgccctctcagccttgcaggtctggctgtgtcaagtgccactgtgcactactgagggactggaggaactgaaaagcattttggtcataggagggaatagccacgggagaagtcaggcctcagacactcttgtttgaatatggatgtttgagccttagctggtagaataaaacactctttcagagtttgaaatagttttactgcaaatggagtggaaagcgaagtttccaaggttttataaacaacctgatataaacacagcagtgttgtaggtcaaagcagatgtggtgaacagaacttacaaagacatatatgtgtatcagtttattttttccacgttcatttcaacctcagcagagctagcaacactaacactccccagtggcagagccaacaacagggctctagaggctccaaacttggggtcctcttgggtgtccttggatagaattcaaggggtccataaactagaatagaaaaaattatatattttcactagtctctagctgaaagataatgtttacttcaattatggatgtagaaaaatccctatagtgttagtactactgtgattttctcaatagaaatcatgatattttcacatcaattacagttgtagatataaatctgtaatatacctgtagcatctgtttcactgtaaatatatattacatataatatatagagatgattccccttgaaattcgaagtattttattttacttatttgaaaccattctaagaggagactcgtagccttcttcaggttgctaaaggggtccatatacaaaaatggttaggagtccctgtactagggaaacttcccagcagaatggagcaagtcgtgtcctaagacactatctacactactgaaatcctccattttggctaaatgacaaagcactggcaaaagagtcagaaggactgcgttctgatctctaacttattgcatgtcctttggcaagaaagacattcaagcttcttgctattcataagaacacagctactcatgcttacaatgtgccaggtgctctgctaactacatttggttgccacaatgatggttcagtcaacaacagaccacatgtatgacagtggtcctgtaagattataatatcatatttttactgtatttttctatgtttagatatgtttgaaatacacaaatacttaccattgtgttacaattgcctacagtagtcagtagaggaacatgctgtacaggtttgtagcctaggagcaataggttacaccatatggcctaggtatgtagtaagctataccatctaggtttgtgtaagtacactctatgatgttcccttaatgaggaactcacataatgatgcgtttctcagaatgcatccctctttgtaaatattacttcctgtagtcattacagcaaccttctgtggttctattgtaatatttattttgcagataagaaaattaaaccttagaactgttaagtaatccatccacagtcctatccagctaggaagcaacataaatgaaaactttctccaaagctattagatatcatagtctagcaagctaggataacaattcctgccctacttacctcgtaggatttttgtgatgctcaaatgaataatagatacattagatttaaacagtacttcccacccttcaaaacaagttatgaatattttaaaatgattgttattgagattttcaagtatagcaaaatgttgagttttggaaataaccagtgaaaagacaagatgctatcaaagagacttttgaattacatttcatatttaagtggcaatataattattacaaggaatagctgatggactgtataaggatctatgttaatgctagataaaaatggaatcaaatttatgcttgttagtgttgtgctacacggcttgataagtttttctcataagtaaataaaatatgtgcccttcaatctggctgtaggcttttaatttatttggaaacttttatctcctacaaggttttacggaaagagaaaatttagtccatttggccaggtgatatcaagacccagaaaaatatggcttgaccagctgtccagaattatggcctctctcctcctttcctcagtggctctattgaatttctgtgcagggtagagggatctctgcagagacattctcaccttgacatctcagggtccacttacctgactaacgatgaagaagatgacagtcatggcagcgcaggccaaggtgataagcatgaggaacttgaacctaaaaattagcccctattagaaaagaaagagtagtttaatactccatcagctaccaatccttttctcactatgtaaatctataaaaagcttaattttaaagaaatctgtaaaaccaaatccctaagaatgacagtaaaatagtttcccatagtaatatttcttctgcagaggtgagtgtggctgaaaatttcttgggccaagtatttcctatgttcttatcactcataaagcagcgatacgagagcctgggaaattatattcacaacacgtcgtgaggctgctaatttccctgctaagctggttatgcttctctgcaagggttcaaagttaccaaatccaagttttctgtggttgtaataaaattctgctccagtgaacaaaaagaaatgtgcatattaatcaacatgaagtggatttggttgaattttctcatgtcactccagctctggagacaggcaagccttagaaagtgcctgtggtttcctaagagcaggatttaagagaacctgtgtttcagagagggaggcctattattcaggggctcttctgtgcagatctactgcatataaaaactctgaggttctgtagtttctgcttctcttttcatacaggaattaggcttgtttctccaaggacagccacttaggcatgaacccaggggatccctgataaatcaaggatgtgttgcttgcattggggatttgaggatgttaagtgtttctcttgaatgaggaacataatctataaacagagattactgaactctgtctgagcatctgctggatattttaggggaatgtggcctgttaagagtctggaaatcagatcacgtgggctaaaccctgtttaattacaggacagggttgattctgggacagaactttgactaaagcctcatcccaacaaaatcccaattatgccatagtccaatctcccagctagtatgtaacctacattccatcaccaagctgaagaaccggctgaacaagtttattcattactgaaaatggaaacacatttgtaccacagaaaacaccaagatttaggccagctagatgcttctcagagtaagatttggcctctaattttgcccagagatcctacatgagaatctctcaatttgtatttcaaagtaaaggctttctatctccagggtgtgtgtgtttacacatcaagtggaaagatcaagcaagcaccagttccagaacgagccaagaaatctgcccacctcatagtgtagccgccggactttgctcatagctggcaggctggactgcttcccactgatgttccgaaacacctgaaataccatgaagcatagaaacaggaagtagaggcagaggcagattccagccacgatgatgaaggccatctggtcgtgtccagtaaaggaaacaacgggctagccaaggccaagttgagccgggtccaggcccttctccccaggtctgttggcaatacttgttttgtctccaaatatgtagaaaattttcaaggggataaaatattaaaacctgatattctaatgccaatgataggtttcttgacacattagtaccacagagggaggtgttcaatattgctttctaaaccaagtaagaaaagaaatggtgtcttgcttgttagaaatgaagaatctaggccctaccctagacctaatgaatcagaatctaccttttaaccaggtccccaggagatccgtatacacaataaatttgagaagcactaataaaccatatattcgtcactatggatcagatgaaaaaccacagtaaaatcaccagaagggttcaaatgtagatccccaggtccctccctagatatatggaatcagatattccagggctaggacatcaagtatgactatgtttgggaaccactgggctagtccttggagttttataagaatgcgattgagatactctggcataattgaagaggagatacgtgggggctcagtgcaggggacctgggcatgggcttgaaagtcttaaagtgaaaccagggatgaaggactatttgcaatcttctgtcaccacagaaaatcttgtccaacagaatggggattcaaggacacatggcacaggtgggagtctgggttgctgccagtatacttgagacccactagggagactgacctgccaattagagccagtctgagaaccaccaagtcttaggatagcgtgagctgccttggaaggcagatgacctgattccaacccctttctgctacaactttgcccaaattgcctttttttttttgagacagagttttgcttttgttgcccgggctgaagtgcgatggcacaatcttggctcaccacaacctcctcctcccaggttcaagcgattctcctgcctcagcctcccgagtagctgggattacagggataagccaccacacctggcccaaattgtctatttttaaaagcatttaataagtatgaacttggcgtgcatatttcattaaataatataatatctaatgcagtttctccttctttcctataatgaacatcatcctggaatgaagggaatatagttattttctgcaggacttgaaattttactcactccatcctatctacaaaattaaaaaagttgaactagatttaacattagaaacattcttcttgttgtgcagctaacatttggtgggggcataacagaggaagggtagagcttctctctcatctttgaggaaatgatactactgatttagtttgctcacaatgttcttgtgacactgagaaaccaatataaacatcatggcaagacaaaggatattccctagcacgtggcaagatatgagccatcaaggaagaatacaacccaagcctttctctccactccagagcagagtctttttctcccaagatcatttcacatactattccggaagataaaatatttaaatccagcatcctaaaagggataagctaagactgtcacttctgcttcatgaagatgacttagagtttatgccaaccaaccagaagccttggcgacttctctggaactaatcaccttagccttatctccacttggtctcaggaataaatagcagcagtgtgatttgccagcacaccaaggtcacttaagaagtctcacacataggtggtttcagaaacaggctcttccacaggggcccagagatgaacctccatggctccagggaaaagctagtcatgcttcagtctgcaggaaacagtgtataacagataattcagacaggctgcagtaagcctagcaactcggatccctctgctgtgaggataggctgtgaccttctcattttgcctgctctcacccaggcttgaaagcaagcagtaattcttcttattattagccttaattgtgctgttatgattggcctgagaatcaaagccctggctgagtacatatggggagcatcagcagagccttagaaaatgatcttggggactgggtggccaggggaagaaataaaaccctgagcccatcaaggaaggatacggccagctctgttccaatgtctgtagtccagatactgtagaagggattcgtgagttgtacccctctacaaagaaaatgagatggaaaggcaagacacaattaatacaaaggcaacgggaactttccttttcacatattcttagcttttcagctgcaggggtgagggctgtatttaggctaaaaaacattacagaaatcctaaagagaaatgaagcttgtagaatacatcggcccaaatatttttcaactgtaaagagctgtgcctttgatttgatcccagaccttgtctgaggatgtgaccacgtccagtgcttccaaaccaaaggttcccgaccaccattctccttttcaaacactcctcctaaaatgacaggagtgggcgtggtgatgcacagtttggctcagtgtcccacaaacacttgctcacctctcacacatgtcaaatatgaagaggcagaaggagccaacggcaatgggtccgacttgcttccaataccctgcgatgtggttccgctcgtgctgatcctgaggaaaaccaaattgagaagggagatagaggggagaggaagaccaagcaattctatgggggagtcagcattcgaaggacacttgccgaccacctattgtgtatcaagcactatgctagattctaggtatgagaacaaagaagatgaaaatctcttcttcaggagctcatctctgtgggggagtctggcacatacgtagaacatgacaaagcccagccataagggctctgagagtaataagaacaggatgccatgggaacacaaagaaaggcctcggctcccaggcaggggacattttgtggtccacaaaataactcattctgaattaaatttctacgtgacttgtaacttgtgtttataaaagtgactgatcctcagaagacaaagtaaagacattaaagcatttaaatatgtaaagtgtgtctattatggtgaggaaaataggcatattttctccccatccttattaaaaccaggaatgagtccccttgataaacaaagacaccaagagaaagaaaaggaaggaatgtagaatgagaaaaaagggaaagcaaagatgatcttagcctccaggtggggccccaggtgggtcagtccacaccagctccctgcggacaatccttggctggcttcctggtgctggaccaagttccatccactcccccgccctgctgctgaggcctcattctcagcgcatctctgctggaggacacctcatggagaaagaccccttaatgtagacagtttagcagtaggaagaagtctctctctctgctctcacactgctctcctggaagggcagcaggacttgagaggtctggttttcatgattgagccataatggaatttaaaaacagtccactctgctgtgaagcccatgtgcctgacgtgaagaccaagttccagctggcatatcatcttagccacaatgtgatgatgacaccattcttatttttaaccatggtaccttcaatccctcttgaaatatgatttggtgtctgtgcaaactgaggagaccgggaaggtctgtatttcagagtaataggggttactaggccacctggacacattgccagctggaaagagccaggcccacattctctgatggttaacctgtattcctggggacaggacaagcagggcagaagccagcagacaagaaactcaagctcaagggcaagaaataatactaatcattagaatgtgtgtgtttatcttaagttactcacattctgtcatttaattctcatgaaaaccccatgcagtaggtctttacatcccattttatagatgagggacccgagattcagagtgataatgtcatttgcctaaagccactcagctggtcagcaggtggtgaagcaggaatgtgaaccagagggtctgcctccagagttcccacttgtaactactagtttattctgtctcacccactgctgactagaggcaaaggggggcaggtgtcagcttggcagcctgcacagagcagctggtacagacgtctgtccctcccggcggctcttaccatcatgtgctcgccacagaagatgatccagaaggacagaagcatcgcatagaagatgccctgtcggatgtcaccaaacagcagcatccaggtccagtcaaacccgatggaaaaccattccactgggatattgataaaggtcatggaaatcccaagggcaaagatgactctgatggtgagaaaatatcaggacagccactttattcatctggaaggcagattttcaaacaattccccgaattcagttttgagacatgagatgttacttattgggtctgaagccatatgatcaatttcttctgcacagagatgcaaaacgtcctatgtagttggcactgctgcagaatgagggagtgctataccaacctttctatggaagtgaacctgacctccttaatgcctcacactttactttggtaccactgcagatggcagtcttcctataatgtttgtgtccccttgccttctcacccaggcctcagtgagtacaattgtcctctttcacctattcaggttatcattcatctgatcattaagaacactcattattattgtgatatcctcagcaactatgaattatataagcatatttgtttcaataatacatgactccaaacacatttgaaatgtaaattctcttgactgcttgtttagcttttattttactcttcccctgtcacactaagaactgccaattctctactaaaatataattcttaagtcactgatttattcatacttttttccatccccttgaaacacatatgttaattaagcacagatcatgtaccaggtattgtgttagcactatggaatcctaaatgaacaggacctgttttttcactcacgggagatacagttagtagaggagccagataaagagacaactgaatagattaggatcaggaacatcatagagttttaaagcatagagggctgctaccaggacttctgactttgacacagacaggaatggagctgacttgtgagtcaaagtgagggaagtggaaagggtgtttggaggagagggcagagcctggatggaggcatagaggcctggaagaacctgctgcatttggggatctgcatgtggcacatcaggaaatgacaggacatgagaccagagaaacaaagagggctgtgctcatgaagaaacttgcataccccactggagaactgaaatttatcttgaagagactttttattggaatccaataaaaagtttaaacaatggagtgacatgattcattcaaaaaatatttattaaactcctactatgtgtcagtcactattctaagatgctgggaatataactgtgaacaagaaaagcaaggattgtgctcttgtgatgcttgcatagagatggaatgagagagggagtacaagaaaaagataataaatgaagaatgagcatcatgaaaaaaaaagctaggcaagagagtggagagcaatggggatgtgattttacgtaaggtggacagacgaagagatcagcaggtgtgaaggccctggggtgtgggtttgagcacaataaagggggctggtgggtggtggagaggacaagtgacaagatcagaggtggaaggcacccaatcatcaaggggcttataggtcagggcaaaggagatgaaaagccagtggagagctttgagcagaggggtgacaggatctgattaacacttgaaagggggcactcctggctatcctgtgaataggctgcagggaggcacgtgatggaagcaaggaaaggggttgcgaggctgttcccactgatccaggtgagaagcgatggttggttagttagattagggtggcagcagtggaattggtgagatttcctggtgaggttgatgagaagtgtgaaaaacagagacatacaggatgactcactgctacatttccagtctgaacaactgaaaggatggagttgccttttactgaaatggggatcctgggagggaataggttggaaatgggacacaatcaagtgttgttcttggtacatgtgacattttcaatgcaaatgaagacattaagtaaagagctggaatatttgggtccagagttgggagaggctgaggctaaagatacagattaagagtcatcagagaatagatgatttttcagaccacaaaggtaggtgaaatcaacccccctagggaaagcacagctaataaagagaagaggtccaaagcaggtgccccagtcccaaagtctaagagtctggaaagatggaaggagacaggaatggaatctaaatgctggtcagcaaagaagaatgaccaacagaagggtagaggagactctgggaagaaaaactgatcaattatgtcagatgctgggatgaataaaaaaaaagtgaggaacaaaaaatgacctttggatttggactatgaaggttgttggtgatcccgtgaaaagcagttttagtagagtggtggagatgaatccagactggaaaggactcaagagagaacagaggagaagacatatgcacaaggtttttgagaagcattgctgtaaagaggagcagaaaaagggtatgtggcttcagggggaagtgggaaatgggagaattttgtctaagaatgggagatggcaggacatgtttgtatattaatagaatccagcagaaagggagaagtcaatgatgtggagagaaagtaggtacatctacaggagcactgtctttctgtaagtgagaggagctgggcttaggggagtttcttcactacaacacagacaagtatctgattctgaccacggaatatcccgaagagcaaagacaggttaaagaaccagaaaggtcagctgggtgtggtggctcacacctgtaatcccagcactttgggaagctgaagcgggcaaatcacttgagctcaggatttcgagatcagcctgggcaacatagggaaaccctgtctctacaaaaaatacaaaaaactagctgggaagcatacacctgtggttctagctaccgggaggctgaggtgggatgaccactggagcctggaaagtcaaggctgcagcaagctgagatcccagcactgcactccagcctggacaacagagtgagaccttgtctccaaaaaataaattaattaattaaaaagagccagaaaggtgagagaggtagaaccccgaggatttacttaataacaacttgcataggaaaactgcaggagaaaaaggagtccaggatgactcctggtcaaatcactggcctaagtcacacactggctgcttgaactggacaccagcaaaagcaagagcttggcagatcatgagaagccagtattcctgaagagcgctccaaaaccagctcttacttttccagaagcactgggggtcgggacatcatggtgatcctcctccaataccacaccataatgatgaagatgctgggcgtaaggaaggtcttcatggcaaaccacaccttggtgaagcctccattttggtggatcccctaggcagagaccagtgataattttgaaggtgaatattatcttagcatttccttctactagcaaatgcttttgtgggagaggtaagtggagacctcgtctgcgaatgttcacgatcaagagctttcacattcatagcaggtactgccctcatacacccttggactctcctcagagataatagaaatacatattaaaagagccctgtgctatggacctgagaccagagaaataaagagggcatcccattcacaataacggctttcatgttctggggtctgaaagaagaacatggggctttggggcagggtcactatttccaagagacttcgaattatcttaccttggactcatcccactgatattaaaatgctaatacctaaagatacactttagaggtacggattaatagggcaggtatggattaatagggcatacagggtgtatgatatctacccagctaccacccccacagtgtaccccccaaaaaagccacatttgaggtagaaccagaaatttcaggtaaaaagcagagatatcctctatctcttaacacctctcttggccgtttaatcctcattctaccctcacatcttactaatctggtctactaaggctacaagagctttttccctatgctaagattacgattaagtacatgatcaattttttttgtaagcttttcattagaaagttgcagatatcctagatggtcaatatgttgagattggtaagtgttaaggtaaatctattctataaaatgctaatcaatattggaaagtatatttatattacattcaccaatttatattacatataccattaaataaagaaagcaaggaaaacagtcagttcaatatgatcctactttttgtaagggaattactacgtataaaaaaaagcctggaaggagatatatcaaaacctgaacagtgattatttctctaaatagtaggacattacaggtaattattatgcttttctgtgtctctacacaattcttgtgggactttgttgagattgaaaagaaatggcctccttgcagcaagttctaacttttccccaattaaacaaatatgatggaaagaacctaaaccacccctattccttttaacatttgtgcttgcaaggtgaaacacataaaaaagaaaatttacttttatctcagtgttattcattatgcaatcatgactatttcatgatcttatcatcattgtaatgatcttaagtgatcttaagcccatttaaaatcttaagtgggcacaataattgcattgtttcccatttctgtaatctctcacacaaattagttcactttatgatctcagccatcatgagtatgttattattcccatttctcagatgagacaggtgaggcatagaggtgccaagagtgagatggagttcccctccaatacacatgtcaagatcaattacattcacttaccaccaaccggatatcctttatctccccaattcccacattgattttcttcttctcattcacaggcagccggatgtttaaaaggtaaaacttatgggccacagacccaatttccatgaaaggaaggacatcacattcatagtaacggccctcatgctctggagtctggaaaaagagcagagggtttgaggcagggtcactatttccaatagactggctctgaattctgttaccctggatccataacatcaattgtaagcagctaatgcttaaaggtacactttagacgtacagagtaacaatgcatactggaggcatggcgtctacccagctatcccaacctaaaacaaacatcaacaacaacaacaacaaaaaacagctgtattcaaggtagaaccagaaattttaggtagaaagcagagataccttccttctatctcctaacacctttctaggctgtttaatcttcattagaacctcgcatcttacgaatcttgtctgccagggctacaagagtttttatctgcagtgtgttgtcagggtcctctaaggctctgtggaacagtcagcttcttaaacgttcaggtggaagctcttgctgaatcattacactctttaatgacggctaattattctcctgattttggcctgagggagaagctagaagaagctgaaaatatcttctttttattcacttgccaggaaaaaaaaagacacaaggagccgttggtatttagggaaggtcgaaacagaagaaagaaagataataagattagtggccagagatacccactaagaattttctgcctccggtgcttcctaacagtccaagatggcagaagggaatagaagttttaatgaaataagaatttagcccagtgtctaggaaagcctcttggacttcgtgccaaacaatttaagagatactgcccagagcacggtggtgggaaattggacagtagggagacaccttttttttgaaaactaaattctgctccacctcaccaggactcccggctgtgtacctgctgaggggtgggggccaggggtaaagatgagcataaagaggcatgagcttcagcaggccgggacttttccctgatatagaagatgagagtctaccatcaatgttgggtttctatgtcagcttcaatgtttccttggcacctcctgatcaagtgataggggagatctaatttgtcgttcctaagcctgaatttgcaagacctccataatttgtcataaatcttcagagcaaagatccactgaagaagtgagaagaaagaagataacaaagagtccatagtctaagagtatgtaggaaggggctaggaaggggctctgccccttctgagatcttggctggtggggagggttccttactgaacagtcagagcttagaatgcagtaaacagacctttgtacagagacagagacacacacggcaaggtagaggtggggaggtgcttctacctcctcttgcccaccacggcacacataaccaatcagtcgtcaacagtttttatccctaaggtgtgagcagctcttgtcagacacaccagttgattagagttggcatgtgagatttttaaaaattcttctgtagaaagaatgctgctttttcaaacctcagctgcaggtcagatgattcttcctatatagatcatctttctctcccctccactcctttctctcttatactttcaaatcagggaggatgggggctctgcaggtactactaaaagttcactgcaggctctaattctccctcagattaagctgcagtgaggaggctgattatcctctgtggtaacagcaagagggtattttctgatttgtttccagttagggccttattttattgatggaaattgagaacttgagggcggaagggaacaaaacctacttagtctaattccatctggtgtgtgtctcgcccagggtcccaaaagtagtagcagaattgggagaaggacatgggccctgcccaaaggcaggcattgtgctgtgataaagactcctgaactccaggccaggaggctgattctagtcctgaccatgttccttgctgggtaccttgggtcaccctgcctcatttggcctcagtttcctcctaagtgagaaagttaagtaagatgatctccagggtcacttctaatcccccacgatgggtctctgggtgccccacacttccctgtcactactgagtgagtaacatggacacccttgacacaaatttacctaagttcaaattaaaagagacacattggcatctgggacactggctcaaccttcctgtctcagagacaagttcgttgtatcctgttagagacttttcttcatgcactaaagtcctgcctctgccagtatttagggcatttaagaagattcctctctctccttcctttgccccacccccagttctcccccaactccagcatgagactagctcattaggacaaattacagcaggtggcaacttgacttttttttttttaacttcacaatccaccagggactcaaaagctttaaagcaatttctcatttaatcttgagactcaagactaaatttcactgcaatcaaaaagcagagacttgatgattcatttccttcgcacttttcaagatttaatatctttcttgcaagggatcaacacatcctaaagataattaagcattaagaagcagttgcaggcaaacacccttccccctcgctactcagtgccctccatgtgtataaatgagaaatgacttttcccttttctatggataaaattctgtatccgaaagccatctagcttagatgttcaaccagtatttcaaagatgcagtcaacttgcagagatagctagaaaggtttttaattttcttggttgcatgcaaagatctgaaaatgttagctgttcctctctcctgcttcctctagtttgtctatcattcatttctacctacaaatggctttctctggaggacagccctatatttagcactcagcagagggtctagggcagtggctctcaaacttcatagagtttaataaactgaaggcctgttaaaacacagattccttgctcctacaccctgagacattgacttaataggttctgggtgtgccctgggaatctgcctttcctaaaacctctcaggtgatgctgccactgttggttctcagaacacattttctgtagctttgttctaggaaacctgcgggagggagactcccctagtgtttcaaaaaacactgcaatgggtacttaggtttacccatggagggccttagtttatatgttttctcctagtggcccatctggttaatatccgctttgactctcaaatatgtcccagacaagatgttaaattagaaggtcatcctgcctacgtcattgtatcatctagtccaggggtgtccaatcttttggcttctctgggccaaaccggaaggaggagaattgtcttgagccacacataaaatacactaataatagctgatgagctaaaaaaaaaaaaaatcacaaaaagaaattataatgttttaagaaagtaatgaatttacattgggccacattcaaagccgtcctgggctgcatgcggcccgcaggcagagttggacaagcttgatctagcccttaaacagactcccaaggtaggtactcttatctcatcttgcagaagaaaaactgaagctcagacagattatgtaagcttacctgaggtcacaccgtcagtgataaaaccacctaatctttctcctctttaggaaaaaaatggctaaagctggggcaaggtactcagaggcttcaacctcatgtttttactattttgcaggaaatcttaacagtaataggcaaaagcaaagttaggaaaggcccgtggcaggagagaagaggaaataaaatgctccgcagagcaggtattaccaaagctgtcctcatgcgaagaagggacacacctatgaaaagtaagcaaatctttccacatacctgagaaccaaataaaaactgtcagcttagacagcaaggggtcataccttgggagatgtgaaggtgcatttgagtttccgtggtactctttcatgggccatttcagtccactcagcaaacgcgtcatcacggtaagccagggaaacgtccatggagacttctgcattttctcctgcaagagaaaggatgcacgtttcagaaatgacttttggaaagatattttagaaacagctcaaaaaattcttataggctttgacttggaaaccaacgagacaaaagggaaatattaatttctatcaaactccaaacctgaagacttagaagtcataggatgaaagtctaagccaaatgctgggtcccctctcatgtccactctgccagagtcaagagcctccatttaaactcttccagagacaggggcctcactctctctgagggagcacaaatggtcagacctcatcctcccataacttgtaccatgggtcctaggtctgcctgtagaagccacgtggaaggtgatgtccttccttcttccataaaaagtgccttatgttcttgaaaaccataccacatctgcctgcattctctttcctctctgataaacatgaccaagtttttcaaccacctctcagacacgtccctctggggctcttctctggtcacactctgtctgaaaacatccttctcaaacttattcccgaaagttctcaaatataggatttgctacttttccaaaagtcaaaatcccttcatattgtggatgaagttaatgtaaaaggcaaagtgtttttccaaaattaaagacttatacacagataggaataatacataattgcacaaatgaatgttcacacatacttccatatgtgtggactggaccacgaatgagttaaactcaccacagaactcattaaggagatgagattaataaaacattgcacctattaattttgtctgttttatactatgatgagcaagttcaagagcagagaagtcttttttttttttttttttttttgagtataaaggtttaattctatttaaaaagaaagtccattaaatcaacttcaagttcttaactcatgggactattttggaacacttctttgtaaatatcattttgttaggttattggcaaaacagtttcaaggttcacttccctcccttgaaccaggtccaggtcattttgctttggggtaaattaaaatcagaattctaaaagttgagcaactttgtttttttttaattgacttagctctaacccaccattacaacttaaggacggcatgacttgataatgatggacttgtgtgaggttttgagttttcaattaaactttgtatcacatgaggtaattgtcagcattcttgagtctggttatggaataggcagatagaaccctgtagtaacaagagttggaaattggctaattgacaacgcacttgccttaaacatctcaagtagagaacttttacattagtgagatgtacttgaatttcagaactcaacaaattttaattactttttactgaaaactgcagtgaatgctaaatgtctacgtttacaataaacaaatacagtaacagtaactcacactgaaacaaaacatacttctgatagccattatttttctgcttgggacaattttaaagtttttcttttgtcacaaaaacaggaatgtatccaaacaaaggctcaaaagaggccatcttttcaaacaaaaaggcaatgattcacaaaagactgtgaatagaacatgtaactagttgatacaaatctaataggatttgttaaaatcagtcacatctaatacatctgaagtgctcttgtataaaatatcacgtgaagaaaagaagactttatcaatgtctaaaaaagtgggtttgttcatagacaatctgacaagttaccataaaaagtgtttcctgagacataaggaaatgcaacattattcttcttgaaccgttttagctcaactttccactcaataaaacagcagaggatctgaaactgagaaaatgtatttgagtacaaacagcttgtgaaagttaatactttttttttgcatcagagggtttttactgaacttacaaccaacttgcccactcagtatgcagttcagatgtgagagatgcttctctgtacaggagcctgtactgtcttcaatcctatgcgagcaagtgtctaccacaggcaaacagttttctccccattttgtagtaatgtaattttcctattagcaaaaggaggtcaccagcccctgtagacttaagggactcaagtcacaggatggggatatcctcttaatattttttattttgttgtttgaactcttgatgcaacattgtagagcagggtgttcaggacctgctgtgcccaagggactgataaaggaaaaagctctatttattctttgtgatttgatgcacagatgaaaaacttaacacacaataacagaagttggtcgttaataaatcacatcctagtctttcagcgcttccgtaagcagacgacatcttcagttttctagctcttgtagttttaacactgcagcatcaatgatgcataagtccagaatcagttacaaagaccatcatattctttttctcttagttcatcatttttcactatctcttggtcccaaatgtatctgaatgattaccttccggcattctctgctattgctcgttggagtgctctcgattgtccccgtgttttgtgggctggttgggagagggcgcctgggaaggatgtgccactgttgggaggttgtgagtcactgggatgcctccagggatgatcccttccacggctgcaggaagtcctcctggagccacgcccacgatgcctggcggatatctgtatgtggcaccattgagctcaggatgaattgcttgctggtctattactgaccaaggcgctgatgtgacagagaattccttgttcacacagtttcttaagctttctgggatgtgacctgtgatggctcggcggatctcagtggcagctgcctccctcatctccagtgacgcctgcttgctgtaccaggcagtgtgaggagtgcagataagattcggtgcatctttcaacggaccctgagcaaagctaaagggctccgactcacgcacatagagggctgcccctcgtatcctgccctccttgagagcttgtgctaaggctttctcgtccaccaggccaccacggggtgcgttcacaaggaatgctccctgcctcatctgctttatggtaaagtcattgatgaggtggtggttatgttcgttgagattgcagtgcaaggagacgcagtcgctctgatacagcaaatcctacagagtgtagaccctctgcacgcccagggatcgctcgatcccatcctgcaagtaggggtcataaaatatgacgctgaatccaaaggccttggctcgaactgcaaccgcctaccccctgcgatcaaagccgatgaggcccagcatttccccacggatgctggccgatcccgaggccaactcgcggttctgctccatgctctgaacccgtgtgccttaccgcagtgcttggtacagccatgtgttcctctggtacagattgaggatgtggcagatggtagagtccggtgtctcttccacggctgcagacgggatattgcacacagcaattccgagctcgctggcagccttgatgtccacgttatcgtagccactgcctatctgcacgatcactctcggggccttaaacttttctaggtcctccctggtgaggatgatggtgtggtacatcatggtacccatggcttcgttagaaccttctcgtggatttcctgcgtggactgcgcgtcacagaaggccacagtggccaggtctttcaggatgggcatctccacagtgcagtcgcggccgtccagcagcgccaccagggggcaggagtgcagggggccgttcatgatctgggggcggataccttcacaaattctgtccaattgctgtctcttgactttgtgcttatccacaagggccatactttatggaactttgcaactctcagatcaaaaggcaaagcagtcctctaagaacttaggggaactcgcaggagtctccgtgcatgacgccactatgaacccactataaatctgtacacactataaatctgtacactataaatctatagttcacacgatgggctgtccgtctttttaagggaatacagcttcattggttcaaaaccatttaaggtgatgaaaccctcgtcccggacggtcagcgtccacggcaaaaggcgcccactctggaggccgcggtggcggtggctcccgcccctcccaccccaccctgcggcggtggcggtggcggtggctgcagctgtgcagcctcccctcagcgcagcatggctcccttttcggtccctcgctcctccgggccgctcccgagccaccttaaaatgacgctcgcacacagggacacacaacacaaaaacttaatctctccagctccccaccactccccctccctccctccgctaccccgctctccccaccctacccctccagagaagtcttaatgaggaaaaaaaaaaaaaaagcacaaatcacatttccaaaatgactggagatcctgccaccactagggttatgaaaatgggcacaattttaggctctggctattcagccttgaagaagtctcagtatccaggcacctgagtttgctccatacccacctcctccagggctgcgacaaggattaaaagtcaagttagtgaaagcactgcatgctgcctcatatgcagtaggtgcttaataaatgtttactaaacctgaacacatacaaatcacaagggaaacagataggaataactgccctctgaaaagcagggcttttctacggtggcttaaagctgacatggcagcatggcagatccctggttctcagaagaaatctcggaaaaggaagagatgatccatggaagaaggaatttgaggccattctgatatagaggaaaccctcgatgaacatcagtacccactattctattattcctatttttatcctcagttaaacatagtgaattagccactgtgttttcctcctgaaattccacaaaataaagacaaagacagtaaaaagaaaagcaaaagatattaaatcacaaggggaaaaaactaactgtagacacatgagcagacaagagatttcatttttttttttttaagacagagttttgctcttgttacccaggctggagtgcaatggcatgatctcggctcactgcaacctctgcctcccgggttcaagcaattctcctgcctcagcctcctgagtagctgggattacaggcgtgcaccaccatgcctggctaattttgtatttttagcagagtcagggtttatccatggtggtcaggctggtcttgaactcctgacctcaggtgatccgcctgcctcagcttcccaaagtgttgggatcacaggcgtgaaccactgtgcctggcctcaaaatttttttaaaacataaaaaatacatgaagtagggtttcctggcagccacagcctacactcctatagaggggatattctagaaaagtgagccaacatatctgcaggaacctgaagccactcagaatttgaaagtaccaggggttgcagaaggcagaacaaagcatggcactgacaatggggtgactgggtcaaagtctgcacacaaaactgctggacctcagttctcccacatcttcccatctgtgcaagatccaaggagagactctggacttgaggacaccaggggaatatgtagacccagggctggaggtggagaagagcaagagtctgtagaagaaactgtgccactcccagcttggcagaaacaatgttcagagttggtatctccccttggtcagggaccaagctggctacaacttctccccacttagtagcctcagtggtcaacagaaagaatcagtcagagctcccatggagtcaaatcttaggcaataaagtacatcctacttataacgctgggagtaggaattgggactttaaactgtgttgaaaagggtgcttggagaaacacaagagtataaatatgaaaagctgtaaaaaatgtcatcagctcacacacaggttacaaattactcacaggttgttctccttggagccatagggttcagagcaacactagccttagacacaggcaagaggggcctttgaagtttgggccccacacttttaaagggtcccacacttttaaagggtcccactctgtcaactgttcccttctttataggacaagaagactcccaagtgaaggggatatatatacccagagcctacagaccccctcacttctagaccacgctccgagatgtcagactccagaacattctgcctagacagctctgaactcttatcttacttccaaggtctgtgtggcctctttccaggtctggcttcccaagaagaactagacaaccacctgtatactcttggatgttcggtgggggtgggagtgaaaaggctgctatttgttggaagatatgaacagagcttgagctcggaggttagggtgtccatgtagaagcacgcaaggcccctctctttatgggatggagccagcggtggggagaaaaggggtgtaggggcccacacttcctgaccagtcacattttggcacagaattccaagtcgtccatgagtcctcaattcgaacctggccatcctgttcattatgcaagtaactcatcatcagaggatgcaacgtacttggcttaacagtttgctggcctgatttatcacttctaaatatttagacacatgataggcatgccttcattcatactgtttccccaagccagacaaatgtttgtagtgggcctggttcagagcaggtgcctcacagagacaaggctagataggattgcttccttgcctggtcccagcttcaaaagttattctaatctgttgaggatcctcaaaggaaaaactattttaaaatatgcggtttaaaatgaaaattgtgcacagtattttaatgtacaattactccatgttaagctcctgtggtttctgtgctttaaattacctcatttaatgttcccaacaattccatgaagtggacagaatattttattttaattaatgagtaaagtgatgccctcagatcttaaggaacttgtataaagtcattgaaattgccttaaaataaaatcacttttttggtattgcttaaagaaaactggctaacttgtgatagaagaagcccctcaaagcagtcacacaatatgaatatgctaagtctttaataatagcaacagctctccttcatcagaggctaacatgcaccagccttcttcaggcctcacatccatcctgggaggaagacgttatataaattgcccaagaacatatggctagtaaacagcagagctcaagtctggatcacgtaagggccccactgcactctactacctttgctggtgaaaacaaacaaacacagtagaattcaaaagaagctaacagctgaatcaagcatacttggtcaaagagccactcaacacaaactaaatacctttccagctttctacaggagagaaacaggcaatgttcctgggaggctgcaagtatggctcataagaatgtctggaattatctaatctaagctttctaaagccatctattgttggctgttaaaattatagcatgttctgccgtctcttcacgttaccatctccttacttcccgtgcaatctgaagcagaggtgttattcctgtttatgaggtgaagacgccataactcagaaagccctaccctagaaataccagactcaggaccctagagcttcatagccaatagtctcatagcatcctgccatcttttatgatgtacataaaaaaatagaaatcacagggagaatggcctgttcaagtgacctttactagactgtgatatcactcctcacccccagacagatagcacacatgaggtagcacaggtcaatcttagcagacctggttccttacctgttaggataagacttaacgcctagaatttcatgattattacactagttactgcatgaaaaatgctcaagacagagcagaaagcatgaagggtaaggtattgttgttgacattttattagggaagtgaaactcttatccttaattcaaaataattaccaggtttcaggaacatggagcttcccactatgaatccctaatccaaacctagatcacaaaacccagaaacgggaaagcactggacagaggaatacagtaaaactgcgaagctggttacctgaattgttttctcttctgcctccagtggacttggaaataaagttcagcattaatgatgatgttgcatttaataaaacactggtttcatgactcctgggatactgtgtgggcaatacttcccctccaccctccagagataatgaaggcgaggaatccaatttgaactccctgggagaatggcaggaaggctaagctacatttggcactatattagaactttccctataaaacaaggacactggttatatcagtttcatgggggtacagttgtaaggtatcagcatagggcatttatagatttgaaatccatggttttccatacctatactataccagcagctttggtatagaagcccataggtcctatgggctagccaagcttcacatttctcaaatagctttggagacatattttagttgggtggagaattcattcagaggaggaagggaagtgtggaaaggcactgtcgttcgttacacttactatttccatcctgttatgggggcagtttcccctatgctccagggttccataggagcagacctagactgcaaagtgtggttacagacagaaagatccatgcctttccatgttgggaagcatcaactaattgtatccttaggaagtctgtctctataccagttatactgccctgccctgcttgagaaaagcaaagccaatcagtttttctgcaggcaagtggaaagtcagagaggagggcaagtaccttctataagccagaaatggtgggaggggggtgctagaaatcgctaggaaagaggtctagtgtccccaagaaatctagggcagctgcttaatgtaagaatggtccctggggtgggaatgtggggagaaggaaaagcaatgaaaaggccactagagccttaattgaggaagacatcagaatgcttgtcacctaagctctacaccttctatatttgaaacaggtatttcccagccaggatagtacaaagtgtataaattgggcaccaaatggatgtgattttgaattctccttttatgacttcccacctgaacaaccttgaataagtctcagtttccacctttgcagtatggaaacagtgggaactactccctaagtctgttaaccaataccagttccttctccatctagtcccagggtggctgggttatattgttgacctattaactggaataaaaggggaaaaaggagaggacaagatatattagaggaaatcaggaatgattttatggttgtcaaaagcttttaggttcctagagacactttgactttcctgggcctttgccctgggaaaaaaattaaagaggtttcaatgctcgtgtgcattcccacattacataggggagctgccagtcaccagagtttgtttgggtaacctcagaaagaggccacagagacaaatctcctcccagcctctggcagacatataatctggagttatttatgccagcattccttccccaataaaaaactctctgacctggcttgaatttttcttgacgctttcaattaaggaaataacaaaaccaaccctgtcttatacatggttaggtctggcaaaaatggactcagctaattacaaatttggccctggcggttttcttaagatgccctacaggcctgggtgtgagtggttataaaaatgaatgagtacaattattttgcaaaccagcctaacagtttagttcacattgcttctcgtctttcctcatcaaatcaagcatttgaattgcagagaattatcttccacatgtaagaaaacatatttctaagcattgcaaaactggttccttgctgtattctgatgcattatcatctggttgaagtcacatatctgtctatggaacatgacaaggacaagggagaacggtgctcacattaggttctcttcaaagtgacatgcagttagaaaacatccacttacccctattgtagccaaggctactagtacttaaatgctataccactgaaaaagtaagtggagacatcaatttttttaaataaatgaatctgaagtaccaccgaatatagaaaaaaaccatatctattgttcaccaggttggagagtagctctttcctcatctaactcaacacgttcaccctgaaggatttcatctgctcctgggatgcaagtcaccctctccagtccagatttccctcttgatatttgaatttgcatgctcacttttcaccagtctctcctctttcatggtttagaaatgcaaaccaccaaatttggtcaactctactaggtgtctttcagatttagcctcctctcctcactgatatgccgcttgttcaggccaccattatctccagcctccatgactaaaacacctgccctgttcctgtctaattttcacacttcctgctacagaaatgatttctaaaacactttcaatgcctttatattgtcttcagtgtgatattaagactccttaaatggcataattggctaaggtgttatgtagcagcctaggttctagttctatgaacgttcactaccccttctacctaggttggccacttcaaatacagcccctctcctctccagccttggaagatgagtaagagctcagctttggagacagacaggctgggaccacagcccaccttagctacttggtgcctatgcaatgttgggagtcactaaatgtctctatctgtaagatgaggataatggtaatggtaatgcccttctcctatcactgtgaggagtaaatgagataatgggtgccaagcactcagcacaggcctggcatatagtaagcactcagtcaatgctggctactatttcttttttttttttttttttttttgagatggagtttcgctcttcttgcccaggctggagtgcaatggcacgatctccgctcactgcaaccttcgcctcctgggttcaagcgattctcctgcctcagcctcctgagtaactgggattacatgcatgggccaccatgcctggctaatttttttgtatttttagtagagacggggtttctccatgttggtcaggctggtcttgaactcccaacctcaggtgatccacccgcctcggactcccaaagtgttgggattacaggtgtgagccaccgcgctcggccgctggctgctatttcaaggctagtactcaaggttatctacacctgctgtactcagggtccccataatcacaccaaattttatgaagagatgcctcctttgagagggtaaattacaaaaggcttctttatctgggctgcagacagtgcttggcatccccgctcgtgccagactcctactcatcttctggaattccccccagatttactcttgccttcttttactcacccaaactcaatatggcaccccccccttgctcccacagtaccttgttcacccagcaatatgacacttatgacacttattctccatgttgcttctcctgactacttatccccatctctctccctacccatctcctatttaggctgggttcctaaaagccagggactgactcagtcttgttcacagttatatcactcatgtctttgcacaatagatattcattgaatatttaccaaattaatgattatcatccttctttctccaaataactcttacaaacctaaatttcctgtcactctaccatcaaacaagtggtttgctctatattttggtgacattcatactttctttctccatcacctgcctttttacttctactccccccaaacccctgcacacacacccctgaaatccctgtgctagatggaccatccaactctatttttgtttccaccaaatatttttgagcacctactggtgtcctcgcacaagattggatgtaaagcctaaaaccataaaaaccctagaagacaacctaggcaataccattcaggacataggcatgggcaaagacttcatgactaaaacaccaaaagcaatggcaacaaaagccaaaattgacaaatgggatctaattaaactaaacagcttctgcacagcaaaagaaactatcatcagagtaaataggcaactacagaatgggagaaaatttttgcagtctatccatctggcaaagggctaatatccagaatctacaaggaatttaaatttacaagaaaaaaaaacaaaaaaccccatcaaaaagtgggtgaaggatatgaacagccacttcgcaaaagaagattctaatgcagccaacaaacgtgaaaaaaagctcatcatcactggtcatcagagaaatgcaaatcaaaaccacaatgagataccatctcatgccagttagaatggcgatcattgaaaagtcaggagacaacagatgctggagaggatgtggagaaataggaacacttttacactgttggtaagagtgtaaattagttcaaccattgtggaagacagtgtggcgattcctcaaggatctagaaccagaaataccatttgaactagtaatcccattactgggtatatacccaaaggattataaatcattctactataaagacacatgcacacgtatgtttattgtggcactattcacaatagcaaagacttggaaccaactcaaatgcccagcaatgatagactggataaagaaaatgtgccacatatacaccatggaatactatgcagccataacaaaggatgagttcatgtcctttgtagggacatggatgaagctggaaaccatcattctcagcaaactaacacaggaacagaaaaccaaacaccacatgttctcactcataagtgggagttgaacaatgagaacacatggacacagggaggggaacatcacacctgggcctgttgaggggtggggggatgggggagggatagtattaggagaaatacctaatgtagatgacgggttgatgggtacagcaaaccaccatggcacatgtatacctatgtaacaaacctgcacattctgcacatgtatcccagaacttaaagtataattaaaaaaaaaaaatactcagagaagttccaaatgctgtatataaataaatacaaatcttatatagaaataggatttggaactatatacatgtatataaacataaaaatgtatgtttatatatgtctataaagagtgaaacaattaaacttcttctataaaaaaaagagtagggataaaaaggcatataaggcaaagtcattgccctcaaattgtttacagtaaagtggtgaaggcaggtatataaataagtataattccatgtagtttgtactgcattagaagtatatatgaagtatacagtcagcacaaaaagatcaagagttctgagtagaaggtcaagaattgtagcacagaagacacaatcttctggctcaccctactgagaagaggtgatatttaccaatgaattgcagaataggagttcactaggcagcgagataggaaaaggcattacaggcagaggaagccccatgtataaaaagtcacataagcacaaaatagcagggaaagcaactaattcaatatggcagggaatgtgagagggactggagggaacagggaaggctagagaacaggaagggtctaatgacaaagggaagaagcttgccctgagtgctgcagcattttgcttagaggatgttaaagcaaaggaggagattctggcagctgtgcggaagacggactgggatggggggccaggtagacaaagagacatcctaaggaaactgaggcccactgctaacacagttctcagtgtgcttaagacgatttaaccttgtggaaaatactgccaggaggatattttctaaggaatttgtttaccaaagaatctgaacccaatgatgaaccaatctttcgctaacaaagctagagaactcagaaccatctaagttagcaagtgttaaaacactggaaagcaaatgtggcaacagcactttcctatttgaccataatcaacatcaatgtggaaagaaaacaaacctgaaagcaagtgaggaaaacacacagtgggtttctttgctttctctccaggacactgtcagtacacagagcatttagaatagctgatttgatcgttgtgaaaatctacctgcgtgcccctctctctctctctctctctctgaatgcaattagagaagacagcttcattcacactgtgtctaaaaatagatgatggcagagttcacagactgacagctgcattgtcatacagtaaccaggaaaggaaagggatggctaatttaacttaacaacttccaaaacaaacagtgcagagggagtccaggataaagaaaaaacacacaggtcagttcttcaaagagctggcagagggatggggtcgctccatggcagtttattagtcctcccaaaatcctgacgaaaccagctaagtattttgcccagatctacccagagtccttcagacaagagctctggcagatgaaccgctacagagattcaggcaatattaggcagcagggccaggactttccctgctgacttcttcatacatcccctggacacaagtaagctaagaagagtcatgacgtttttctaggcaagataaataaatgagttttttccccctttgccatatctaaattatactctgcctagcctggggcatttaaaaaaaagttatccaggaaataaacatgcatcattaaggggcagaaaccaggtgtctaaaagaagcaaaccatttctttccctcccttcagtcctaaaatgttttctgttttcctcctcagtctgccttgcccagggaagggattacggttgggcttcaaaagaaacaagggaataatgcctgtggacgggtagcagattctctctgcagctctcccgcagctccatgttggctctcagcgctgctgccagccagctaaatgtcagatcacggcaccccaacattccctcactgcatacctccatcgccctggtgactaagctgtttcaacagctgtgttattgctggagtcaggccagtgttattcacacgaagtatttgtttcatacggcttatgtggggaattattgcactcagctttggggttctatttaaagataaggtccttcccttgatcaatcagccaggacattcctcgagttgggctccaggagacagtgggacaatattctactgccacccggggttccagataatggacagattcataatactataaagaaggtggatgaagcatatgtgtgtgtgagagaatgggaagcataatggaaaaccatgacccttggtggagctgcggaagaactctgctgctcctccctcaataaaagccacccacaacacaagagtgttaagctggactccctttctgctcttcttctccagccatcaccctcagcctttcccttaaaatcattgctctttcctttcgggtcacgctagcactgttgcgttggtctctacatgcatcactccacacacctgccccgaatgccatctcctccctcagcccttggcttctcctatctcatcaaatggtttatgaccattgatgttcctatcatgtaggaagcaagttgggcctgttggcctggtgacctcctccactactccacatcctcttctgagtgtgagtaagataagggctgtgttactaactgctgagttaatcaacccaaactcccttatatggagggacaactgggaaaaggaaaaggcattacatccatgagctttatgtcctgtaggtgggactaatttctatttctagctcattctaggctgaatctccatcaaagaggcctactggcctgttctccctccaaagttgttctcaccaagagcaatcgggcaccattttctgatgctgaaaagatctcagaaatatgttttcttataaatgaagtatttttaaaagaaataaaacaatgattcctaagagctcacattttttactgcctactatgtgtagacattttcacccatgcagatgccagccagatggaaaccatcacaggcaatttcaaagtgaggaaactgaggcccatggccatgctaccaatgtgagagggaggcaaaatgagaacccaggtttgcctgactcagcagctcaagtactttccccttatgtctctcagtcatggggtaggaaagttaggacacccgcttcttgctctaaaaaggccactatttagccaaacaatttgagtaagtcactttacataatgtattatttcatgaaatactacagttggatcataggcttactaagatcctttctagttctaatatttcatgaatgtagaaatctaaaacacctccagctgttgactgccttctatacttaaggcactgaggccaaaacaaagagctataaaaccatgcctgtcctcagggcacttataatggagtttgagtgacaaaggataacaagttgagtttgactaatggaagagttaaacaattaacaaatacaaaaataccagagaaccagactacagggcagtgcttgagaaataacaccgcataccagcatgactatacaaggagaaaagtagatttcaacaatggtaacacccctaacccggaaaatacatttgtgctgccagcagaaagaaaagaagagacagaaaacgcttgcaggaaaagccagctactagaagggatcccgtctgtttcacaggaaagctttgtttctgacaagtttcgtaaaggaaaaagtaggctagaacaagcttttttatttccaacccaccttttcttcgttcccatgaatgaggaggggatacaaatgagagcaggcagccagggacaaaaataatatggctggtggttcctgacctcttggattcctgccaacagagaagcctgagaggcaacatttaattgtggaaaaaccagcctggctctcctcttatctttttcctctgtgacttaaacccacaattactggcaacccctagattccgagtcacccagctggtggtggcagcaatggctgtgtctgtagctgaaaagcaaaagggagtcagattttacctgcctccgaagccagccctgggagcacagccctaacccagcttgatgacttctcccattaaaaggttcacagatgccctcccgttgggaaaaccaccaagtgagaagtccagatgggaaaaaaagaaacacgattttcagctgctgtataattcaaaggacaagctacgagtctcaaatcctgaattccacattttatttcagcactagagatgtgatgttcaattccttttcttaagaaacaaactccaaatttcttagctggtcatcaaggcaactcacctaccaggccctctgtctttcagcagctcatcttttttctctaatatggacacttttctacagcccaacaaatgggcttaccgtcctttgcacatatgttatttcagagcatttcatgatagaaaaatatggtcttagtcctcactttctcacctagaaatcactttgaagaagtcacttaacttccataatttcatacttgtttaaatttaaaactttttctccagtaacagcctcacagaggacagtagagatttaaccttgaacatctagcattgagcctgcagaggagatgcataatcaacgtttccttctctatacctaatgcctttgctgagttaccttcatccaaaagaatgttcccattgctaactcttgtcctgatcttttcttaccactcttccactccaagaggttgtctcccatacacctctgctcccatcttaatattcttccatttcaaaatattttaatttacatgctgctatgtttatagtcaaatataattaaatcatgcctgtgggcacattctcctaaggatgctaagaattttccacatcttctattttaggactttatccaattgcttcagtgctgatcagcatgcattttggtactcatggggcataccctcatcgggattcataaacctctgaattccatgggtgagcttcagggcttccattgaaatatgaatactaaatgtgcaaatggggtctatgcatatttgtctcccaaggttaaagtccttgacctgaagttaataaccactgtccggaagtaatgaaaggcctgtggctaacatccatggacggggtcctttttctgaacactcagccctgccacctatgtttctgggcttctatgctctctctggaacacaattcctcctttctattcaagtccgagaataataactactcactcttatttatttatttagagacagaatctcaaccaggcaggagggcagtggcgcaaccttctgggcccaagcagtcctcctacctcagcctcccaagcagctgggactacaggggcacaccaccacatcctgataatttttgtattttttgtagagacagggtttcaccatgttgctcaggctggtctcgaactcctgggatcaagagatctgccctcctgggcctcccaaagtgctgggattacaggtgtgagccactgcgcccagccaactattcacttatattgagcatttactatatgtatccagcacttactatgtaaaagcctcacatacactattctagtttaatccttacaacaaccctataaaggtagtactactattctattttataagtgaggaaaatgaagtacaaggaagtttcaaaaacttccttgccaagggtctcataatttataagcagcaggccaaacattcataatttatgattcagcccaaacactctggcttgaaagtacttaacccagtgctggagttgtctctccaagctctttcactttccagaaaaaaataagactgcccttggactgtttctttgccttcacattgtaagtgatcacagattccaacgcctttaaaactccacctttgactcaatcaaaacatttccttttccgtgagttaatcatttccccttctatgtttatggactcctttgggtacttaatgcactgaacacactggtgtaattttttaattctctctccatgaattagactgtgagctcctaattattttgagtacacatggaatatttactgtgcctggaattgtgctaaggatataacaatgaacaacacagtgtccctgcctttaaataattcactcttaggccaggagtggtggcttacgcctgtaatcccagcactttgggactttgggaagccgaggtgggcagatcacaaggtcaggagtttgagaccagcctgactaacattgtgaaaccccgtctatactaaaaatacaaaattagctgggcatggtggcacacgcctgtaatcccagctactcaggaggctgagacgggagaatcacttgaacccaggagggggaggttgcggtgagccaagatcacgccactgcactccagcctaagcaacagatcgagactacatttcaaaaaaaaaaaaaagaaaagaaaagagaaaactaaacaaaagagggttatgatggtttctgaaattgtattatgaagaataaggacttatctttatttcttaaatcctgagcaaaatgctagcatgtagtacaagtcccaataatgcctatcgaatgaatgaatgaaattgggaaagggttttcagatactgaactgctaaactgaaagatctaccatcccatcatgaaactctttgaggttatttatacactgactcacctaaaaactgcttcctgtgttggtgtctatgatacattttttaatgtcagactaaaaatacacttccagtacaccaaccctgtctgcctacctaaggagtagaaatgaacacaaggtcgcatgtaacaaaagaaaagaaaattcactcatttcaacactaagctcaccctctaacaagagcatctgtcttgactgagcactatcttctagaatggttttcacttgagggtctctgaagtcatctatttacaaaaccaaaggataccaatgagattttttataaagtcagagaatcttaagtgagtcatggactctcaacttcagagagttagagtagatgggaccttaggggtcgtctagtataatttcccactcagaacaggaagcactccatagccctgtcaatagactcatggtgggatcaaggcactggagtcctaacatcatgtacactcatagcctctcgacttcccagctgggagactggcaaatcatgtaaactctgtcatcctcagtgtcctcactctgccagatataattgttccgatgatcagatgaaataaacgttgtcttaattagcgaacatttgtttgcaagtaacaggacttcacccccactaacttaaccagaaatcagctggagggatacaggagtgctttaggaaaatcaagggcagaaaatgctgagaagctggagggtctgaaaccaggaatagaaagctgtcaggaggaaagtcaactcttatagtctattgtaattacactaatagtcttcatctccatttcctctttgcatctggtcttcccactctgccagtcaacaatcacggcttctctgtgcacgtgtagaatgatgactgcccaggtggctctcatggcttttcagtttaagtgctaataaaggtagatctcgaattactgaaacacaatttcttataagagagaatttgattgcttcccctttggccaagggaccactgctagtctgatcagttatggcttggggactgatcatatggccagttgcccattcagtagaggtggtggaacatgctgagggagggggaagttaaggccaagttcaggccaagcaaatgactgacaacaaagacaagcaacagcatctctagtgcgatggtactttgcaaagaaagcactgccccatgccagctatcactgtggccatccttatgatcctcaccaaccatcttctgcttgaccactaccagtaacaggctgctcactactggtagaggcaaccttttcatcagcaaacaacttcagctattagaactcttttccatgtgacagcaacttaagatactaaactgaaatatttgtaatcttctcccaagccttaactttaatgaaggcataatcttgcttgttaggtcaagcctgggcttttctttctagtcaaaatatgaataatgggcaaagcaagatgttgaggaaaagctgagtgttgggagggaaactgaggcagggcttgcataatgtctttgggaatgtgtctagacttgctggttccttacttctagccctcataggctcctaggctcctattcccattatctcaagtagcagaacatgttccatataaatgctaaaccatcacagctgtagatcatgtgcctgctcttttgacctccacattttcaccacctgtttctttgttggattaccaataaatagcatgggctcccagagctcagggccttcacagcctctgtacactagtgatggccccctggtgtcccaactttctctctcaaactgtctttttctcaatcctttgactctgctggactttgtcacccccacaacctggtgttgggtctgatcaccccaacacaagagagatagattcactatgcaattattttagcaaacaacctggaccagaacaaagccagaacctcttcttcctataaagaattactactatctctctactaacaccattactaatgactcactaaagcaaaagaggatctggaactgtttctagcatcagtgtgtagacaataggtagggttggggaaaatggttttttccaatgtagagtccctagcacttttgcaagcagaattctgccttgctctcatttaacttccttttgcttagaaaaatataatccagaaaataatcttaacttcatttttttaagttaaccaagataaagttgtgaattccccataaaagaacctcataatagctatgttatgaccagctggcatttaaatactgaaagacccaaagttagaagaggaggtgaaaacaaaaaaataccttctatacattgggggcaccattaagggatgtgctgcttctggcttctctgctcttcacattagtcaatgatgtcaccaggtttttattttagtaatcaggatatacttgtatggatgcaaagagaatatcctcatttatattctaaactcagagcaggaaatgagacacgtgggtgatctgcagctgtggcactataaacagggccagcctaccacctagtctagattctagactgcacttcattccctgaaatactgattgggagattttaaaaaattgaaaatatatcattttagaaagaccagtgcatcttctgtgcaaggatcttagagtccgctgtttggtagaaggctgactcacctgtatggggtggtgcacgtgttgttaggtaccatctacctatctacaccactgatgtacaacgaggagatcctgccctggctccagccagctgtgccaccgtgggcgagtaccacagagttcaagctttctccagctgctaaattaaaggattagtgctttaacttgggtcaaccacccatttgcaaacctgacaagaaccacaaacactcttacttcaaaaatgcatataagcaaataccactgaaattttatgtagagtatcaaggggttctcttagcccttacactccagtctaaactgcttggttgatgattgttagaccagcagccctctagtattcctttcagcactccaagctaaaataaaacagctgatgtttagtaacaatttctgcaaattattcaacaccatagaagagtgttttgttaagactagagactaatctaacacaatctactcaacaatgttaaattgaccagtaaccaatagatgactagaagaaagtgtatgtaactagatataccaaactatagatactaattttaaaatcttggaaaggttttggaggagccctactgtttctgaattggaatttttcatttgcaaatacttaacaaaacccaccaagccagatagagctctatagcgatgcctatggaggagccttataatgatgttgtccaagtaatgtgcttaacaataatcacactcaaagccaaaggttcccatgctcctgccaatataacatgctcacaacggtcaattccaaaggaagagctgtcaagaagtgcctgaagatttcctcaaagggagagataattcatgagcaaacaaacatcatgtccctaatcttctctatcctggggtaaacaaaatatagttttctcccatgatttcagttgctttctataccaagtcagtaagtaaaactgattcatactggtaacttccaggttccagccttggtttgaaggggcacacaattcaataagagtaaagaagactggccatgtaagcccatcttgaatactgacaacttccgtaccatttacctaacactacaaaccctactccatttaagtctctgagatctttttgatgtattttgagcttttcaacttgccttttttggtgggagaggagggaggaggagaacaaagggagaatttgaagtttttatttctgcttgcattgactcaaattgtggtaaagaaacttaaaaggtaactttaaaattctagtgacactagccaacaatgaaaactatctaattagaatgttagaggttttttttgtttgagacagagttgctctgttgcccaggctggagtgcagtggtgcgatctcggcttgctgcaacctccacctcccaggttcaagtgattctcctgcctcagcctcccaagtagctgggattacaggcacacgccaccatgctgggctaatttttgtatagacagggtttcaccatattggtcaggctggtcttgaactcctgacctcaggtgatccacccacctcagcctcccaatgtgctgggattacaggtgtgaaccactgtgcccagccaaaatgttagatagttttaacacaggctataacatagtcataaattaaagaagacatggtcgtaaatgaaagaagacctctttttggtgggagtagtagtaggggtgggagagtagagttatacatttcttcttagcagttgcttcaacatattttattaataaggactatctgctgaagcacagaaatacaattatgtgaatatcatactaccaatggcctgttccatcatagcagggatagttcttatagtgtataaaatcctctgccccattcagctctctttatggagctttcctcagaagcatcagaaaacacagaattaaatatcacaattcttgttgaaggccaaaaattagttcccagaaggattctttgactttcatccttctacaaattcacccatcaccattgtagataatgtgaggggtgaatttgtagaaggatgaaattcagagaattgtttatgatcaatagattgttccctttattccagttgtcttcccttgatgtccacttaacattccataataaatggacaaatggaaaagcacaattactctgccaaaagtcagtcaacattctcccaggacactcagccatctaacttgaaaactgactggtaataatatcattctaattactttaactagaaatttgttatacagaaatgctttcagtgtggggaaagaaaaatcacttgccacttatagaaagaattctgcttcatgtgaccatttgcaataatgaaacaagtaagacaacactgggttccagtgtacagcacaaggatcaaggcgaaacataatgctttcattacgtaagaataggactgacattattctggctttcccctacccttcatcatttaccaatattttttcagtctcaggaatttttcaacccctgaaactcctagatttactactcaagacacagctatccatcttgaggctttctgccaatggctctagtgcttctatttcaacagcttatagatttgaaagctggaaagagagatatgtaaacaaattctctaactttgatctatgcacccaggtttctcaaaagaagcccttggagagtctggggtatactaagtgtatgacttgcagttgtaatcattagagtgacaacccatttccagtgggtaccgttttagccaacccaaacctttcttttcctaatgcatagagtgactttttaaaaaatggtatatttgggaaagtattttagaatggcatgttaacaaaacaaaaacactctagaatatattttcaaataacagaacttggccttaccaagaggtctaataccatcaggtaaataatcatttttatcagtgattcataatacatccagactctaaatgttaaggctgacttttttctgacactcttctctgcctattcatactccatttcctaactcctttagagtaaaaattgaaatcccatatccctaacaactagacagaagcatcatgtttacatcctgacaaattcattaattctgtacctctgaaatatttagcaaaaagccagcactgactcaatcatagatttccacagacaggtctgttcatatttgtaattggtattcactgaaaggtcaatgactcctgttcccaagtatctatgagtctctagattttcttaattggcctcttttcctcagctcttacagactattgttttaaaactaccaccatttagaagttgaactccgagtgaggggaaaaacaaacaaacaagcaaacaaaaaaaacactttttgattcccactccactcataatcaacataacacagactacttctgacccaggtgtgatggaaggagcggggcacagagtcgggggaggtttctccacacaccaagcaagcaatcaatcacttccacagcagacatcagctgggtgtccaaaaattcaattttgacaccacttacctggaaatagcatcaagtctcataggttgaaagctcagtcccataagactgctccccacttcagatgcccatcgaaaaaacaggttgtggcctgttataaatacgcgttcccatgaccctcctccttaggattgattgatttgctacagaggctcacagaactcagggaaacacttaacttatgcacgttataaaggatatgacaaaggatacacatgaacaaccagataaaagattgatagggtaaggcatgtggtatggcagggatccctgaccctctggcagcagacaggtaccagtcagtggcctgttaggaactgagccatatagtagggggtaagaggtgggtgagcaagtattatagcctgagttctgcctcctgtcagatcagctggcattatattctcataggagtgggaaccctattgtgaagtattcatgcaagggatctaggctgcatgctccttatgagaatctaatgcctgatgatctgaagcggaaccatttcatacccaaaccatcccccatcccctcatctgtggaaaaagtgtcttccatgaaaccggtccctggtgcccaaaaagttgaggatggctatgataaggcacagagcatccctgtcctctctagggtgccatgctccgggaacctctgcaagttcagctgtctggaagctcccagaacccagtccttttgagtttttatggaggcttcattacctaggcatgactgattacattattggccataagcgagtgactcaatctttaggcctcttccctcctggctgttggtgggtggggctgaaattagttccccacccttctaatcatgccttggtctttcaggtgaccattctgaagctatctgggagtccccagccatcagttgactcattagcatgcaaagaggcattcctatcactcaggagattccaagaattttagaagctgtgtatcaggaaatttattactataaagtaccttataatgccatcatttttctcccaaaggcactggcttgattaaattcagaaattaaaacaatggccagcttctatagtgtaagtcaatgcttttctagttttctgagggtttggaaactcaaatcctagctaaaacctgtatcacttttaaattgaaaaatttaaagggaataaacatttaaccccaagtgactagaagtcatttaaaatatgtagtacttagattattttatctactcaaagactcttcaaaagtagatgaaaacactaaccagatatatattataaacccaagctttaatttcagagcccaaacatgaaatctcttctcattgtttgaaatctgaaactcatttcaaagactgccacgaaaagttaaaaaaaaaaaaatggattggtcttgacttttccttacatatgaagtaatattgttacaggtgaatctctgataagcaggaagccatcatgtgtaataggatcttgtttgccacactcccaaactcttctctgaagtcctgttcattgctgtcagaaaggaatccaaagtaatgataaacaatataaaaagtagagagtctcatgcattcttaataccaaaatcagagagaaatctagacctgatgtgcctgttatactaaaacatgtgtgtatatgtatattgctgaatatatataacataatatatataatctgtataatcaatgccttgctcagtgtccataagcaaaggtagagaggataaatttaaggaaatgaatattcccacaaacacaacatgtaacttctcatataatagttagcagctggccaggcatggtagctcacgcctgtaatccccgcattttgggaggccgaggcgggcggatcacaaggtcaggagatcgagaccatcctggctaacacggtgaaacctcatctctactaaaaatacaaaaaaattagccgggcgtggtggcaggcgcctgtagtcccagctgctaggggaggctgaggcaggagaatggcatgaacccgggatcgtgccactgcactccagcctgggggacagagcaagactccatctccaaaaaaaaaaaaaaaaaaaaaattagcagccaaaatgtgttgctgctactcatgaaaagtattttttggtgtggttttcttgatagctctattaagaaagttattttatacatttatcaaatgaataattagtggtccatcttgttaactttttagtatgccccctattaagtgctagttctcatgttataagaaaattaaggattatttttaagtcagaaagcttgagtacagtatttttgtagatgaagataaaatattttaaagcatgaagatgtacatgagaaaaaaataagacattaatatttatatatagaaatgttttaaagctttgccaacatgggcatttttgttgtttaggattagtatttgctgggaagtaattcatctgtgaaattatttaacatgtagaattatttcttagtttctggtttgggagaaatgctcaagagttgagcttaaaatcattttattcacactgctaaagctgaaaaatgtaaacagggagctttcaatacatttcaaatgagtttggagaattctaaaatattcaatccatttataatgaatacaaaacatcattagaaactggcaaaaaaaaaagtagctaaaagtattcgagttatttcacattactgggaaagtttcttttaaaaagttcagttataaataacattcactaaacatatttatccttttttcaattttggtggtataattttagaaatttatcgttgacttttaaaatttcacctaaacttacctgaggctctgcattatgttactcaatgattctgatgccaagttttgaaatcaaattataggccagtcaccttcagtgatgtaaaaggtagaaccacaagataatccagcactttcctcacaacctgaaaacggaacctgtggcaagtacctgcccaagtgtcagactatgctctaaacaactgcctgtcatgtaacaggctgctcgaaagcagcaacatactactcctatagtcaattcttaacttcttaaccacaatttcatcagtgtaaaaaatataggagcagtggggaccagacttacatatactgaaatgttaaacaacagaactcttattttgaagtgtgggaggggaggaagcacctcaatcagttgctttatgttccttttagtggcagaagaatgatacaatccagtattttcatccacagctccctaaacacaaagctgtggatttcataaatgtaaatatactgcgtaatctgcccactgggagttcatagtttagtaaggactcagagaagacaatttcactgtgcagaacacaaggctgataaagtaaacatcacaaggccagtaatgaagaatgcgtaaggaaagacagattatatccaggaaggaatgaggacgggagataatatagaaaatacctaggaaggctccaggggaatgtaaaatttgggatgttgtgaagaatgagtaggtttatctgggaggagcccttcatttgtgagaagaggaatcacaagagaggaagaggcaggcaggatcaatatcagcgaagacgcaaagggagaaactctctggatgtgtttacagggcaggaaactactccttttgaggatgcagagaatggttactggccagcagtgaggaaggaggctagaaagaagccttgagccaggaagcgagaggactctgaacaccgagtcttatttgttagtcactgaagatgttttgagcaaggaaatgataaattaaagctaaaagagtctcctccttatcagaggtttcaccttcagtggtttcagttagcagaggtcaatcacagtgtaaaaatattagatgaaaaattccagaaataattcttaagttataaattgtgcactgttctgagtagcatcatgaaatcttgtgctgtcccctgataagaatcacccctctgtccagcatctccctgctcctgcctgttagtcacttagcagccatctaggttactagatcaactgctatgtattacagtacttgtgtgcaagtcatccttattttctctcattgccccaaggtgcaagagtagggatgctggcatttcagatgtgctaaagagataagtcaagtgcttcctttaagaagatgaaagttctcaacttaaaagaaaaaaaaatcttatgctgaggttgctaagatctacaataagaatgaatcttctgtccttaaaattgtgaacagtatattttttctttcattattaattattgttgttatcttttactgcacctaatttataatttaaactttattctaagtatgtatatatgtataggaagacacatcatgtatgtatatagggttcagtaccgtgattttaggcactgggtggtcttagaacatatcccctgtggataaggaagacttacctctaccacgtgcttcttttataaagactaatctcactaaccaaggtgtagaagtaagaattggaaaaatggctgaatttcagcaataaggataaatataattggataattgtaatagctacttttaatttttaactgttttaatagtacttactatgtccaggctgggtgcagtggctcacacctgtaatcccagcactttgggaggccgaggtgggtggatcacctaaggtcaggagttcgagaccagtctggccaacatggcgaaaccccgtctctactaaaaatacaaaaatttagtcccagctactcaggaggctgaggcaggagaatctcttgaacccaggaggcagagattgccgtgaaccaagatcatgccaccgtactccagcctgggtgacagagcgagactccgtctcaaaaaaaataaataaaaaataagtacttactatgtcctaaaagttttacataaactaatttattccttagagtgagttggttaattaggcattattatccatattttacaagggaggaaactggctaagagcggttctgtaacttccccaatactgcagagcttttaaaaagtggcacaaggatttaaacccattgctgtaggactcctaagtccatgctcttaaaaaactttctatcttaccccctaatctagatataaatcagggatcacatttcaaatgaaactgtgactccattgaaaagtatgccagcaggtagtcagcctctaagatggtccttaatgatccccatctcctggcattcatgctcttctgtaatcacctcccttgagtgtgggttgaacttactagttcacttctaaccaacagaatacagcagaagtgatggaatgtcgtttgcaagattcagcggtttccctctccagcactgctcaggctctctcttggctcactatccctgggggaagcccgctgccatgttgcgaggcagtcttatggagagacccatgtgggagggatggaagcctgccaacaaccatgtgagagagcttggaagcagatcccccttccccggtggagccctcatgcctgatgagactgcagaccaggccaacagcttaattgcaaccttgagagagtttgagccagagactcccaaactagattcttgacccacagaaatgaggagctaagaaatgtttataggtggccaggcacggtggctcacgcctgtaatcccagcactttgggaggccgaagtgagtggatcacctgaggtcgggagttctagaccatcctggccaacatggagaaaccccgtctctactaaaaatacaaaaattagccaggcgtggtggcacatgcctataatcccagctactcgggaggctgaggcaggagaatctcttgatcacgggaggtggaggttgtggtgagccaagatcgtaccattgcactccagcctgggcaacaagggtgaaactcagactcaaaaaaaaaaaaaaaaaatgtttatagttgaaagctcctaacttttagggtaatttgttacccagcattattaatacagtcagtagacagtaattatttattattacagggtaaatctttttctttatacttggagctagaagtagggatctgtctaggagagattatacctgaaataaccacaaccagcccaaataacagaataccacgtcctttacctttccacccaaacatacataaatcaggtaatctacctatctcatcctcccatggctcttcttgttgtccttattctcctttgcttgaatgcattcttaggaatagaaatgctaaaacccaaacctgcaggtttcaaaaaaaaatttttagacatacagttttgaatctcatagcaaactctttccttcccaaggctcctcacattacattgtgtattcttattatagcacataacatgttttttcttatttgtaggtttaagtgtctgttttccaggcaccctcttccctaacccgttacaagaatcatgtctcgtgtgatcttatatccccagtactgagtgttcgtatggctgggacttaataaagtttaaatgaactcatgaataaatgtgttgcacaaccaatgagtgagtgagtgaacaagtgagtcaataagcaagagtttagggacatgggaaccaccacttaaaagcttgaggctgttgtgcaaatttggaccttcatataagccatttccttctatatagaatgctctttcttttgctcatcctcacctcctcaccaggcttttctctctttaacattcacctcaaagagctgtctgattgcctctctacaactctccccgccaacacacacccacacaccctaccagggaagtcttccttttctctgctgtgaagccttttctttaagtttccatatcctcctgggcataacttggtcacagcacccagcataccacactgtaatgattagttatttgcctgtcatttccacttagccgtaagttccttaaaggacagcatattcagctaacagcagaatgcctagcagtggtaggcactcaaaaacagtttaaaataatgggcaagagaatgaatgaatgagaaaaagaaaactgtatctagaaaattatctcagcacaatctatttatttcaggtaagctatcagtcaggtatacatagtgctccaactcctaaacagagtaaaaataattgtacatcaagattattacagatacatgaaaatcatatttagaaatagtacttcagatcaggcatggtggctcacagctgtaaaccaaaaatttggggaggctaaagtgggaagattgcttgagctcaggagagacccccataaaattttaaaatttaaggccaggtgcagtggctcatgccagctactcaagaggctgaggtgggaagatcgcttgagcctgggaggttgaggctgcagtgagctgtgatgacaccactgcactccagcccaggcaaaagagaaagaacctgtcacacacacaaaaaaaaaagaataaaaaattacaaaattagcgtgcctgtagtcctagctattcatgaggctgaggtgggaggatagcttgaacccaggagttcgaggatgcagtgagctatgattatgctactgaactccagcctgggccagcattcgagatcagcctggggaacataggagactctgtctcttaaaaaaaaaaaaaaaaaaacagaagaagaaagaaatagttttcaggccaggcacagtggctcacacctgtaatcccagcactttgggaggccaaggtgggtggatcacctgagatcaggagttcaagagcagcctggccaacatggtaaaaccccatctccactaaaaatacaaaaaaaaaaaaaaaaaattttgctgggcgtggtggtgggtgcctgtaatcccagctacgtgggaggctgaggcaggagaatcacttgaacgcgggaggcggagattgcagtaagccgagattgagccactgcactccagcctgggcaacaagagcgaaactctgtttcaaaaaaaaaagaaaagaaaagaaaagaaaaagaaataatgtttcaatctatggacaggccctagacagagctgcctttaacacatctttttccctttccctcacatccttgatcccatctcagtcaaaaaggaaaaaacaaaaagttttcttacttctcagcctaagattcctgatactgtccccagatgccatacatgtattggcctcccagaaatcacccagtgattttctccccatgaaaagtttatatgtctcatgccctcagagtttttaactgcaaataagctaaaaaaaaaaaaaaaaaaaaaaaaaaaaaaaaaaaaaaaaaaaacgaaaaaaaaacctggtttggtggggaaatgggtgctcatgggttggcatttccattttggtaggcatctttttctaaggccatagctttactcaaagcccagtggaaaaagacatttaaaaaaaaataaaaacctttcaggaaccctcaagtcactccattggggtgaactcccctgtgacactagagaggtggtgaagcttggtggttagggcagttttctgagtcagaaatctcagcttttccactctctagtcttcagatcatgagtaacctcactggtgcccaagtgttccatctgtaaaatgaaataataagactacctcaaggaacctggtgggaagattaaatgggttaatacaggtaaagtacacagaaagtgcctgggaagtagtcaataattgtttgctattactattaccatttttacttttattagaattggctcaaaaagaacccaaagagggcaatgctcaaagggaagaaagggatgagaggagagtacacttaactgatttggttgtttagcttgaaggcaatgtccagctgcaggataaacagcatgaattggaaccaaggactcatctccatgtgggggaggggaatgtgaacagaaaacacgatgtcattggcttcaatttcccttggaattgcctcttcaatgtctcggatcttgtcacaatgattgggtccccaaggcacgaaccattttgtcttgtgatggttcttacgggcatccacacatttcaccgacatgtaggacactgccgttgtgggccctggagctgaaaagagaaagtttgtctgttttagaaaagccatctattgaaactactgtttctggttaatattctttccactgctgtgttccctccagcttttgtatcgccttctacaagtggggctcagcaatacttagggatcttccaaatctgggtgaggatctttcactgacctccagaggtgtcataacagtatctctgagaaccttcccattatgttttcaattgctgtgaaagaatacatttgtaaccagtctagttatacttccccacttcaaaacaatgtcacaaaaaatcaactgtgctacagttcccacctgattgaggtcttggagagctctggtgcttcatagagaacagtatctaaagtcagaagaccttagtcttcaaacctggattcgaagcctggttaaaaacctactgtcagtgaatcttgggtaagtcagttaaatctgtaatagcttcaggaccctcatctgagaaacggaagagtttctaagattccttttggctctaaaattgtacaacattgcttttgcttaagataaagaactaggggacaccagttagcttggtacctagcagagaatgggaactcaaacactgactgatacttcaaaagtgtactaaaatataaacgatgcacttcaagacagcaaagcaactttgaaatgtgtaactttaaaaacactattttgtgattatataatggttatatgattataatattaataacttggaaaatacagaaattttaagttcaaaacaacatttacccaaaatcccactagagggaagtaaccactgttggaaaatgtcaaaatgccatctgtcttttctatgactgtgtaattagataaaaagtttacacatgaattaaattgtgtaactttaaaatatacgcaaatattaacacatatttataaaatagttatatcatgcatagttttgtagtcttttctttttattcacttagaaaagcagagtattgtgtgataacaccagctctggaggcgacctgtctggtgtcaaatcctggctctctcatttttagttgtgtcaccacaaatccacactaggaaagttttgggcaaattactaagcctatctctgtatcggttttatcatctcttagatggcaataataatagtactgatctttccaagtcactgcatattttaaacaagttaacatatgaaagcactcagagtagtgcttgggcacacacaaagtataaaatattagccattatatcatattttctttataattaaaatctttcagttagtagttgcaaaatagtcaatcacacaatacaccaaaatcaacttctccttcatcagtttgtaaaggctatctataagaataatcctttgcctaatatgttttgttggaaatttctcctaaactttccatctgctatctaaatttgtttatgcacatttaaatagagaagttccagatcttatatggaatccctcttttatgtttttccccccatgcttttgtgtttagagaaactgaccttcttcatctcaaaattcaatagtcatctatattgacttctatttattttttgcaatttcattttttctaatatttaaacagttgatccatctgaaaattgctataagagatgcagtgaggttctagttttatttcttaaatatttaaattatagttgattgaacagaccctcccttttgttgatttatcatatcactgttaatctttatgtatgtaagcatgtttctgaacatctgttcttttccatgcattaaactgtcaattcacgggtcagcacaacattgctttgaattttataaatttattatttttatcaatatctgctagagtaactctcttccccaatccatttcaaatttacatctttttgctaggatattgaagattaaattaaatttataaataataaatatataataataaattaatgtggacagaattagcatccttccccagcgtttagttttcccatccaagaacagtacttgtttctccattgtctacaatctgtttttaaatttcttggaaaactttcattgttttctttatgtgggtcctactagtatattttaaaatagatacatctataaacctttgaaagttagtagttaaaagaaagtgtcatcaattatggtttatgtgtgtggtttaaatatgtgtatttctgtgcatctgatacttggtatattatgtttgcagaaattctctcttatttaatagagatcagatagcaatggagaaacatgaaaagcaaaaagaaagttatataacgggaaaaatgtgtattattaatattctgccctacttctaatgttcgaatccacattatttttctattctattaaacatctattttaatgatacatttttagtaaaatgttatgtttgtaagaagttaggacaatgcctattaatacttaccagaaaactcaacactactaagctctagctgaacatccttcatgtagaaggctgaacactgcaatacaagttgccactaacccctgctacagacgtttttctttaaaactcaaaactgtatcacgaagacctcacatctaatccatctaaaatcagacatctgacttattcttagaaatatgagtcaatcaaactttggttatcctgactcagctaaatagcccactgacattagaaaagccaaatggcacatttaactgaaccctttttaatgtggttggagaaataaacagtgagacaaaagtcatgaattctattttcggctaacatactcaaactgactatttgctgcagaaaatagttactacattttaaaacttctattcttccaaaatgaacctaacctttttttctttattttttaccttcttgaaaaacaagtctctcacttctcaggccaaaacgaaaaataactagctgagttcctcagctaagctccaaaaccacattccaaacttaataacagagaagctgaacactttatggtcacaaagtccgcatttttaatgaatgcagtgaacgcctgcctttttaggggcctgcattattttcatcctctcattagtctagtgtttcttctataaagaaaaaaaatcccagaaatactaatattttcataaatatcatggcagtgaacttggagaagcctcaagtgcatctcaagctatactgtgagaatcacaatttttttcacttgaataaattagtccttgagtctcaaaaatgctttccataacttcaaaacctgaagataattcaacattttccgtttttctaatagtgttcaaaagagaaaacacaagtattgcttgagaaagtaaacagacatcctgatattcaaacatggacagttaatgttcccccaataatatatttacagctcagtgcaatgtcctactccagctaaaagtgaattcccaagtgtttctttatatagacagcattatcacgtaaaccaaaagcaaagcttacagctggtagctggtcacctaccatagaatgtgttttcattagctatagtcaaaattttagctacatgggtcacaaattgtgtctagaatcaaaaaaagtttgatctgtctgtaaatttttttaaagtgtgtgggattaagagaaaagagctaaatggaggaagtttaaatcatcttcaacctttgaacaagccacaataacaggtatttgtaatgaaggccttacttagtcacttgcgtggttctagggattaatagagtttgtgtattcaagagggggctggatagattcaggtcaacaaactgagtcatgtttgctcaggtgaaagctaaaaataaccactccccagtattcctaggagagtaatgcaatattacccagctgcctcagcacacattataaatgtctcctccacccacccatagtataaggtttaactgaaaacaagtaggccaaaaactacttctacaccagaccaattcaatgacagaataatttggccaaaactaaatatgcctagtcactgtaaactggttaactcatggttggttaagatagccttgggaatatgcacagaagttataaaaccatgagctattcattgaaaatgcagtccattatgaattcagttctttttactttatcaaacatgaccattttattttgtctgtatttcaatacagtatttttggcctccacttttccactacagcacatgaattgtgaaatgtgattctatataacatttaatgttaaagtgatatgaaatcaataagacttctaacaaattcaaggtgtgaagaaatgtacaaacacaacctgaagtctctatgaaaattcagtggtccctcagttacacacattactatggctcacagtatattgtccaaatttgtcttgagtatctaccatgcactagacactgccggttctggagtaaacctgataggcaccaaccatatggaacgtacaaataacggaggaagcagacaataaataaacaatttcaggaaaaaataattttgatgaatgttatatgtaacctgacattccctgagaaagggcaacagtcagatatttgggaggtgggagaaatgaatacaccagaatgacagaaaaatccagtcatcgttacaacataaccttgaataaaaatgtaagtgaacaatgactaaacctgtagtacttcttttggaagaatattcattgactccagtcagcttcctgttatttcacttcaaatggctatccagtttacaaattactatctagccaaccgctagcatttatcatgcttaaaattgagtcaacattaaatcattagcccctattccttccagaacctgtaatttaagagttagagagagacaagacttggttgcctcttagaaaagttaaaataaaactaaaacaacaggctgacatgacacattgtctccatttaagccaacatagactatttatttctttgctttattatgagtaatgaacatttctttagcaatcacctaggagcattactattatgcaggtaccgtactaactaaagacagagacgaatggcctcccagacccccatttgctcacaggctagtgtgggaggctgagaagttcacaaagaattacaccctgattggaaatttctttgacagaggtttgcacaggatgctccagttgtaaaaagagctgagggtagctttcggcagggcttagccttggaagagagcaggtaatagccaagggagaatgggggatggccaaggagggaaggtgctgaggtagagatagaacatgtgctgggtcatagaatatctaaaacaatcatattttctgcagatatctgtgcttgaatattaaaaattaaaaagagatcatttaacggtgaaaactgtagtactactcttatctctgtgtccacccttgccttttctaatcagtggtataattctactagagtgccttggcctctgctcccaatcatccctgctgtactctatagagcaccataaagaaggaataataaacagagccacacataacaaagaacttttatttggcaggaatgtttccttttatgacacctatctctgccctgtaagtagccacaaggccagaccagagatctgctggaaggaggcggagtgagagggtagtcaggtgggaatgaagaagctccccgtcctattcccacaaatggccccaaagagcctttgaagtctcagtcatcaggtaataatagccttcctctaaattagaggaagaatgtctgccttgcaacaaagatgatatttaaagaataatctgctttggggtacaaggggaaggaatgcagagaatagaccagttgaaaaggtaattcctgtttataagaattaataatcagaacagcaccattttaaaaagtaatgacttaaagtaaaaatggtcaaagatttcagaaatgttttagagaattttatgtttacaatagaatttatctaacaaaaatgataggaacaatacacattgatttaaaaacatacaaaaagttggtagcagatactttctcctactgacttgagacattgatttaacacctgaaaactaatctcagttaaaaagctgccagcaccatctctccacctgtaaaaatgtgaatatttatttatattttataatttcattttatttattctctatcttgttccataaaacattttggggtactagaactggttattagcctttattttttaaaaataattgggactgatttcaacggatagaattaatgttggggcgggggtgggcagagactacaaattacttggtctatgtctatatcttcaaaagtttggggagcttatattctccagctattgctttttttttttttttccagctattgcttttgaaacaacagctgggaaatataagctcctcaaacttttgaagcaatagctgaagaatgaatataagctcccaaaacttttacctgatctatgaagttgaatggctcaatatccattttactttgaaatgtagagaaaacctccattgcactatgaatggtatttataagaactaaaaggcatatgcccaagttggttctaagctctgcctatctaaatatctctgcttgccttatgagaacttatataaaacatattgagcacttaaacccttgggcaattgcagagtgtgctttggattttttgagtatcaaggtggggagggtcgaaaagagggagaaagggaacacaggtgtcagaaaagactagatgaattcctgttatgtaactactttttcaaatgcccccaaagtacttatttaacctaagaaaatctttagctaagtttagaaattagctttaaatatgctcaattgattttccttagacattccacatgcctttcgccagctcaaaagccttaattctggttaaaaggaaacatgtgaaatatactgcacaacttcagtggccagatcatattaactggctgagctgtgaggtcttatgagccaaacctgcttaccattcactgaaagtcagttcctaaaaagatttcttaatatctgccataccacttatctaagttttgggtggctaattagaatgagctcttcaaaaagttcagctaaagaaagtgcaaatatttgcattaaattgacttagtacttaaatgattcagtgtgttaattcttttactgaaattgctctgaagttatagtagacacttatgctttctccaccacctactttgaagagaagattctcctatatttcaaccatacccattaaatcttactagcttactaaatgaagtattatttcacaattcaatctcaattactggagagctgaaagtgtgtctacagagactagaccagaagtgatttttacaattatcaaagctatgcccttgtgcatgaaatggggtacgctaagtgaaatgaaattcattcttgccagccactttcagtcagttagttatgctaacatctgttctaggaaagctaattttttttaatacagcagaacattcctttacactgaaccactaccaccaaaacacaaacatacatactacatagcagagttgaatgcaaaataatttgtaccgtacacacaaaagtcaagcacttatttaaaaatagttctttacaatataaacttatgaaattatggacattttgacagcaattttccaaaaattgtagcaaacacttgtaaatacattccgactcaaaaatattgaaaatatcatatgtttacattttaggcagatgaggattttaaatgcttcgcctacaacctcaattgttgtggagccaaagatgcaacagctttgaagaatagaagaattactctatatttgtcaggatctacgtggcaaacaagcgccacttggcttacattacttgcctggcttggatcccatggaatggaggagcattggaaccaagaggaaaaaaattaaagtgctttgggacagcgagccaaactcttacatagtatttgaaatggtgtggcaaacatgaaattattttaggctcaagattggtgctagttttttaccctctttttgaaaaaatagtaaaatgcacataaagggccctgccagaggtttagctcataaaatctgccaatcattggatgtgctaattggtgtagcaatccagtggtggcctggattaggactcaaaaactgacccttaccacccttggtgtcctgcagcaaagacagcctaaatcgaaaagactgatggaagtatatcaaattacgaatttctctatccctgaaaaatgcctgcaatttctgtttctccatcactccagaaatactcaaaacagcaaaaattaaatacatatgaagtgaacacaaaagacctccacagaaaaatcagtggctcatctgttgacgctattgctcattgctcggctggccagtcatctgggctaagttttgactttgggccagtgcttcaaaatcagcaacctttcagccaaaagactgtggaatgcagccaagaccacctgtggaaagtgaattatagcatctttaatttactaccttgggctatgatgtcagaaacccagcatggagggcgcaccagttcttgtgtgggaaatctctcagagcccccatggaggcccccaaagtggctctggcaaagctgtaggggtggaggtaacaaaaaaggggacacctggctctccttcttaaatcagctcaccatgggcacacatttatattggaattttagggtcagaaaataccaaaattaaatcttctagaagaaacacagtcagtggctttgctctaaagtgcctattacactctacaagtttccaacatttgttatttaaaataatcagacatttattattcataaattacatatattcttttatcaatattattgttaataataaacatgaacaactagtaagtgaattgcaaagaactttcacatacatagattatcgaatccacctagttaacaagtaacataattagcaccattgcatattcagaagatcagtggtttttgtctcatcagtaaatagagttaggactggaacccaggtctgatttcatatctaatgctcctttccaatacaactatctgtttatttattaacggttactatttattagcactctcagattacctgagatagttgcagagctgagggatgaatgaagacgactgtggccataagtagcttgctgaagctccacaggcaaggcactaccagcactgggctgggtgtcactcaaagggagccagcaagatagcttttctgggagacttacagtcagggacagagtacctctaagacttccataaagaaatgatggagtaataggctcatgaaaatgcactaaactcccttgaatctgataccctcccagtttttaccgggtcttggttatgacttcatattgcaggtaggcagtgtttaggatgttagcctagagaagatctgactcaggaacacagcgctgccatggaagtctatgacagcacttgcaggcatagtgagagacaggaattcaagttagagaaaatctgactccagagcaacctatggaagaattacttataattcaggtaggcaaacaatggcacagtttgactcaggaaagggtgggttcctcaaccatggaaacatttgggaagtaaatggatagataagagcaagagcctgaactaaatataagttcctctcagtcacaccaaaataagtctcctatccatgcatatggtatgtcagggaatggagaaattaaggtccaacaaagagctgcatatagtttattgatttgttttctattttctgaccagttccagataaacagataaaagcaattaaagtacagggcattctgaatggtcaaaaatttagtattgtacattgtaagttaaggctaagggcaagtaagacctgttaatgtctttatctggaatttcacaaatgccaagaataatcatatttccttccttgattgattattcaaagaaaacacaggcccttataatttgcaaatttcctagaattgagggtagaggtacattttaagggtaacttgcagttttaacattcacattcttaggaattattattattattaatttttttttttagacggagtctcgctctgtcgtccaggctggagtgcagtggcgcggtctcggctcactgcaagctccgcctcccgggttcacgccattgtcctgcctcagcctccagagtagctgggaccacaggcgcccggctaattttttgtatttttagtagagacggggcttcaccgtattagccaggatggtctccatctcctgacctggtgatccgcccgcctgggcctcccaaagtgctgggattacaggcttgagccaccgcgcccggccggaaatatttttttaaaaaacattgaaatcacaaaattaaatagtctatgcaattatttagtattttaaatttcatcagttttaggttctagctcaagggccgtctctccttcattcaatttgttaaatgcctatagtgtgccagctggaggcctcctctgattttccttcagttgacaaaagatccttacttcctttggtgccagtatcacctggtctatgtctttattatagcattctactttatttgcaggcatcacttctgaaccctacaaaattataagctcctaaggggaaggactacatcttattctgccttgtgccactaagcacagaaacttaaacatgcaagtcctccagacctgaactgaactatttattatatggcttttgtgtcataataaacatattaatgtaagttatgctcaatgtaactaacaaaattttatcaaatgcctactaagcatcattttttaaatgccatagtggattaatccttgtcccgcctgtatcaaagtacacttagactggcactcagtgacagtttgggaagaagccagagctgccttccgtgaggtcagtctcccaaggtcacacatgtgctcatcagagactcacttcctacaaatacttatgacggttcttccagatccgtgtcaagcaatatattaaatgaaatactgaattttgaagatcaaaatgaacttttcctaaactataacccaatccacacaagtaatttacacatcaaaagaaattagatagtaggcaaacaaaacaatggtaatttttttaaaaaaaactgctcccaaagggtttgtggccaacattaatattgcaggaacatgtttagataactgctgttcagcatagttcctggaaacaggttctcaaagccaggacttacagttatttaccttcttccagcactgccctgagggttttaaggcctaaatgaatagaaagcaaatgggggacaaaatgaaataaaatgttcacatctcagcctttagtgtatataactaatgtttgaagattttatgacaaaatgtgtcttcttaagaacacatgtagggaagattttggccatttctttaacaccctttaaacagtacctaccagagaaaaagcaaacactcccttctaaaagcatcaatattctacttctgagatcaaaactacaaaacaggctcagacagaaacctgggcaaaggaaccttctgctgcacgtatgtactatttcccagagatgtaaatgatttttttctctctgccccagtgaatcacatatgaaagttctcaaagaattagtaaagaaaaatggtgaaaatcttcttggtgttgaaggaacagtggagtgtagctggtatcagaagttctgaagtgactcagagattcagaagggtgacaggcaggggcagtttttactagaggaaagagcgatgtaggatgaacaatttactgtccctgttgattcacataggatgtaagtacaagagaagtcaaggatgtccccaaatttcttgcataggcagcagatgagtgatgtcattcactaagacaggaatcaaagaaaaatgaatgacatgtcatatcacacgtagaatttgtagaagctggagatgtatagcttgtttaaaaggggggtttagtatggagggttgaagataaaaggtcaaatatgtgaatgactaaatgtggaggaggaattagatttaccctgagtggttccaatcttgcaagttctcaggaaggaaatctgagatcaataaaatcaaactggcccacagttcaccacaccagttgaagaaaatgagctgccggcacctgtgtgagtggaggtgctcctcagttaacacttggtgagtgcaaagaatgcagagggcatttgagcaccgggtagggatggaaaggtgacttttagggtctttgttatcattattattctatgggcattcttcatatataatatttagagcttcgattctgggccacaagttgatctgctattcctgaactactacaaatttgagcataagaatcttggcagaataaattatcccaggactcatgattgctgggttctagcaatggatatgcattaatcaggcaaattattcaatcaatcttgggccttagttttctcaactgtaaaaggcagtatttaaactgttaagcacttttaactcagcaattgtaggattctaaaaagaatgtatgtacttctacgttatgatgaaagtcactcttttaagtttaaagaaaaagttcctacaaattagggtcaatttatattccaagagttctggctgtccctatcaggcccctcctccccctccttgtccttatattttcacatctgttagaagaacagatcttaatggtcctattctcgttctgttactgtttgggatctgaatgtattctgagtgttttctgtcttccaacagctggagagatcaaagaactgttcctaaaagcaaggacaagctacagccaactgcatatgtaaactttcatactgatgtatttagcacagtgaattatacccccataatttataatatgagaaggtaggtctaatccaataataataaagacctttaggagaaaacaacaaaaaacaccattccagcttccagccagtggtctgaatactcacagcctaatacaacacaaagacattccaatacaatgaaataatttggatcatgtccagcctctattttttaggatgatagaaataagctcaagagagctaagtctatttattattcagaagaaatgaaagtcatagcatacacttctaagccaagagatcattgacaaaatttgctaatgaaatcaattcataactttctttcagattttcatttaaacggctgggttcctaatatatttcaaaatttacactgattaccctctacaaaaagtatgtcataagagaaaacaatgattacagagtagcaagggacttactttcacaggaacggtgctttatgttgctgaaggcaattacaaaaagagagtaagaaaaattaaaagcaagagctagagctcagaaaaacttgggttcaaatcccaactctgttactcactagcaatttagtggggcagcttacctagccttgtagaatgccagtttcccttttgtaaaagtgtactaaaaggtactcgcctcctaaatttattttgaggataaaatgattaatataaaaaccctattacagtaccatgaaaatagtgaagccttaatgaatgttagctgataataatagtgctgtcaacacatgagaagaattagaatctggtgggagatgaagacctactccatgttctctgttctgtcttcttgccctgaggggtgtgttcatcaatatttaaggaactagaaggtgtgcatcttggatgttaaaaacaggggctcccctcacctatcagtgaacagccccaataccagagatgattctatacaaattttaactggaacatctaagataaccctgagaaatatcccaggcatatcttaagcagcctgttatttgagggaacacagaattaacccttggttttatccttagaaaaatgggatgataacatcttttttcacaattatcttcacaaattattataaaatagttatggcagagcaaaaactattgacatgggtatttgctaccctttcccctcctctcttcagataaagagaatgctggttttgcctcttctgtcacaaccccctcacctgccccccgatgaggattcaactattgctagatggattctttgagttttcatgatgcacaatcaaaagacaggggataggtagaagatatgggcttgagctcggcagggagaggggggcggtttaccagcgggagtgttggggagattttggaagagacgttagaaacatcaaagtagatgggaaagaaaatagggattgctagaagtactgctacagattatatatcccctttaccatgctttgacagttaaagaacagaagttgttaggtcactttaaattcacctttggttgactgcctgtttctttgacagaatccctacttggagactggaccaaagaggctatgtcttccatagaggcaacatgagaaagtaagagaggtgcaaacacatcatgcaaacgttaggcagaatttattgtgttcatacatgacatggggaacattgaaaggattgatgtcttagaaaggcgtgttaggagtgtgggtctagaatgcataaggttagagatatgcctgcactgggccatcatcttattttaatatttggtccaaattctgggcttctcacaatcagagagctatacctaccaatttcctcttattattcttggctgcccggtccccatccctctactcagagatttctcaagctttgcactaatggcattttgggttgaataactgttgtgggggtttggcttgtgcactggaggatatttagcaacatccttggcttctacccactagctgccagtagcatcttcatccccactgctggcaagttcagggggggtgtgggtgggggaagtcttctccaaacattgccaaatattccctggggagcaaaactgcttctggtggagaacctctgctttaccccaatcatccaggcttacaagaaaaattcatactccatcaagccattctacaacacttcattttcagagtttccaactacagagattccaagttctcagcaattcataaccattacagtttgcctcatgttacactgactgcatcaggctgtcatttagaaattataataatggctaccacttgttggatattttttatgtgctaggcattgtgctagggacttaacagggtgattttcattcttatacagaagtaagtgtggccgggcacgttggctcgtgcctgtaatcccagcactttgggaggccgaggtgggcggaacacctgatgtcgggagtttgagaccagcctgaccaacatggagaaaacccgtctctactaaaaatacaaaaaattagctgggtgtggtggcgcatgcctgtaatcccagctactcaggaggctgaggcaggagaaatcacttgaacctgggaagcggaggttgcggtgagccaagattgcacaattgcgctccagcctgggcaacaaaaatgaaactccgtttcaaaaaaaaaaaagaagtggtagatattattatctccattcagagatgagtaaaatgaggccctgaaaaattaaaataactcatccaaggtcacagccaataagtggctgaactggggtttgaacctaatctgtcccaggtccatagtctctccttgtctcaggccacactgtttctcctgatgagaaaaactaatgcagggatacacaagaaatacatttacccaaagttacatgagttcaaatggcaattccactgtatggactattgtagaggttgttgatctcagcactatgtggactcagcagtatggatgtctttgttctagggacatcaacaagctgatttttgaattatgaattttctgcagaaaataggaaaatggtgctctcctttaagtagaaacaacaaacagtagctggttgccatggtagcagaggtaaacttaaccttgactgggaaggcaatcaccagaaagggacagcaagtatggtcaggagtctaaaccagaccaggggtattttaactggagaagagaaagtcaaaggagagaaatgatagtcatctttagttatttgaaaggctactgtgtaactgaagtgaagcatacattcaagattattctaaatggaaaatccagcattcatgagtggaaattacaatgcagtcatggaagccagttttccactgaatgataagaaagaacatttaaccatcgtaatgttccaactggattgaaaaactaaacaagctgtctagagagcaataggtcgctaaaatagaaagatcctaacaggaaggtcatctctcttgggagacccagtgtgggtgagactgggctaaacaaattctcaggccccctccccaagcaaaatctctgtttctccagagaattagtaaattggggttccctgttgaaaacagacaaatggaaggtccactgggcggaaagccccagccgctcatcactacaagaggagaggtaaactacaatctcacctgggaagaaaatgttgtttaggtgacacaaaccaaggggaggagaaaccttgtggaggatttttcccctctgttctgaatagatgatcaaggggtaaggcagtaagggcaaaaccaaaaacaaaacaaacagaaaaaaacccaccaagaatcaagcagctttctgctgtcttccaaccctcagacactctgatgcctctttcttggaatgtaccgccacctcccactgctttggcctaaagactgcatttaattttaaaaagaaaataggcaaccatccagctaggggacagttagagtaacagttgattagtccttttctaaacactgtcttttgtttcattgctctttatttgctgtacaccaacaattcattaaaaacatctcaccactagatttagtgaatggagaggacaggtctaaacccaaacattcctcttggaaaaccgactacattgtaaatttgcagacctgtccaggaaagtaaaactgttacaaagtcaacctctactgaggcacacagcctcctttgtaaaagaaaaaaaaaaaaaagaggtgctaaaaaaatgacaggtttttcttaaaaaacaacaggtttttcttaaaaaacaacaaaatcttattcatctttccatattcagcatgaagaacacctaagagaattttccctatcgcctcatctccagggcactcaaagcatttacaatctcattattttatacaacacccattaagtgggcaccaaagattattacccttctttgatttctaagaaagcaactacagaaagtttaaacaagttgcccaaggtcgttcagtaaattgagatgcttggattttccattcagtgattgttctagggacatagtgcaaagtgactgaatcctctaaactcaccaaaacccctaagtcttacagatctcttccccatttctcaccactcatgagattttcatcatctaatcacaaatctgccaccatgtggatcttggacatgggtatcctaccaggccagtgccatgtctgcaagaagcctggtgctacacctgacagctttcaaatcaccatcaaatgattcctttatctagtgaagttgattctgcctggctgcatctgggaaatttttaacccctcgattagccattgcacagttggcttaacttggatgagacagaggacaaaatagtggtggtttaaaaaaatacctcccccattctgattacaaaggaggcatgattaacgaagtaccctttgtatccgagctccattctaagagaaagagaaagagctttccttcccccttttttgatcgctgagtcttttcctacttgtctcatcacccacacaatctgttcacagcccaaacagacaatccagccagtctgtggagagttcctaaaacatttatgttgtgaaagcagacaggatgaacaggacctcatctcgacaaaggatgatgggacattcagcaaaagagttcacgaagggaaatacagatggagtcccagagctgaatgaatttgcccacaatgtctaacacaatgccagcccttatgggtacttgtaaaccttctggtcaattcacagccacctccaggttttatcccccaaattccattacttttagaacaaagggttttaaaagaaaatacaattaacaagttaaggaggtccaaatcagtgctttaaggatccttcaatttctctagacctttaaacataaaaatagcaagttagatgaagattttagttccaacactaccagatcgggagttgacataatgcacataaaatacttaatacattgcctggtacatactaagtactcaaataatattacctaatattttcatcttacactgctctattttattaatgatgtttttatatatgtcattgcctgtctactcagctaaatagttccaccttatctgtttttggtataatccaaaagataaatgccttcatataattatcttatttaagctttcagatctatagtaggttacagatgagacagtaaaagcaagactaggtctcatagctggcaagtggtagattcccatactgagatctcaactcactaatttaacatccagtgctttatttcaataacaccacagatgaacagattatcatctctcgtgcctctttgtattcttcagaatttagctaagcgctaagatataccttaatgatcatctaaaataaatttctaatgataggtaacctaacatgtctgaagatttattttagtgcctttaataaggaagaaaagaaatgggtggaaaagcccaaccatacttggctttgaggaaagacatgcctctgtttttatttgccaagggaaagcattaccaggtccatttagaaagacaagaggaagtaaagccgggcgtggtggctcatgtctgtaatcccagcactttgggaggccgaggcaggtggatcacctgaggtcagaagttcaagaccagcctggtcaacatggtgaaaccccgtctctactaaatatacaaaaattagccaggcatggtggtaggcgcctgtaatcccagctactcaggaggctgaggcaggagaatcacttgaacccgggacgcagaggttgcagtgagctgagattgcgccattgctctccagactgggcaacaagagcgaaacttcattccaaaaaaaaaaaaaaaaaaaaggaaagacgaggaagcatgagggattcaatgatataccaaagagataaatggggctagagccagaactcttgatactctgctcatggctttctgtattaagttcattattaatttggcaccttgagtgagatgaatcttgccttggattatgcacatcaagttgtatttcagatggctgtcccatactttaaaggcccataccaaacccccatgtatcaaaaaaaaaaattatctgatctaaaaaatgcctagatcccttagcccttaacaacaaactgtcttattttatggatcttgtcttcccaaatttaagttgctggagggcaaaatccatgtgtttactccttctgtagcccatggctaacctagttcagaacttgtagcaacgtgtgctgctcattgcttcctcggcctcacagccttctagatgtcccaaagaaacctcgagtcatcataacatctactgaatttcccaaccatccccagcactactgctcggcttgggcagtcattaaagcttctcttctgccttcaggatcttcatttcagctgctgggacatcctgttgccatccatttcacacagacatccagcccagcaggaacccgtgttgcaatgagctttgcttcaaagccagcagcctggccaagttccaggaattgtcactaatgatcttcaccagcaacttggtgctcaacagtgatctctgaacacacacacacacacacacacacacaccccatttccaatactgctctagttagaggagctgcctaacagaggttggttccataacttattttattctttaattgttacagaggacttatttcatcaaaataagctaactgtccaaatacactctgcaatgcagcagtggcctccaccaacttactccttttttttttttgagatggagtctcgcactgtcacccaggctggagtgcagtgttgtgatcttggctcactgcaacctctgcctcccagtttcaagtgattctcctgcctcagcctcccaagtagctgggactacaggcaggtgaaaccacattcggctaatttttgtattttttaatagagatggggtttcaccatgttagccaggctagtctcaaactcctgacctcaggcctcccaaagtgctgggaccacaggtgtgagccaccacatctggttccaccaacttatttttaaactgaagaaggcataacaagtgtatcagtttcttttggttgtaagagacaggaaagcctgctcaaagatacttaagcaaaaactaaattagtaagatgatactgaaaaatatctagagataaagcagtcttctagtggttgttttgagaaatcagattatgtcaacagatctcacttctctacagtcattgaattccaccctgtattttattagcttcattctcaggcttcattggaaagactccaacaattccaggcttatattctgtgagttgaaattcagtaagaaaaagagaggacatctcttcctggtagcctccacacaagtctcagaattcactctaattagactaacttgaggcataaatccaccgtggctagtgcttggcttggtcacatgtccatcactggaatcagaagtgaagattctcttaaggcacatggactgagagtggggaaaaaaatgctccacaaaggagattcaggcagatcctgctgccaaaacaaataggcgaaacactaggcagccaaaaaacaccaatcatcctctccaataaatcttccttcttttcctaatctccaagaagttgtattactgggatgatccaactttgaaaatagtatattaaaagaaaggaacaaccacgcaagtcatataaaaatatatgtagccagtaggcacatgaaaagaggtttaccattactatcaatcaacgaaatgtaaattaaaagaataagatattatcagcacattgggaaacattttttaaacaaaagtaatcaccagtactggctaacatgcaaagagatagacattcccagatttggctaatgggtgatatgatgattatcactgaccatcaaaatccttaaaaatgtgcatttcattttacctaagataaattcacaaaagtgaatttactaaggaaataataaaggatgtacataagaatttaaatacaaagaagatttctccagtattgtttataatagccttaaactggaattattctaaatgtccaacaatagattgagcaatttaattttatccatactatgggttatcatactgacactaaaaataacctttcaatgcatgtttattagcatggcttaaataagtagaaaggcactatacaaaagaattaataaagtgggcaacaatagcatcattcactaactaaacccagtaaattagtttcaccctcatctcctaggcactccctggttccttctttaagatttaccctggggttctaaagacccagattccacccggggaaagagaaaaactctggacaccctcagcaggctaaaatgtgttgaataaatatgtaaagagagaatcaacaactgttcatgggaatggcttgctacacagaggagggtgaagaagatggaccacaactgtcatttacttgtcctggaagagagctcaaaaagaaatgtttggccaatacacagtgatttctatcacaagtagttcatattttttaaaactactcttttttcttgttcttcaacttgtcataatgtagcaattaatattcaaatcccgagttattccttccacaaacatagctactgccttgccaaataaaccataccacaaacagttactccccatctcagttttcataagtttaaaatgtaaatatccctgatggactggcctatcttagagtgttgttgggaagatcaaataagatgatttctactaaagtaccttcaagaaggataaaagcactatacaaatgtgaggtatcaggtgtatcagtgcattacgcagatttcacaaacacacaacagagcatgggagagttcatggcaagcctctggctcctccattaccctcatgtccttttccctgcagtcatttcagaaaaccagatgtttgtttgcaaagtttctctgcagcaaaagggcaggccctctctacattcaaattggctgaagctgtgtttctagctgttgaaacttagacaataatgggggagatgccaaaattaatccaaaaagcagacaggcacactttacagactggagccctgagatggaaaaaggcagcagcatgaacaagtagagggttaatggttttcatattatttaattcaagccgcaacaatgacagattctaaagatataaacttctgagagtgagcattctttcagaattagtatacaggggtcctattagcaatattttatatactccaaatatcttcccaaaggaaatcactgctgaaaaagacaaagttctttgttggtagggctgtgcgtttataccatggacttaaatacttttcttctacagtctcctcattttaaaaaatggcaaaaaatttcaataaaacatggatggagcaataagaagtacactgaagttcttaaatgcccttctttttaaatccccaccccaattacgtccctcccttgaggatatttacagtcctctatgacacatgctctgtaccttcttggttcaaggaaaacacacctacagcatttcaaattaactactgacccttactctcacactataaacaaacccttttcacaatctcaattgcattgtgtccacattgattaaagcttgaagcctggtgacctcatgtggtgttaacttctcccatgcaccaacagcattccgcctttctactcaattaccccctttggtgccagaggatcgctacccaatgaacacatacaatggacttctgcttcattacactaaccaacagcaggatagaaataagcagaagaggaataaacaagctaatttatcatgaggacagagcaagctttcaccagtctcgccatggaaaacttcagtggttaacgggaacatcaatagtctgggggtgatgtttatgatcttacagattatggacaaagccataacagaaccccaaactgactgaagaattctgcagattggcaggtgtgaacacacgcacacaaaacccatgccttaaaactccggggtcctacataaaacctactcagtaattattttgggaagcataaccctgggctttggataacgtgggctgacactctggtaatttgctccaactgttcagcttaactgtggggcccctcttatttatctttgacaaggtggtcaggaggaacccagcccctttgtgagaggggtctggttcccccaccgccccctgcttcattaggcatggcaaggacacagcggttgattaaattaacaactttggagggcttcagtcccagttcccagacattagcaccatcatccagaacaaattaaaagtctcacagcaattaagcagattttgaaaatgaatttcccatggttcaatggctcaaccacaatcttgagttaagtatcagagaagagtattgaaggaagagaagaggaactgactgctgaaattccaaagtaaacatacaactggtagaagcagcatacacaataaacttctgagcctctgctaagtaggcttatacatttcttttatagaaaattggaaatattcagtcacataaggggaaagaataaaacattaacatagaatggttgtatcaaaatggtggatttttttttcttttttctttgtttttaattactttaacatcattttattcttgttcaaaaatataaatagatattgagaggggacaaaaatacctacttccagtcacaggcttttaaattcaaacaagaaatcgtacatccaagtctggaactggaatcatctatatttctctgaaccagtacaactaggttcacagcaggcaaagaccttttatgccagcctccaaagaaccctgggtgggtgatttacctctaagaactcatttctggatcaaaagaataagattaatgataaaatcatacctatcacattctaggtgtgtactctttgccaggcactgccgttttgaggccttgtcatacttgcttccttccctttcagtttacatatgctcctttaatccctgttcccgcctcgcacctctgcctggctctacttgcaagtcacaggcctccgttcctctttgcctgcaggcagacatttggcacagcttgtgtgcaggaacctggaggaatcctgaaggaatgtgcgaatgaattcattcccactcaccagatctataagctgaagacagtggaatgcagaggtagttacttgaatgaactatattttcctgtcaagggcatttataaaagctgacatcataaatacattattggtctctaagtacaactgtaaataaatctacaaaattcttagaaggataactttcaaagatttgtttttcatctttaaaagtttatagaaaattaagcaaactatgtggctcttctaaaagaagccccttcaaaatagccctcacggaacagaagaaacacatttacttcttaaagacagtaaatctcaaaatttgcattacagttcaacagttccatttggatattcaaaatttggaaatatatatacttctgtgtgttcccttcttcccactaaactttaatcaactagtatagacaaccagccacagtcaattatctggctttatggccaagtagggaccaaaatatataacccagacataataacaatcagcataacagtaggcataggtaatgaaactctccgctagtggtcagaaagctcagttcaaaccttatttctcactatgtcttccttggaccttagtttccacaatataatggaaaaacgtccctttccaactccaaaattgtaccattttagaaatgtaagcatgtatattatgaaggtaacacaatcttttatgttcaagtgaataataaaaaccctcctcccatttaaataataatagcctggaatataatgttataaaacttagggaggacctcaaagccttaaagtagaagcattttagttacctccacaataggtccaaaatgcaaggcattcatctattcacctcttcaacagatattattgggtacctacattgcattgatctgtagtaacagccataaaggtgagtatattagaccatcattattctcatacagcttacagtttgacagaggttatattttaatcattattttttgtttaaaatttcttataaactataattctagctaatgtttcagaagtaattaatattttatttttaaaaatcatttttcctcaaagtttgactttaagaagtctttgtcattcacgttattatctagaagcaaaaaaatttcccagtggatgatgactccaattttataatgtaaaacagaagtacaactgggattcacttcgcagcaagcaaagagggaataaatctcttccacataatgagtgatatccatttaaaaaagtcatgctacctgggcttatctatgctctaaagagccatgaatactggcccagaattttaaaagacaaacatttagattcaaattaaatgttggttaaaaagaggaaaaacaacccaagttaattactctaatttaccgaatatatgaatgacctgcttattggactattggctagcatagatcttgcctaataggaaggctatcaagcagggtggctgggtttctaattttatccaatcaattaagaggcagaaataacctgcccattgaccttacgagacacaagttgactccagaataaacaaacaaacagacttgaaaagttaattatgggcaacctctccttcagagaaatggctcacatatattaattgatctaacacctatgtgcaggctcccaagaagatggaactcgttctctcatttaaatcccacaacccccgtgactcagagatttttggttcaggaaactgaggctcacagaatttaaatggttagtctaggttacaaagcaagtttgataacaaagagataaatcagatcactgccatttatcaaccataaaaccacattccatcagttattatagaaatccatcactttgaatggagagatcaagtttctcaaggattaagcttctcatttaacatgaactatcaaatggaaaacctcgagccaacacttatttttatagcgtgactatttctcaagaatcctgtaagaagcccacatcaagaggcaactttcaaaattactaaaatttcaaaaatttcaaaattacaaaagtaacagttctgtcaagtgggaagagttaatgcctttcctttacagagctgctttatgtaactagccgaagttttaacatagaaatattactgtttcatatatacattaatcttgactttgttaaaatcccaaacatactgctcatcgatctcctaaactttctctttttcaagaagtaggtgggggagggaaggaaggtattggaggaattcttctgatatctgtaaaaacagaaacaaatgctaattaaaagatgaccttagtgccctttcagtttaaaaatcttgagcatttacaaattatcttttttttctctttcatcaactattacccagaaataccacattctcatagagcaaagctctgtcctgtttgggcatgttcaaagaatagtgccagggatttaatactggcatgctcatggacctgcaaattctgaaattcagggggaggcatgaataaaaagatagctgaggtcccacagttgcctgtcacagccaagccccaccccacccacatcctcatatgatcctcaagaagcaaaacctttctgagatattctataagtgacagcaaggcccaatgtgcagtcttttcaaagcctcagtaaaaatcttatctatgacttcacttagcccagacacacaggagctaaaaggtaaaagcctggttcacacaagccagaactagctcaacagaaccgaaaaaagaaaggaatgtcttttctatatcttttccatgtctgaggcattctgctctggggcaaattacaacctaaataagaacagataaaatatatgggaactgagtaaaagaaatagaacctcaaaaagggctgctctgcctggaaagaaggctggaattcataaaacatggaacgtaacttttttagtgatcacctgaaggcaagcttgttaaacagagacttaaaagtcaagatttatttcagctaaattagatggtgcagaaaaacatagtgcttcgtgactctgctcagtttcaacaaaatgaaaagacagaggaggaagaatttacagtataatacttgcaccactcaaatcacaaaaatacacttgttagtcacaaaggaggggcccataacattgtaagccttattttggcaatgtgaattttctgcttgcaattaccttcaaagtgaagaaatggcagagacgaagaatgaggaattttgttgctgcttttgtatgtaaattcgaccaaaatatatagtgctatgtgactttaccccaagctcactagaacttcggaattatgcctgccacaaacatcctccgaaagcacaagaattagtcatagatttttttagtcaaggaagcctcagactgataaagtcttaaaactagacgcaaggactgtgctttggattggataagtaatgactatactgcgtggttttggtgtgtgttttttagagttttaaatttacatttccccaagcaggaggaagggaatgtaccacaccctcagcaagcaaggaaggaatttagttgattttttttaaattctgtagtgttccttaaaatccacatagcatagcataacattctatataattctgttgttccataagggattggctaagtatattaaggatacaaagggaagggggagatgacaaagttattgctattttattttcaagtgacagaaaaatcaatcgagctataagaagcaccagttgggaatgttctgcacattaactctttaatagccttagacagaaatcagatgatcttcacactgaaactctgaaggacatatatctttggggcactgagtagcattagaaactgcgtccaagccatggctccacctctaattgcatgaactgaatggcttccctttcctgggactcgaattccttctaaattaaggtagaacaagatagtcttgaaggccctttcatccttacgatttaatactgacaagctcttcagcttctattcaggacaaacaccaccaaagtgtatggatacaatggattcaagtagccacactcatggacagtgacaaaatcccacagctttagggtggaatcaagtatcatattggcctagaatgtattgatgctgccaaggtgtggggtgggggtgggggtgggggtggggggcaggggtgaggtaccactgatgtgtgaaatgacttgcctaatatcccagagacccctgaatcccaggcattcttattctgaatagagacttttaatcaatttcttgtctcatcctatgtcctcatgttaccatacttctacaagtctgtgctgccagtgagggttggcaaatcatcccaactcagaaggacagacttacaaaatggcataatcaagcttcactaacactgtatataaagtaaaagtaatagattgagtaaaagcatgagagattctcttgggagtaaaatgtgcatgctttaggagaagatttggacttgtgttcttatttgttagttttctgcaataacattaatatttatcatttgggggaggttcataatgaaatacttggttatagcacaggaactaatgttagaaagcaggatgacctccttaaactttcaaacccaaaccaagtaaggttttgggtcattcccattccttctgcctcaacagatctacaaatctgtaggtgttgggcaaagtggtggtgactcaaagaaggaaaagaatggataataaacagtgtcgtgtgtaagtttccccagatctaagaacagagagggacaaagaaatgtaggagagatggatttgggattaatcaaatggtttcagtgcaaagtcctctggaaatcacatctctgataggcctggctcaatgagacactccaacaagtgtcaagtcctcaagatagtagattccagtgatattttatgcttgtagcaatccccatgaggaaggagggctctgtttcacatcgcagttgagagagggagtcaatgagattttatgacttttttgggatcattgaggccacaggttgtctgcagagtcctagccaagtttctctccactaaatgacgctgctttgagaccagaagctctctcttttggagggggtcagccaggaccaaggcagcagttaactggcctccaaccaactttcatgaggctggccttattaaactaggtctgaagaaaaactgagtcaaccatttacagacttattatcttctttctaaaggaaaatcataatgccttgccaaaacaaatgtaataacttggccttttctttcaattacctctgctttcttggaaatgtgtatctgtggataaaacctctgagttaacccagggaattaaccagatgtttaagaagaccctgtgattcctgtgggccagcaaagaaagaataccccttggccacattatgagaatggagtactaaggagaaagggggagcagaaaattaaacttgaaggcccaggatttaaataggcatagcagatagaaatgttagctcagttttgggggattgggtgacactggaagcaggttttggaaatccaggcacaagctgtgtccttgaaaagacagtctcatatatttccagagcccttcatttcattttcttcagtctatattctacccccatcttcctattccacatcctcattacactcccatttcttcaacagctaccttcaggacctacgatgtatgctaaatccagggaacattcagagggcccactatctcgacaaatttcctattacaactctaagccatcttttgctgtatgcaataatttcctttggggagtgttggcatgtaatttctgaggttcagccctccctagcatggcccagaaacactgccaatatttacaatggctggtgtaggcagttcttatgtctcaggagttggggatcccttgttaaggaagtaataggccaatgatcagtaaccatgcagtgatatgagtgcatggtttggggaaggggtggaagcaaaacgaaaaggtgggggggattgagctttcatcttctgctctatctgtgtagaatcagtttcaccacactcatccctttgtttcccatagaaatggaaaggacaatgggaggaaggtagcattaagcttaagaatatggcttaggattcaatcaaggactgtgggcttgagtcttagccctctcatttactatctctgcactcttatttactatctctgcaacctcaaaaaaggttcttaaatgagcctcagattcatgtgaaaattgaagaaagtaaagtatttacttctttgggttgatgtgatcattaagtgaatctttacatgtgaaacgctttccatagtcccccagtcttccaatatgattactgcttttgctcccctacaagatttagtcagggatagaatgtggggggtggggggaagaggtggtagtaagaggctatagaaatttagtatttttatattataaattatacatcattattttctttaatttagcaatccttttagattcatcattttatgagaagaaaacttagaaaacactaaagtttgagatcattaagtttgagaattggcatgtctcaagctcctcctctccttcccacatccccatacgggcactttctctagaactgtgcagagctggcacatttattaggccaccatcacaacccttcagagaaaaagtaagacctaaatgaaatagtcgtgatcatttcgtgtcttgatgctccctgtgtctcattacctctcagggtctctatcaaaatcaagggctgcaaatctttcaatagagaaatctattagcatattttccaaagaacaaaatgtacctattcctgctgtcagggctgctgtttgtaggagtctctggtttaaaaggccctcgttattatgcatgggtgtgcatacaaacaaaacttctccgcatgggaaaagaattttcagctttcagtaagaggctcttttctcaattcctccaccatcactaccaacctacaccctctaaaaacctctccaacctccactgattctttctttcctctcctttgaaaaagtccggacttactgtataactacatatatgttaaaatcaccaactagagaaaataaaattgagtaatattcttgcaagtagcagaatctcaaacatttgatggttaacttggctgctttagtcaattggatgattcatacaattatggggactggttagaacttgaatggaattggttggactggcacaggcaaacttctcaagacatgtcctcccctcagccttggcaaggcactttttgggtctgtacagctggactccatttcatttatcatcacatttaatattttcttccttttgatgttacctgattataaaaatgagaaatcagttttagtgctattctcatgtttccctgcattcagatttttattcaggcctaaaagtcaaggttttggggaaagtgggaggatcacctaaagttgataatctaggctctgatgtccgattgactggagttcaatcccagctttgaccacgagtagctaggtaatcttgtgcagttttactagatctttctgcacctcagttcccttacatgtaaaaggggtacaaaaataccaatttgccaaggttttgtacagatgaaattagacaggctttggcacatattgcacattcaatacatgttaaacattttatcattttattaatatatctatttcaagatgaaatattaatataattagttgatggtataattagtaggggttctaatttcatacattctcgaattcccaataaataagtgaaaattatcttgatgctagaaaactacatcctaggaaatcttttgttgtaaacttagatgacgaggggctcttttctacccacagctcccctagtttactcaagctccatgtctcctctttaccaaccccgtgtcggcatgtagccccatcctgagcacacagtacaccctaatagatattttgcaaatcaggcaagtagcacacaggagttttaaggacctttatataatttcaacaaattcaaaattctaaatctccatagaaacacctttatgaggaatataaggtaagaaatatttctgcagtttatatggatttaaacattttaaggtcaaatcattgtaaaatgtcatgtaggaagggaaggcctgaagtctcaatctgggtttcaggcagggaacctgaaaacctcacaaagccacacataacactattagctcaaggaaatgtttctcactgtaacaggaaaagggaaagttcgaatagaagtctagacaggttgtactgaaagaacaatcagatgaaagagcaattcaagccgggcatcttgtgcctgtaatcccagcactttgggaggccgaggcaggtggatctcctgaggccaggagtttgagaccagcccggccaacccggtgaaaccccgcctggccaacctggtgaaaccccgtctctactaaaaatacaacaattagctgggcgtggtagcaggtgcctgtaatcccagctatcgggaggctgaggcaggagaatcacttgaacccgggaggcggaggttgcagtgagccattgcacttcagcctggctgacagaacgagactccgtcacaaaaaaaaaaaaaaaaaaaagagcaattagagattgttagcatgagcatgattacactgcaagaaccaaatagttaagttttttttaagtcaaatattgtaatttcaattactcttttaaaaaagagtaattgaaaactctttttaagagtttacaaaagagtaaattaaaaacatgctcttttaaaaaagattaatttataaggttgcacagtactcctacaaaccacattagatacttctagtagttaacaaagaggaaaacaatgacattttacaaaataaaaagcagaattgaatacagaaaaatatgacttaacatcaaccaaaaaccaattgattaatcttgtcaagattcttgtcaagattctcaccagacacccaaatactgaaggattacaactattgcatcattaagatatattaaaagaaatgcaacaagcttaaaatctaataaattggagagtaaacacatatactctgcataactgtaatttaatttcttaaaattctgcaacttccaaataaacaacagcagcagaaacaaaagctcacataaatgggtcacagtaaagaccagttgcctccacttaaacaatactagcacaatcgtgtgggctacatccttgaaagaagtagataatccatgcacaatttgagaaaattgattacatatgtgtgtatgttatatcttatacagtatacattacatcctcaacattaaaaatttaaaaaggccactcacataagttaccttttggaagaaacaatgatcttttctaaagaaataataattggtgatttgttgatacttacagtttatgtttggaatagtctcatttatgggtatgctgaaaacaatgcaacaattttctattaatccagttctgatcttcatactcttagcagttttagaagagctgagaacagtgacctgctttttcaaccattatatttctgagacatgactaatttgaagctgagcaaattgcacataatgggattcaagttcatgatttttagtctgcactctcttttcagggtacatggtctccttccctccctgcttctaccaccacccccaaagctgccttttcaggagctaaattcacccaacatgaaatcaaaagagaattatttttaagttttctgcaggcttatttttaaggaggataaagttatatttttaaaaatatttatcttttccttcaggtactaccgcatttttaaataatttctaaatatttagaatgtatttagatgtatttagaatagtagatgtatcagatgtatggtttcatagtggctcaaagtttttaaaaaagcattatataaatcagtgaatttataaataccctaagttctactatgtaagatgttgctttcagagcctttttgcaaaatcccattaaaggtttagcttacagacactggtgccaaaaaaaaaaaaaaaaaaaaaaaaaaaagcaagcaaaaaaatgtgtttttttttgtttttttttttttttggtaagaaggatgttgaaataggagaatatttaagctggctaaaccaaagccaattcctggaggctagttgcttttatagtgaatgtttaaattttctccatcaaatctagaaggctacaacgaaacaacagcctaaatgtcatgtacaattctctaagtactgaaagagttacacaattttagaaccgaaagggaccttaaactccttcctctaccaatgaggagcctgaagcctgctagttaactcacttgcctggtcactctggggttcacggattgttattgtttggtggggtggttgtttttgtgctgtatatttgtgtgtgtggtgtatgcagtactcacacccttacaaacaagagctttgccatttatattctccccttcctaagttgctcttcctaagtttactttcatcagcaaaaagagtgatcaaaaagaaaaatatattctggccagttcaaaggggacatttctttttctcacttggcctactgcagatatattagagagacacttcacacccaggacaactgactttttaagtggcaataacaatgagcagcggaggagttctcttctcactcgagagagcagaggaggtttctgaactttaccttgacttccagcctacaaactgttccttcaactactgtctccgcttgcccactttgttgctattctttccttagtttcctttgttttccagcttagggaagtttggtgggaaaatttttcacttacattttgttgatatttatttcccatatttgggtcctacccaaattttagatttaagagcaaaaaaaaattactgtttaagtgaaagaggaaaggctaagtcactgttcaacatgggctagatctgatctgaattggagacacagcctttgcaattgaggaaggagaggtaagcagtaaacttatacagtttcctccaagaagtgttatacatagatatttttcaaggaaattggaataaagcagtttattaattgaggggaagctagttacagttagcacctgccgcggactttttgaggttgtcgtcattaaccaaattcttcgggaaaaacaatctttggcaccacttactccagacaaaccctgtttggaacagacaagtgttctgaccctatagtcgctccaatgtccaccagccactcacgagtgcccttagggcttctccttggtggtagcatcccagaaatcctactagtttcagaagtgccctaggaagcctacttcttggataatgggctctgtctgcaaagctaggagatcagcctagaaaaagaaacacaccaacaaacaccaggaaactatgtgtaatggtttgctgcttgtgcaaaaacctcaaagaggatgaaggtcagacagggataataggccaatttaattctgaaagcacaaggtgcaagaaattttaattatggtctgccactgaaatcacacaagatccaatggcatctaactgcaactgctcatcaagggagacaagaggtgtaattgtaaccgctgcataatcactgtgagggcacagggaaggctgccttcagctcccagcagagaaggtattaagagcctcgaaaaatccaatacggggaaacgagattgcatgtagccaaacagaagctcctaacacaaaagccaacccgtgtgtgtgtgtgcgcgcgtgtgtgtgtgtgtgtgtgtgtgtgttgagggtgagggttccagaaagaaaatgtgaagctgtttggcccacactggggataagagattgtttgaaaactctgaacccttttctgttttgtggataaatgcacacagagaaaagagcactgtctcctttaggtatttctctccttgatgaagcttcacccactctcctttgtttaagacaattggcttggatgttaccgtgatttacagtaccaaactccctttaatttgttcccatcaaacccaagtctggagacaaaacgccaagcacacgactggaggtgcccaagcctgtgcagctctggcagcgacgccgccggcgcccccgggcgttttccccgcaccccacatcgcgtgggcgcccgtaaaggcacgcgcggagaaagcccctccgtggactccccactccgcaaagtttaacaaagccgtgaagtaaggaaaccgaacctcccgtccgcgcccgctgcaaagttggcattgaagtttgtgccgggatgtcccaaatcttgagggggcggggggcgcgagtgtgcagagaggcgggaggatggatgcagatggggagacagtgaggggaagggagtttttccgagtggacggtccgtgaggcggttttcttcacccggaagcctgtttgactcagagaggtccgggaggtgcacgccaggggaggtctcccggggcgggcgctgtcgccgaggaggccggcgagctgtcacctgcggggggctgtggtgggagctgagggcgctctcctaagcgccaaaagaggacggggacattcacagtcaccggctctcggggctctaagtagtgggggaagggatattcacgagtgggcaggaggccaaaagcaacacctttcggatacgcttttcccctccgacctctccaacttcccgcggcgctggtcaaggactccctcccaccccaccccatcccacccaacctcccggccgacaattcggacctgtccacggcagagcgtggggtggagtgcggcgggaaagcagagggcgcgaaggtcgggaccccaaattgcaaaccctcagcccctagcaaagacgaccaaatgcatttacaaccgtgcaagtatctcagccttgtaacagagctccgggtttgcgccgggcacagttccccgactcttctgttgttcctaataaagtcgattacgttgccctcccggagctgattggaagggaaccgagaggaaaagggggggaacgcgggaaaaagcgggggggggggggggcgagcaatcaactttgtaacccagcgcttcctcgcgcgatccgtcgccatgcttaagattcccacccccgccgcccccctcttgcctttcaagtggatactgaaactaggccaaaactttttcccctccttttctcttagccactagactggattgtgccccacggagccccatggagctctgctttcttaagcacaatagccggactaattagatcatagaagcaaggcagtgatactgtaacaagtagcccaagaggcaaagagggaaggggcccgaaaagacagaaagggggaaaagtttgcagctctccgcacttaccaatcaagcctcccaccagaaaggcgatgatttggaacacgagcagaatcccaccaacaatgcacagcttcttggtgctcatgttttctataattgccccagccatttttgcgccccccctttttcttttctccttgaaataaatgttttagggtgagctttttgctccctcctctcacacactccctccttcctcgcctcctttctgggcgctgcaaaacttcagaggtgctggagcgcggcgaggatgggaccgggacggaaggcgcccgcacggattcccccggcgcagccggctcgggttcccccaatgcccggagctgtgattgtggccgctccgccgcctgtggacg

SEQ ID NO: 2466 - DNA, 423695 bp, Homo sapiens
taaaggagggctctcctccggtgtggaggcatcatggccgctaaatcagacgggaggctgaaaatgaagaaaagcagcgacgtggcgttcaccccgctgcagaactcggaccactcgggctcggtgcagggattggctccaggcttgccgtcggggtcgggagccgaggacgaggaggcggccgggggcggctgctgcccggacggcggcggctgctcgcgctgctgctgctgctgcgccgggagtggcggctccgcgggctcgggcggctccggcggcgtcgccggcccgggcggcggcggggcgggctcggctgcgctgtgcctgcgcctgggcagggagcagcggcgctactcactgtgggactgcctctggatcctggccgccgtggccgtgtacttcgcggacgtgggcacagacgtctggctcgccgtggactactacctgcgcggccagcgctggtggttcgggctcacgctcttcttcgtggtgctcggctctctgtcggtgcaagtgttcagcttccgctggtttgtgcacgatttcagcaccgaggacagcgccacggccgctgctgcctccagctgcccgcagcctggagccgattgcaagacggtggtcggcggtgggtctgcagccggggaaggcgaggctcgtccttccacgccgcaaaggcaagcatctaacgccagcaagagcaacatcgccgcggccaacagcggcagcaacagcagcggggctacccgggccagtggcaagcacaggtctgcgtcctgctccttctgcatctggctcctgcagtcactcatccacatcttgcagctcgggcaaatctggaggtactgtaatgggtgggggaaaagggaggcttgctgctgctactacatccccactgctttgcttttgcacggaaatctttcagggttgctttggtagtaaccctagtcacactcttccagttttttgggtttcttttgaactggggcttgcatttttaaaatttgcaatctcagtctagggtgggagggaagtgagaagcaagggaaggacagcaaagtggtttcgatcacctcatcccttctgtcttcccactctgccttactggcttcttgctcttggcatgccacaacccccctccccgcttccccatttttagtgatattgtttcagtgagtaggagaggattcctgtcacatcttctaaaattcctttattattatattgaatttgaggtgtgtgttgccatttggatggtttcttttgttccctggggaaaaaaaattgctaattctagtgaaatgggagttgctgctgctcaaaagtacccacatattaatgatcactgctggagaagtgctttactcaaagtaaagatcctaataggcaaatgactttgtatatatatatatatatatatatatatatatatatatatatatccccgagcatgattcagtaagctttatggggcccagatttacttttagagtgccctttctgattatcttgcaatatctccatatctaatttctcatataattacaagcctttggaaaaggggtggggcaccatgttaactttagttgtacttggtatcttcgttggctactttgctgcttgtcatctgatctaccaagtctttttacacagggatcacttcagttataaactggaatacaaggctaaacttgggcagagggaaaccaccacttgaacagtcactgcatggacttaggagcagaatgaaatagtatgctcaggaatacattcttttgacttttatatgctactagcagatttcgaagcaatattttacatctataaaaattacttatatggaagtctatagattctaacatgtcagagcttttttggttttaaaataacttagtaaacaggtggtataagcgaaatgaggacaattcctagaaagtacaccaatatgggactacactctgtggtactggtgctctttttcaattttatttgtggctatttttgtgataaaagatgtgagttcttgactatgccgaagtatcacctgtggaaacaagttagaggatttgtggactagaaccacaaacttctttttatttatgatgaacaaccatatgttcacctgagaagagcaagtgtggtgatttcacaacctttcctgggaccagagctttgtaaagcagactgaacattgccatagatggtgaccttccagattgtgaaacattttttttcaagcacacactttctgaaaaagtgatatttgatatgtagtcagacaaattgatgttggaaccttcatacatattttggactcaaagtaactttttgaaattctagttaaatatgatagctatatttcccatggatgactattgggaagacttatagcttgatgctcttcaagtatgatgaaggacttaagtgcttaatttacttactgaaattactgactggctaggatgcatctgattagcatttctaatctgataatttggtaaattaagcttaacattccatttgttaactttttcaaactttatcaagatttggaaatcacttaattttaaccacctttcaagtttctagacttatgtaaataattcaaatacttctctatcctgttaactgaaaaactgtaattttttttacagattgattctttatgaaaaatctgatattaaattctgtgaaccgaggaagtccttttaattatagttgtgtttactataccttctaaaccaaacatctccccaattgaaaaatgattcttaattttctaggggaataatatacagaatgtgagaaataattaggaaaagatatgagcctaaaaacatgtcagagagaccatagccactgggccaacttatcatacagaaaagttatttcagaggtagggagtgggggcggggagagaagggatggaagggtaaggtttgaatgtagaaagaaaaccgcaggctgtcagacaaatgtattaactgacccagacttggagaaactgtggtcacacatggctccttttagttaagcatttctatagtattttccttagaggctttaaagttaatactgataatgcatgatcatctaggaggaatattgtagttggaaatattatcagatataatattctggaaatatttgtcaacattttcagaataatgtgtgtagtagataagtttgaattatcatctaatctaactattctcagattctgattaaaatatttgggggatgccagagtaatctggtgaaagcgtgatctaagactaatcagcatcattttctgtttatgaagtatatttttcaaaaaaacaaaactttagcctaatgtaggaagttggaaagggataagaaagcttatggaacttaacactcagatgcgctctaatatgtttctatttctctgagtgttgaacattcatgtggaactttgggggagtagacgcatctttgctaataagccgacgaagtgcaactcatctcagatttttctattagactcactatgattccttaaattagaagcatccctgtgcctcttctagcttttcttttcaatacattatacacaaatattgcagaaacaccagagtactgagtggttcaaagcacagaggtcattattcatgttttaacatgctactttctgggatcaataaaatagattttagctaggttggtaactgcttcttgtgtttccatgaaattctaattattttagggaaggaccagattctaaaagctttctctaaatacagtcttttgaaataacatcaaagcatttgcttgtttagaaatagccattgaaacattgtgggtaagatttgcatgtatttatacatatgttacaatgcaactgctaaaagcaatgatacatattcattttaattaaagtttactaatgggaaattaatggcagcttttaaagtcgcaggaggtgagcttgggaaagagctatttgaaataataaagtgaatttttgctaccatgtgaaaagagcaattatgactttaaaggaactgtgcctgtgaatgaatgcgaaagtactttcctttcttatttttctcatatgattccagaaattactaagagtgcagtttagccagtgggaatcacaaattccctaagagaacagtttttagtcctcatgcttttgatcaattgcctccaaatgtctttttccttcagaaattatgaagtttactcttaaaactctacctgaatttctcctatgtatgtatgtacatagttaattattttccagaaaatatgcacattgtaaataatgagtcagtggatggtagagtggggagcattttcactattcttactcttctgggttttgtttttgagtctccatcatgagagtcatctgggaaaaatgtgaggaaaatgcagttttttctgctcttgtcatgcttgctattccagaaggcactgattgtgtcccatgttcaaataagttgggaaaatgacagattaaacaaagttaaacagctctctctacagcaggacttctcagagccttttataagctaaggtacagttatcagttaagtttttaaagtcacatctattaaacattcttataatgatgcatgcaaagcacttggataaatatgccattcttaaaactggccaaacaaaaataataacaattttattggcactttaaaaatatacaaatgtttttttctactttttatgtcatctacattttaaaataacctaaaagaaaattattagtatctgtatatgtgagacaactgtctcagagaggttaagtaagcggcttaacctcttaatagggtcacccaactattatgtagtgtagttaggattaaaaacggggcccattttaccatacagtctatgctttttctggctgaactggctacctccaaatgccaacttggataatgatgacaacaatgtataaaaataacaatttaccttcactgtggatggcaaagtgggaaagggagctgcagtttagatggattaggggatctttccaataacacactggtagttaaacagtaaaacagagacttgagcttagctctttgaactcccagttcattgcctaacttactataccatttggacatactgaggttgttttattaaatcccagctaaggaacatgatctcgtagtagttttaatgattacatggcataatgtatgtgaatatgtgaaaagttaattacaaatgataaagaggttctagagataaagaatgggtagaaaaactaaggaggatataggttacacctttgactattaaaaaaggtggtcttcaattctgagttagtcctgaattctgatatagattaggcaagattggtgccatttgctgagtttatcaaatggttattttctgcatatatgtgtttcctctctatacatataaattaattagtcattcaacacacactgagcacctgctatgtgcaaggcactgtgcttgttactaattattccaagatgaataacatatatatatttcaaggaatctactctctaatagggaagacagaaaagtcagtagaccatctcaatagaagaaaataagcacgatagaaacaggaaacgcaaactgccttgatggttcaggtaagactctctggaagaggggatatctgagcaaaggtttgagggatgagaaaaatctgctttctgagtaaagtgggacattgactttagagccctggatgcaatgtgtaaaggcagagaggcaagaaagaacaaggcaggttaagtgcatgctctacatatggagtgagggagggagagtagctagagatgagatgaagaactagttgggccagataatgaaaggaatttagattgtattttgaaggcatgaaggagtcatgaaggattatagggggtgaggactgttaagaaaagtgttaaaacactgttttattcaaaggaatggcagaaagttgaaagcttcagaggctatgtcattattcatctctgactcagtcatgtctctgtcattcatggaaatctattggcttcacaggctttgagtttggatgtcattgggacatataaatagacccatcataatgggagagtcatttttcagaaaaacaagttggttgaaagttttaattgtatttatattaaaataatattaaagtaaattattggcaaaactttctttggtgttactatttgaagagttattttcttaggatacagtggtttttaccttattgaaagttagttcttctgatccatagaaatatattccttatgtttattagtcacatttaactgtccagagagcttctatgttctatttcttatttgaccctttgaatgatcttggaggtagcacttctattttgcagatgtggaaattgagagagagaattttaattgttttcctccttgggtcatatatttctggacagattttaagctagaactcaatactgatatgggaggggtgaaagcaacatggaaaatggctgatggtactgaggatgatgaggtagaagagaagcccgaaaacttgagagctccatagtaagtgctgaactgttgtaacctggaagaggcattggacttttgtgtaggccccctgggacaaaatgggtgggacctataggaagagattttgaattgatggaaggaagaagttttttagtagtcgaagatatttgcagatcaactgggcttccttagaagcagtgagtttcccatcactggagtgtcgaagcatagtcaggaaaattaggtagagatgtggtagagagactaactctcatacagagggttgtaccagaagatcatcttccagctctgagattttgtgataatctccatcataacatgctgctccaaacatattagactaacctttgcttttttgtggatgaaagaagtagaatgaattttcgtgcaacactataattgtgccactttaaaatctattcgttggtttatagactcagtatcttccctggagcatcacaaatccatatgccacccctgagtgctggctttggcatcaagatctctgagttagctgacaggtataaatccacacacaatcagacagctccttgtgcatttacctgggtttctgtatgaattggaataatttatgtataaatctctgtggtgggtatatctctgtgatgtctttgcaataactagtgcaaagattgtaaattttttccattcacttgaactatgaagtgtttacttcacaagggtaaatatttttatacttattactccccaaccgactaacttaacagaacagttgaatgtgtagcatctgtatacatgtatactatcagttttgaacaatgtccacaaatccttggagcaatagctttgaaagtctttgctcaatctcttacaaaatgtttcttcatgattgagtatccaagcacacaacttgctagtaaatatattttatatgttacagtttgaatgatatagtccacctatgaatttaagtaacacaatcactgtctaacaaataatgtactgattctccttcacatggacttactggctaatctgattagtacatttctttacttactttagaaatttgtatggaacaactaactggacctatggaagcaagaccagagattagagttggatttattattcttatgcattttcacataaaaggctcagtatggtgctagtcaggagggaatgttttatcaggtgtgatcttgcaatgtgtaattgttgttggaatttagggaaaattatatttaataatactctataagaaatattctcttaaatggcattgcatgattctgaccaccataacaagtgacctcatcccaacaacatgatggtgtccttggtaagtgacagcatggctggtcaggaaggaagaccatggcaagttctcatgaagttagtctagtggttgtggaacttaaggtaaaagaatacatactcagtgaatatctgctgatctgtgaatagaacccaggcactattctttcttcttgatgaaggtgtagctaaacttactacttagtggcttctctgagattctaatggtgtggtgaatcagaaaaggtgcaatgtcatctgggaaggataggaaaaattaccccagctctttttttagattactagtgttgggaaaataggggtaaattttgtgaatcgctagttacactctgagaaaaatgcagctggaagcccagctttgtattcctggttttgctgatagaatagtcagggtggagaagctatctgataggtatttttcattgaattcttacctatacttgactatctgaaaatatacttatatatggaagaatttttggtattttttatgcttcagtctactcaaaacgtttgcagcctccactgttactaccaccaccatcatcactgtaattcttatcatcataaaacatcaattctacatctagtatatgtatagaactgatatagattgctgattgtaggagaaactagagaaagattaaaaggaaaatccctgaggtggtctgagtgacaccattaggtcttttttaaccctaaaatagacggagagggtcatagttagaatgtcagtgataaagcttatttaaagaggcatctgtccttttgggaattggactaaatatggggtatcagaagaaatgatttggtctccaatagcagcagattccaggcaggctacctgactgctctgggtcatgtgccattgtgggtgcagatgacacatacggcccagctcctggagcctcatagactagatcttcttttggtttcctccttctgggtcttaattttctatctgtatgatgcgattggttaaaaataatatcctaggttctttccaggtctaaagttctgattctgctcttattatacattcttttcacttgcctagtacctagggtatatgcactagaatgtctacaggtgttctaagaccactgttgtaggctttctctgtttatgtaagtccaaggggatatacaagggactttccagggttgataatattagtgtctaaactcccaggaactggcatggttcatacatagagagtcttaagcgtatttacataatgcaattaaccttatgtcatttccaaattttagctataatcaaataaaacaattttcattaaaaacacatatctacatattcgaaatgatgtcaaaagtcttccgtgtcactgattctaagatatataccatatagactggagaagccaaaattgccatctagatttcatgtggtgaggtatgcatagctggagtgctgtgattaacaaataagaacaacgcttcacaggcttgaaagaactatccattatgtcaatgagaaaaatggttgccagagctagatttgcttttaaattaaaagcttgtcctgggtcacactgtcactgatttaatattctgaaaattggatttaaaattggatttaaaacaaagatatgacatccaggcctatccttgttaaaaataggggtatggtgcactctgctagaagaacagagcattgcattagccttccctgagaactccctggggataggaattccctggattctaggttcttagaaatctgatgtgaagctgaacgatttttaaccccatgccaacatttcagatttaaaatttttaaaaaccttaagcatccgttttaaaattatctgaacaaagtatgtcaaactattttctcatctttatgattcataagtaggctgtttgaatcagttctacttcttttgtttaatttatacacatgccatatttccctgttggggaatccttttatataaacagagcagtgggcattgtgtggggtgagtaacgatgagtcaaatagagaatcatgcacatatagaagtaggatctatagggaacaccacttgaaaaagacttgagatgactggtttgacttcccctcaagtccattctatttaagaaggacagagttgcctttctgaatcaccaatctgacagatttcatccatgtgaaagcagtctgacttcttttatctgcagtacaggtaatagtcatgaataaagatctcagtctggggctgaattctttacttttcaggttttttttttttttttttttttttttagggagcagagagtcaataatcaaagcaaaggtagcaatcgtagcaataacatcaactaaatgattccctataacttctatcattagttcatggcatagtcactgtatcagtgtgacggtaacaatgaggaaatgatcctttagtgaggcaaggaaaggatttgtaaaggctttttttgttttgatagacttccagctcattaattaacttcctgttttgcaagagtaaaattaataacaatccatttttaaaatgtaggctaattccagaagactgtcccaaacagtttataatacctgaatttgttattataacataaattaagaggcatgtctcaataaagttttgtatttccaggaaatctactactcgtaagagtggcagtcacaaatacataccttgtgggattttcttcctgatggggtgatggctaggtttgaaaacttgagttctagaggggtgtgggtttccttacctcatcctaaggaaagcaccaatattagttgagttcttacttctgaaaagtcataaagagttacaattatttaaggatataatatctacctactttgaaataaggttgggatcaaatgagaaagagggaggaagcctgaaggttttatctaacaagcatgtccaaatactctagaaaatatcactgtgttgccttctctaatctgctaataggaaagtagcatgttgtccataaggcatgcatctgttagctagtggaagaaaaatttagccctgagagaaatgaacaaaaagaaataattttattccacaatcagagagcagattttcagttcttagaaggagtaggaaaatcgtactgacctccattatgagatacatcacagctaagcttaaagcagggcttcgccagccaggccaagctcctcttagatgagttttttccaggggcaaagaaagaaaaacttgagttgtgataatggtcaggtttatgaggtcaacttgatatatatttatttaatttttatagattaactgggtgcatgtacagttgttttacatggatacattgtatagtggtgaagtctgggcttttagtgtacctgtcacccaaagagtgaacattgtacccaataggtggcatttcattcctcgtgccccttccaccctcccaccttttggagtctccagtgtctgttattccactctgtatgtccatgtgtacccattgtttagctcctacttagaagtgagaagatgtgttttttgactttctgtttatgtcatttcacttaggataatgacctccagttccatccagttgctgcaaaagtcatgattttactctttttagtggctgtatagtattccatggcatctatgtattacattttctttatccagtctgctactgatgggcatttaggttgattctatacctttgctattgtgaatggtgctgcagtgaacatacacacacatttgtttttatgatagaacgatttatattcctttgggtatatatccagaaatgggattgctggatcaaatggtagttctatttttagctctttgagggattgccacactgctttccacaatgtttgaactaatttagactcctgccagcagtgtatgaaagcgttcccttttctctgcaacctcacaggcgtctgttattttttgactttttgataatagccattctaactggtgtaagatggtactcttgtgattttaatttgcatttctctgatgattagttgtgttgagcatttttttcatatgtctgttggctgcttatatatcttcttttgaaaaatgtattgagagcaccagtggggtcagcagtttgtgcatgtttgactgagaattttatgttatcagaagtgtacaggaagtcagagtccagagggtgaaggccaaagcacatcatcacaaatggggccaaaacacatcatcccaaccctgggaatccaagcaaaggccagaaataagcttactaattgaagaggtgggtgagaatctgaaatcaaggacatcaagacagtaaaccatgcccatgcttcaaaatgtaaaactgaagagaaatttgtttgatttatattcacaatagatctacttctgttccaactgaggggagggcagagagctgggactgcaggcaggttctcactcagggacgtcaactgcctgcaagctcatgagcaactcatctgctaaaccactgcctggtcactaagatcagttgctgagaataaaatgactgaaataagcaaccagtgttagcccctttattcatggactccacaaacatctgcttagggtcatagtaaggaaaatgcattaaaataatatgttttcaaaaagtctactcactaggaaagcagcctagtcatgggcatcccccctaaatctctttgtgatgatgcgccaaggacagagctgtgggcttgttactgaaggtggaatctgcaaacccaaactgtcagcatctcttggaagcttctcagacgtgcagaatctcaggcccaccctagccctgccaaattgccaccagcattgtagcaagatgcccaggtgattagtatgcacattagagtttgaaaagcatggagcaactactgctgctacagaggagggaaatttcagctcaaatggtcagaaaggctaatgtgagctggacatttatgggaaatatggttgctccagatatttgtaactggctttctcaccaaacacctagtatgagctaggttatatagcaagtgtagtatagcaagggttgttgcttggaaacttaacagtgataggtgcatacacacacacacacacacacacaaatgaatctccttatagacaatgctttaagcaaaatgtgaaatgttttgaatggcaaaagaagtgaaagattgaagtctttattgaaagtccattatttgctgggtgtggtggctcacacctgtaatcccagcactttgggaggacacgctgggcggatcatgaggtcaagagatcgagaccatcctggccaacatggtgaaacctcatctctactcaaaatacaagaattagctgggcatggtggtacgcacctgtagtcccagctactctggaggctaaggcaagagaattgcttgaacctgaaggtggaggttgcagtgagccgagatcatgccactgtactccagcctggtgacagagcttcatctcacacacacacacaaaaagtccattattttatggttttatgttgcagaaccaatctctaagaagataattaagcacattgactgcctacctctcacagttttatgcagtactcagaccttatgtcatttgggctttaggactggagtcatcaaagtggacaggaggtggtgagagagggaccaggccttcacaacagtggtggatgctgagggaaccattggcttcagagtaaccagacaccaagaatagagagtgaagagctctgaccaagacatgatagtggttgtctttgctcagagaagtggagtgggctggttctgggcttatttttatatttttctgaaaaagaagtagtgagggtggacaaagtttgtgtatgctggctggatggaagggatagtggagagcgaggctgggtttctgaacattcctctgccttagcttttaatctcctagactgaagagcctctgtatctacacggagaaagaactgagataggaactgaggaaaattgaactgggactccaggtgtgaaggactaatccccagccaggagttagctgcatatttaaataaaacaatacagaaagagttctggtgaacaacctgctccctgcacttcccctcctcacagtgacccctgaggcccacaaggcacaggtttactgtaaggagaaataggatggctcagtttgatggcatgcttcaccatttgtcttcctacgtgagaaatgtaacgttcaacaatatgacaagacatgtcagtgtctatagtttagaataaagggataatgagaatgatgccttataaaatgcatatttgtgtagacatgttattgatttccttatttcacattaaacaagatagaaatggatgaccttcccagaaatgcctcttttcaaagtaatagttttctgatttccctttcatgtaagagctggtgttgctatgctgtcacttttcttgctagggttccctcccccatctatgtgctgggaggtgattttttggttcagtgttcttaaatgtttccatggagagttactaaggtaatttttttaagtctcctctttcagtaggtgtggtcaccccacatggctttccatatgcttgctactacccacctgtgtccgctgagcacttgaaatgggctggtccctattgagatgtgttctaagtgtcaaatacccaagggatcttaaaagacttgatgtgaagaaaaaagataatatctatcgtattatttttattctgatttcacgttgaaccaataatgttttggatataccaggttaaataaaaaatatatgataaaagttaattttactggttgttttttactttataaatatggctaccagaaaattagaattgtgtatgtggcttgcattattctattctattggacattgctgagctagatgatgtcagatctttttgaggagtgagaagagggaaatccaaagtgaaatatttcaaaatactagataagaatttactagaagttaccagggaaagggcagtgagttattttgctgctgaggcaggtttacttaatggattttgcaaataagattagctgctggtaaaaatggactctttaggagacaaaatccctaatatgagtaaagctcattgccttccctgcttcctgccttgcttaaggccgagcaacatgctgtgcttatttggtggattaataaatagtacttgatgatgatgataaggagtaaatctttgtaagtgccattgtagcttgccatgcacattcattctgttaaaccatccgatcttctcatcaggctcccagggtaggtattattgctattctcatctgaggatgaaccagctgaggttcagagagggcaagagacttgctcaagtgcacacagctaccaagtagcaagtacctgggctcactttcatgacttttgtttccgaatctcatgcttttcccactatatcttactattccaaggttaatccaagactcacctggagaagcatttcttgacctttcagactgtgctaaaaatggtaatgagttcaatgttaccataatatcaatgagaactaattaagaccaattatgggattttctgctgaccaccagggtgaccaccagctgttggactcaaatttgagtcttcacttagtgctgttaaattctcagctataaaatgttgggtgggagtgaaatcagatcatttccggatcttttctagttctgcagttctatgaaaactggcacctaaaccgagaatatcaattctttttatataccttattgaatatctgcgtgtggactgatattcacattttattgacctgggctagatttctgataaactattcctgggattgatgtgtcacacagatttcaaacacggagactataggtcagttttatctaaaatgtgtcaaattcatttgatacctactggtaaaatacatattatttccattgggaaatgcgtagtactaaagaatgctaagtatattccattcccatgtgaatagtacatcattagcttgtatttatatcctcattttgtatgtagtcatgctttgcatatactagcagcattctaccccacatatgttcatgaattatgaattctactacaagcattcaaggcaaagctcctctgtcagtcacatctctctctctctgaggccactaggatttatatctatgtgacatacttcaaactgacctcctaagacctatctcagaggaccaactctaacagtccagcataggcaagtgctagaagattcatcactctcaaatgcatgcaattcaaaattttcagtatcagatacagctagtctttgtataaacaatgccaaacgttcatttctaaaaatcaaaagaattcccttgttcccgttcaaaagatgcttctcaaaagtgaatatgacttgcgttgaaagggctcaccaactttattctggtccttattttaatttctttgtagcattccatgaataattgtgcagtatcatttttcttttagttaaatgattttattgcaaagtatgtttttttttggagagactaggtgatttctaaatatgtttttcgaagttcatggcacaaaaatttgttctaatttacttagatttttgatactaatatgctgtaagaaacatgaaaatctatagcacttttttttcatgattttcttccatatatacatgtgatcatgtagttatataggttaggatgtgtgggtaaaagcagacatgatttaattaaactcagatactgtggagtgaaaatgccttcactcattcatttaataaatatttaccaagcattcactctaagcaggctctgagcacgcacacgttattaaaatgtgctctctgacttcaaggaattcactgtcctgcaagagtctgccatttataactgtttatatcccaaaggtgccctgcattatcagcaagggcagagagaatgtagtctgggaagggactcccatactgggaagtccctcccagaagagactctcagactgggaagtccctcccagaagagactcttagactgggaagtccctcccagaagggactcctgctgggaaggtttcacagaggtaggagcttttaagtgggacttaagagaatgttaagcagaaaaaaaaaggaatgggcaaagatatcttctgctgtgttgtgtagagggctgaaatggaaggggagagggagagaaggacagcagatgagaagggggtttggggccaaactaaccagcaacttgggcgctctcttaaggaatccgaagttgactgtgttggggaatgcgcagcaatgagtgtcaggggaggctcacaggccacactcagacatgtattttcaaacagtttccttttcaaagtgggaaagaatcaattgcagtttgaaagtactggagaaagaagtttcctgtactcttcagaggtggggaaaaggaagtgtgagtgaggggtggacttgaaaaatcttctgagctttaaaaggctccataatgagtggagtgaaagcatttaagtgggcttggctgagttcttactaaagattctggtagtgctggttaagaactctacttaatgaattattggaaaaggcataaacataaacagagttgggagcatgttaaataaagatgctctgtaaatgcaggctgggcaattaaaaaagatttaccagagtaaagcttaatacagtatagtggataattaatgagcctgtgacaactcagtaataactaccctgaacttttacaatggtgcatgaacatgtgtgcaagtcagaaggagggtttgttttcacagtcagctccagttagctaggaaatttctcgacagaagttaattagggattcctggtaatggagcctgctgcttaaccaacctcctgtgccaaaggtaactgactttgccattcattcatgggtttcttgttgagcctaaagggagtttggttgtaaatttgattctcccttttctcagttccctaagctctcactgtagcacatgttttgagtttaagtagggcttacctttcttactttaagaaatgaacttctgtttgttttataggcgggtgaactccaccctggaaagacctctgttggtgagctataggtgcctgactggtccaggaaattcaaattattaggatgtggtgaattctctgtctttgatactttgggaacatgggttagaaactgctcagtaaatattcttaagaaaatggtacttttgagacccctgtcaccttttatttcagtatatcttcatttgggaagttttcggtttacagaagaattgaatggaaagtaccgaaagttcccatatgccctcttccccttctcccacccaccatttccagtttcccctattattaacatcttgcattagtatggtacgtttgttacaactgatggaaaatattgatatattatcatgaactaaagtctatagtttacattagggttcatttgttgtgttttaaatacttgtatgatgacatgtatttatcatgacgtatcatacagaatagtttcattgtccgaaaccttccttgtgctctgcctaattcaccttccctccatccccacaaactcctggcaatgactggtgtttttactgtctgaagttgtgccttttctaaaatgtcgtgtagttggaatcatatagtatgtagcctttgcagattgtcttctttcacttagcagtatgcatttaggattcctccatatcttttatggcttgatagctcatttgtttttaatgctgaataatattctgttgtctggatgtactacagtttatttatcacttcacctattgaaggacatcttggttgcttccaaattgtggcaattatgagcaaggctgctataaacatctgtatgcagggttttgtgtggacataagttttcaatttatttgggtagataccaagtagcatgattgctggattatatgggaagagtgcatttagttttgtaagcaactaccaaactgtcttccagagtggctgtaccgtttcacattcccacacttaccaatttctgagcacctaccctgtgccaaatgaccctatgttgggcaacagagtagtgaaccagggcacacgatgttattctagaaagagttaagataccgtgaacttgtccaagttacagacacactaaaattagggagtagtttgctgtttagaatttatgctttatagtacagatcacataattatgcttgatgagaaatggataaaataataaaaatttaaattactgtaaaagattgtatttattctagtgattaggtagttctgtggaattattctgctggacatgtagacattgagttctggtaccaactctctagattcacatgggggaaataaaaaactattggaacaaaacttgtctttgtaccttgggaattagtgatttttgtgggtttttaaacttgctcagtataattattactttacaaatgtaattatgaggtaaataatttttatgttacagaaaaaaggcacggcacaaatacaacattacacacacacacacacacacacacacacacccctttgacatactttggagctctgcctgagagttggacagttgccctggggtggcagcctgattcactcacctctgctccgcttgggctctgcctctaatggacctgaatggagaatgtatgtataaatggcagaaaatcttctttttaaaaaatattttaaaaggccttgccagaatctataaattgttatagtattagctaggattgagctgaattatttttataatttttaaaagcagataatgaattaaaaatttcatcctcatttgtttgactaaagccaacaaataagatggccatgttaataatttttggcctaaattatatagtcagataattttcttgtttactttgtactgtatagaaacaactttggtgtcaaatgtcagtgtcacatgtcaaagtagtagaaatgtcttttcattttgcataaaaatttgtttcatctgtgttcccaaatttgttaatatatcttaaacctttttggttttaaaattttatacaaatatctgtgaaactgaaaattttacatgatgcattatgactattttaataaggctgagaatgacactaaaaccttattaaattaattaaacataatcagtattctatctggttgacgcctcttagctttgaaagggattgagacttttacctctcaggagtgaaaataatttgtaagtctgttgattagaatggaatgacttgtgaatagtcagtatgtgagcatgtctttctgtttttggaattagcacgtgttaaagaatcacgttttcgtgtgcttcaaaggaaaaacaaagttctacctgatttagagatgaatgctctgaaattccactggacaaacgtgagatgcaataacaattgaatgaaatattgttcaaatgaactctattctaaatgctgtgacttgcagcaaagtgcctgcccttttttttttccttctgtttaagaaatgattaattaaacctgtagtcacctgaggagtttactgtggtcacatggagggggtcttccagcgaatgagaggaaagtgaactggaaggatgggtgaagacggaatggcagggtgtggattgagcttcatggggtgtgtgtacaagctcctctctgaacccacttgtacctgacatttatctgttggcttgcacttctttcctaataccttccacttactgtggaacagggttattgattcagattgactcttggttttattagcctcacactggttagtttcttttctaaattctgccactttctgaaatgtgctcctcatggaaagagaaacactttaatttgctcacagtagtatccccagcatgtggtatggtatatggtccatgtcatttaatacatatttattgattgaatgaatgaaatggaaatcagcaaattattagaggactttatattcattcccatgaaaactgagtaaattcctcatttctagatactctgttttacttgtgaacctcatccacagaaatgaaaaggcatatgatgcccaggacgttcccatgaagcatgcccctggcctccttgttgagtttagcagctggcatcaggccagtgggtggaaggagtggatttctgcagtcagcactccctttgagcccagagcataggctcaggaatctcagaacccttcagtccatgatgacactgcattgtctaagtctgcctgttggttcccttcgagaacatctcaggagcagctatccactgagaaaatgggagtaccttccatcccagactcaggacaggcctggcccttaacaagtagctttggtcctgctggtttcactgctccttctcagaagcagcctcggacacgtgcctctatgtaatatcctcctgctgtgtgtgtgtcccacaggggacacccccgcacctccaagtgacagccatgatttattgatttatcagtgtgctgatcccattcttgttttctcttaaggactgagagcaaacaagtgatgaaatttgcaccatttttttagactctgaaactacaatttacagttaacaattctcattggacaaaaatcaatggcaagagtaatcctagcatccccctaatcttgacctgcctgcatgtcaccataaactgtttttaggtatagcaatcccatgagatctacttttttgttttgccactatctttaaaacaaggtgagttttcttgtcttaaatgtggcccataccctctctctgccctcctcaaagctgtcatcttaacaccatgcagatttacaaatgcctcccctaacttcccctgatttctcctgcctgacttggaatgctggctcagactttcccaagctggcgacgctgctcactctccatgtggttccttctgctgtgctccttggccattcatctacttgcttgctcctatcaccacagcctcttctcagctctttgtggaaccttctttagtagagcaaaactacattccttctccccagcctctggttcatacagagtaaacagcattgttccctgaaggcgggacaaaaggagctgtggtggtttcccttttcaaggttccttttagtttgtttctgagcagcagcgctgctgtaagatttaaagctcatgattgtttattattattactgtaatatggtatctcctcgcattcagttggtgtcatttttaatcttttccattaacttttaaagctacatttttaaaatcacaattccttctgtaacatcagagtaagcgttgagcttcagaggagctttcagcatctcaataatttagtgacatttggccatggtttttgctgttttctcagacatacatgccatccaaaccattttcaatatccttttattttattttttattctttttagatacagcattttgctctgtcacccaggctgtagagcagtggcataatcatagctcactgcaaccttgaattcctggcctcaagcaatcctcccaccttagcctcccaaagtcaatatcctcatttttacttggaaagctagatggagatttctaagtgcaatataagataaccatcattttattcaaaggtgattagtctatccatgcttgaaatattacatttgataattcatcagagtatttaataaagttctatcaagtgctaggcagccaattgtggcaacatctagcctctgctaattctatgaaggtattttaaactcataagttttaacatgaagctgttttcctacaaaatgctgttgatggtagaagtaagtataacagatcttacctatttttaaaaaatccattttagcaagtgcttctcatagggttatagatcgtaagaagttctatttgcagttattattattaacttgctggtttttcttttcttttttctttttttcttgagatggagtttcgcccttgtcacccaggctggagtgtagtgacacgatctcagctcaccgcaaactccgcctcctgggttcaagcgattgattctcctgcctcggcctcccgagtagctgggattacaggcatgcgtcaccacacccggctaattttgtatttttagtagagatggggtttctccatgttggtcaggctggtctcaaactcccgacctcaggtgatccgcccgccttggtctcccaaagtcctgggattacaggcatgagccaccatgcccagccttggttttttatttcttcacaaacattgcccattaatatggtaaaatccttttacaaaataagtaaaggaaaagccataaacagtccaaagacatcgcaaactggaaaaatttatttgcaatatattaaacacaaaagcctattttccctagcatcaaatttcttaccaattaataagaaaaaatggccaacaactcgttttaaaaaatgagcaaagaatatgcaaagacaattcccagaaaaaaaaaatcaacatacaaaaagatgaacaagttcatttatgagtaaataaatctgtccttgttttaaaattctgtttgtatctgctcaatatctaaaatctgcctctcttgaaaccaaatacaaggcccttctaagtgtgagccctgtgttactacacaggttgtatgtccttgaattgggccctgtttgtagtcctcacctggagaggtggagaattttgtattccttttttttatgagcagttattatagattggctcactggacacccacaccaactcacttctggtgcatcttatgtgatagaaactgaaagctacagaaataaattaattaataaaagaaagaaggaaggaagagagtgagggaggaggaaagaaaaaaaagtttcagccctttcatgcagctagagaacccatttctaccaaaaacttgtattggtggtaacttggaatgatgaagtgagcaagttaaggtaatggctgtgtgctgggaaatgttttgttcttctggggaaacagtgacggagattctaatgtcttgtccctgttgtcctcctttgagcagcaggtcatagctccagtagagctgctggaagtaaagtctccattgttgttcatcattgtccagctgcattgctcctggccatggggcatcgaggcttggttctgcaatccctccagaaattctttaagtcatataatatcttgtaataaatctttctctacttaaaccagctggagtggatgcaaaaaatacaatttagaaggcaaaattgtgctttggcagtcatagggtagaggtggaatatgatggggagaacagaggtacataaagaaataagcccatcacaacccagagaagttccataaaaagttcccatcagactttcagttctagctacttcactgctgaaaaatacagtttgtcaattacagctaaatttgctttggggtctccctactggaatcccataaaatgctatttttaggcattcactcattcatttagtcaaatagcatgtatcaatcaagtgcttcaccaggttaaccacgattagagaattcaagtgactttgatttatgcaatgtcttttccttaaaatgtacaaaagcccaagtaataacttgctattttcaaaaaatcttaaacaggaatcctttttataaaacaaagagagttcacaggtaaacaggatgtggtttctgaccttcagggaaatttcatccagttggataaacagatcagaaaactaatcatacatagcaagtgatgagtcctgtgctagtgggttgcatggagtactgtgggaagacagtggcatgcaagaaactggttaacaaactcaagatttctccacttttcacctattctcgtatgagccagctaaaatgccccccaaaagaagtgttaaaacctactgaaggctatcatttgctatcatttaagtttaggtgcctaactcttttttttttttttcattttttttaattttgagacagagtctcactctgtcggccagactggagtgcagtggcatgatctcggctcactgcaacctccgcctcctgggcttaagcaattctcctgcctcagcctccagagtagctgagattacaggcatgcaccaccatgcccggctaatatttgtatttttagtagagatggggtttcaccatgttggccaggctggtctcaaactcctgaactcaggtaatctgccctccttggcctcccaaagtgctgggattacaggcgtgagccaccatgcccagcctggtgcctaactcttttttttttttaattttattttattattattatactttaagttttagggtacatgtgcacaacgtgcaggtttgttacatatgtaaacatgtgccatgttggtgtgctgcacccatgaactcgtcatttagcttaggtatatctcctaatgctatccctcccccctcccccaccccacaacagtccccagtgtgtgatgttccccttcctgtgtccatgtgttctcattgttcagttcccacctatgagtgagaacatgtggtgtttggttttctgtccttgcgatagtttgctgagaatgatggtttccagttacaaccatgttcctacaaaggacatgaactcatcattttttatggctgcatagtattccatggtgtatatgtgccacattttcttaatccagtctattattgttggacatttgggttggttccaagtctttgctattgtgaatagtctcgcaatacacatacgtgtgcatgtgtctttatagcagcatgatttataatcccttgggtatatacccagtaatgggatggctgggtcaaatggtatttctagttctagatccctgaggaatcgccacactgacttccacaatggttgaactagtttacagtcccaccaacagtgtaaaagtgttcctatttcttgacatcctctccaggatgtcaagaacaggaaacctgttgtttcctgactttttaatgatcgccattctaactggtgtgagatgatatctcattgtagtgcctaactcttaagcagggccagtgctctactagaacttctgtagtctcagctctcatgcacatagaagtgcaagcatcccactgagaggtaactgaagacactcacaggctgctgagctggccttgacttggcttcagccaagaatggtcattcatgtgtctctggatgaagacacagggatgcagagtgacttagtcaagtctgactttgaggcaagccttcaaagtcagtattcagttacttcatcttgtaaaagcaccacacttcatgtgacaaagtaagtgaaaaagtagctgagtctgtcttggatgactgtttaaactcatttaaacatgtcggaaaaaaacacaaaaaccagcaaaccaaacgtaccatgattgctgacatttcagctctttatgtttgacctgtgcaacaaacagacagattcttgttttctcattctggagaaagcttatgggaggtttctctccaagacaatgaatgacacaggtaatcaaagtgcaaatggcacctgctgtcatccatgcagcagtactgttattcaggatgttgaaatgcagatgcttagtcaggaggtggattgaggattggaatttgggagagatggataccaacattttgtttataggatcgtctaaccaacaatggtgataggctctcaatcttcatcagcacaaccacaggagacctggaagcttctacaaatattctcacatgccagctgaatttagaagacttttgactcagaataaggtaatattaaacttacagtgagaacaatatttttcataaagtttttgagacagcacgaacatctgttgagttttgaaaatggagagagaacccaaagatttcaggttagaggaaaatatagttttttctttctggttacaaggctggttacccatacgatattctgagtcaagaaaagaattttctaagacaaagaaataatgccctcaaaggacttctttcctgtaggcaaattccaatgaaaaaaattctcctatccgttctcactcctgcaggtcgggtgccgggaggtaaaactgccttgcactctgagctgaacctcctgatgaggagaggtggggttacagttacatttcagttttacaaaccattctctttactaacctgcaatagtttgacctcatttgtgtagatcttaactccttgactgtggcttgtttaatggatttagtaacatggaaacccaagtaagagccattttgctgaagtgtggtggcagaggccagatttttgagagtggtggacagactcggggtgagaaagttgaccctgaggaccagaagaggggatggagaggaatataggtccaggaaggtaggagtcttcagtttactttttctttagggccttattgttatattttacatgagagagtctggaacatgtttgaatatagttgaaaagggtgagggaggtggtgggagagggagaggaagattaaaattgacatggatgatactggagactgagttttattctacctgtagggtttctgagacacagagaggagcggtgttaagagcacgtgtggaagaaatggtctgtgttgggtggagaaaggaggagacaggtgcagattcagggattgctgtccatctggtcacttccattatctttgaattaggaggcaaggctatccgcggaggtgtggggtgtgggtagagcaggattacaagtttgaaggaatgatggttgaaatcatcacttaagagaatggaataataagctgactagagaaacttttcagctccaatcagctgttttgatatatcaggtactattattggcatcaaagatatagcaacttacattccagagaggaaatacagatatactcaaaaaagctaataaataggtaatatgtcaggtgttatctgctacaaaaaaagtaataaagcagaaggaaaagagaacagggagaagggttccattttatacagagtgttctgctaaggtgacatttgagcagaaagctgaagcaagtgaggaagtcagctatgcagaaacctgagacaggagcattccaggtagcagtaacacacctggtacagtgacaaaagcaaaggggctgtgtgcctggagcacagggagcaagtggcatcagaggaggaaggagggacaagcagggagccatgccctggaagtcttgtcagccaaggtgaggacttcggattttaatttgggcaattgggaaactcagatttactctatctgcctcataccagcccctttggacagagcctcagtttgcaatgtctgtgcacctggttcctggctttgccttcacagtgttcctagatgccaatctgttaggtcaggttgaccagatgactaggcccccattatctatgagggggttcatgtaagttgtagtgtatatgtgcacgtgtgtgtgtgtgtggacatgacacaagtttctttggtaaaggaagtaaaagccctgacaatctgaacataatctattgacctttcacggccttgctactccaagtttgacctcaccttcttgttagaaatgcagactcttgcggtggctcacgtctgtaatcccagcactttgggaggccaaggtgggcggatcacctgaggtcgggagtttgagaccagcttgaccgacgtggagaaaccccatctctactaaaaacacaaaattagccaggcatgatggtgcacgccggtaatcccagctactcaggaggctgaggcaggagaatcacttgaacccgggaggcggaggttgaggtgagctgagatcacaccattgcactccagcctgggcaacaagagcgaaatggctgtctcaaaaacaacaacaacaacaacaacaaatgcagactcttgagccacgcctcaaatccattacatcacaatcagattttgcattttaatgtgttcctcaggtgattcatatgcactttaaacttgagaagcctgactttagagatcctcaaagaaaacaggaaggttttcctcctgcatttaagttcatttttcagggatccttctcattctaaacacattctaacaggccttctctactttctctgaatgaagtggaaacatttctatgattactttgttacacagtggagcatacatctaattatttgtgtagtgggaaatcattcctttctctcttgcctattctcaagatccagatccttttgtctttctagataagagtcctctcgccttgcagtttgaatctcttcagcacattagatgcctcgcattagcatcccctgaactgagtggagttaaataactcagtgcgcgattgacatgctcatcacaaggcctttgtaaaagatatcccagcatcttcttgatattgagttcagtaaaggaagtaaaagccctgacaatctgaacataacttttttctgtttcttttcttttttttttgagatagagtattgctctaccgtccaggctggagtgcagtggtatgatcacagctcactgcagccaaagctgcatagccaggactgcaggcattgggccaccatgcccagcctccctaatatttgttacagtgagcatgctgtttacacatggcctgtgcacagtcttaatgagagccattctggggataaaatgatcagatgtctgccctagaggagcagtttcatatggcaggtgtagcgcagagcccgaagggtgtggcactaccagatcattggtcaggccatgggaatgtccaggtaaccagcagtcagcagtcattatagatgggcagagtttgggaacatggcctgacaacaatgggttcaatttattgagcttgtatcatgcaccaggcagtgtgcttcacattaacgatctcctttaattctcacagtcactacagaatatgcactgttgttccattttactaagaggttgaaagagaagttaaggggcctgcccactatcatataattaacagggaatgctaattttccaatccatgtgtatagttgtccccccttatccacaaggaatacacttgaagaccccttgaaagtgtggatagtaccaaaccgtatatatactgtttttccctatatgtacatacctatgataaagtttaaattagccactgtaagagattaacaataataactaaaaattaaataaaacatttataacaatatactgtaataaaagttgtgaatgtgatctctctctgtggctctcaaaatatcttactgtactgtaccacaggtaagtgaaaccatgtacagtgaaaccgaagatatggagagactactgtgcctgactccagggccatattattaacctctgcactagaatcccgtgtcagaaattgagctcgtcagaccattaacttcaaggtggtgtggctgctgggtcctaacgtacttgcctggtgaggagttcctaagtgggaaagcctgggtgtaaaggaggagtggtgcatccaggatgttctcagaatagaattctactaaaaggaatgggcgtccgaggcccaggatcaggtgagttactcaaaccagggtgtcccatctgtgctcagctccctgtgccatgtgatggggggccattctccgatttgtgaggacagctggaagcacatgatcatcaggtaagcttagtcctggctagggtgggttgagccagtgggtgacaagtgactatgtgaccaggttggtccttgaaagatgactgaggtttggacacctttgcggggtggagatgagaggaaagagagagaaatgcatttttgcctgagcaaaaaggggccttgtttgtcttgttcatttcatttatctaaattcatgttcaagaaaaatacgaacaattaatggaaaacagccacaaacttatggaaaagcagatagtggaatacacaagaaatttttaagagtctacaataaagggtaagtgtgagtttggaaagaaaactttttaaactgctctggctaaaaactgctgggccaagacctggaaacagcagggatgcatctcatcttgcacaggaatgtggataaataggtttcaatgcataagacatgtgagtctacccaaggcacacacatgcagtttccatcaaattccacacactcggttctgttggaaataagcatgtcatctgtgtgattcagttcaatggttggtctaatggattaggatgaaatgctgcttcatgaataggaattgggtgctgaggtatctcgtgtctgtgaataaggtgagagtgactgattcttgcagtggttgatactggcgattaccaagtaataagttaacactccagagcctagggaatataagtagtgtgaattaatatgacaacaatagtttgcataggaagactgagaatgtgctaactagccaaagttgctgaaatcttaattaggtattttgatacataatgaaggatatttgctcacctcagtaactgtcatcaattaaaagagatggacagggagaattacattgcacttaattttatctgaatatttaatcaccaataatggagatgaaaatttatgagatattttgacattctgggaaatacagcaaagttaatattgttagaagcttctcagctgtgcattgctcagaagtgaaaacgtccataacagctatagagactggggagattcacaaattcaactttttagatcatttggaagaattttctctccagacagattttttttcctaaaacaatttgtcaattgtttttaattactaaatttcaaagtaaagactgtttataacagctaattacagaaaataatcatgtcctcacaatgctaaatttatatctaccatatattaatatttgctcccaaatggcaactgcccaggtcagctgagctcacccgaaattctagaagagaaagcaggtgaagatcagagtagtggatgctatttggagtgggaccttcctttcttttctgtttttcaaagttaatttgatttatcaaaaaatatttatgtgattatgagaagctatttgtgtgtgctcatgtagatgacagtagcctgtatataatttgtgagggtaaagaaagcaaaatgtaaaaagaagagatgtatacattcatgtgccaatgctcctttcatgtaaaacctaggaaaggacaaaaaagaaggcagagaaaaagtcaaaataatgttaactacgttcattcatgcattcactctctctctgttcattcttcccagcatggcaatgagctccattttcctgggtgtctcttacatagtgggaagagagacatggggtggtcagaagacctggcttctgcctttatcactgccatttattagctgcatgactctgaggaagttacaatctctgagttgcagtttcttcatttgtatgtggagtaataatatctgtaaccctgccttggtgggctcttgcaccaaatgaagcaagttgttttgtgaaacttcatttagcttataccctttgttaaaatgcacacatatactgagtgctgttcaccacattgagcagattcagtggatgatgtcatttaattctcgcaacccaagccctaataagcagacagagaatatggggtacagagtactttgagggcacagagctagtaaatggagaagctggatttttttttttttagttttttgacaacatgcatagtaggaaatacattttacagtctgaatcagtagaggtagatatgataaatatatgcatacctgtatctacacatatatgtatgaatggaaaaacaaaaatttcagaaacagtgtaatggcaaaagccgcaattacatttgtaccaacctaatatacatgtaagtctacacacatacatggcttgaaagtaatgccaaaaatcacaattacatttgcaccaccctaatatatacaaatatattctaaattgaatatattctgttctatattatttcttttttatgataacatactaaatggattatacaaatcaattgtgatgcacagtttttaaaacacttatctaaagcctacactctttaaccactatgttgtaatccttctatttagagcagatctttatacatagtagatatgcaatatatatttgttggatgttgtatgaatagggacagaaagaatgaaatctaagggtccccccaaatcatatctgaatcggtggcttcactctttgtccatctgtaatgttaactcttttccctcagttgatgacaaggagcacagtccaacatgtccattgctttctgtattgctttctgctttctctgtcatcggagctgtctactgaggaaaagccaaggacagatggctccctggatagaggagtcttcaaaaaacagggagagtaaagtcaaagctgagattttccagtttatgcccattacaccttgtacacctcctctgggcaccttcctgacccctgacccagcaggccggtgcactcacacccttcctgcatgttgaccacttcctctctctggtctttggaagtggaacagctctgaagaaaacattggatataaatattttctttttctctgagatttcctttcaacatgctcactttttttttttttttgtttttttgagacagagtctcgctctgtccccaggctggagtgcagtggcacgatcttggctcactgcaacctccgcctcccgggttcaagtgatgctcccacctcagtctcccaagtagctgggattacaggtgcacaccaccatacctggctaatttttgtatttttagtagaaacagggtttcaccatgttggccaggctggcctcaatctcctgaccttgtgatccgccccccttcgcctcccaaagtgctgggattacacgtgtgagccactgtgcctggcccatgctcactaatttgtctttactgcaaacaatttacaatatactcaccattattttataatcaagacacattgttggatgtgcctggggtgagcagggaattattttggcagcagcagatgcacttccttcacagagaacagtctcaacttgacaaatacttggggttgaatgaatgactcttcaagtatttcctcagtttcatgactgctttttaagcattttaaacaaagatcatatcctttaatttttttcctcacaccagcaaactgttatgcacatgagagttttgagtaagtagtagtatgtgggtaatagtgtattgaatataatatcaacgctccacgaatagtctaaatgcctttaatgactgtgttatcagaaagcttggccagcagtcaaacaataataattggaagagttaaaacatatagatttcgatcttttttgctccctaataacaaatgaattgtacatcctctttttactgtgggtaaacctgatgtgttttaacaaattggttatgcttctttagtgatggagactttaaaatggtagatataaaaaaagtgagaaagtctgttaaatcattttagcttaagtttaaacaactttagctcttaaaatacttccaaaaaacactcttgggcttcccacatgtattacagttttaaattaacaacaactggcatatccagaaaagaatatgtaaaaaagaaagcattcaaaggcacccatctttgaggcatagagagagagctaattacaatatagcatgaataagtgcctgttatctctgctgaggacagaactggaatgaatatatggccttaactccagaaaaccgataatgttagacatttctgaaaacaatagtttttagattctggagctgaacttatagtgtaagcattttatgtctagtaatctcctagactcccaggtcaactcctgggaagatagcccaataatctgctagaaaaaaggttagaagaccttctacaaagtcaaaagaaagttggaggtgggaatgggttagggatgtgagtagagagaggaggggaaaaaaaaaagaaaacttgtgaaattccttggaggcctttcaacctctccctaaagattttaaaatttacctttaaagtgattacctcaattgtccattatttaccagtcaattattatatattgagcacctgctgtgatcaaggcatttagttaaatccaagaggaatctaaagaatagcaggtttcctcaaggtcttttagggattattatataattggaaaggaaaatataaaaatatctgaaattaataatctgaataacttataacccaaagctaaaaatgttaagaggtttagatgcttcacagaagagaacttttttttttttttttttttgaaataggggcttgctctgttgcccaggctggagtgcagtggcacactgcagtctcaaactcctgggctcaagtgatcttcctgcttcaacctctcaagtagctgggactacaggtgcatgccaccacacctggctaatttttatttatttattttttttgtagaaacaaggtctcattcttctgcccaggctggtctcaaactcctgatctcaagtgatcctcccaccttggccttccaaagtgctaggattacagatgtgagcttgcccttcacagaaaattataaaagacccaaccttggaatgaaagaaaaatttggatagtaacaataataactttattatctagtataaagggcacacccaactgtattatttgtattaaaaagattgttctggtatcttgaaagtgtggctgtttttacatgtctaattaataatctcacacagtgaaggagctgtctcattaccttcttgaagcccgccatgactttggcgttctacaatgtataccaaggagggatgactaattccaaagcaaatgtccgttcatgctcagtccagagggttcctttttttttgttctcaggctgtctcaccagttactcctttattgatatttagctcatttatgtaagtttgccagctcaagagagataataggtgagggagaacttgaagtcaatggaggccacaaggcttttggatcatctgttgataccaaaacccaatttattctacccctccaataacgaaaccaagagcatgtgctctgggaagaggaaagagagaggagctgggcaaagtggagaaatgcgagaagtttttaaagtcagctcacaggaaagtatttagagaatcatctcagaaaaaaatagaatagatacaaatgaagtctttcttagatgctctagaaatatattaatataacagtggttgctaaagagcacttaaatatttctaaagcatgatgtctaaaaattgaagctaagtgccaccaagcaagggatgtgcttctaattaaaggtaactgtcaatttgtgtttctttttatgaaatgaggcctacattcagctcatttatttattcaacaaatattgttgagggtctaccatgcactggtcactgtactaagggaaggtgatagagtttctagatggagatgcagggttgagggaggtggttcttttgcttgcttcattttgctcactttttatttttttggagatgagagtaaattgatgttggttatgaaggaccccatgtaaaaagattaagttgaatatgcagggatgagagaagataactgtctaattaagtcctagaagagagtggagggatcaaggttgagaacacagattcagtgaccacccttaagtaagaaatgacgtggctcgtctgtctgagatctttaaattctgtgcttaatctgtgcacagtaaggagtgaaagtgtacatggtacctgtgtatatttttttcatattgggacaagattctataaactcaaatttgaattctcctacagctgtctggcttcaaactctgtttcatcctattaaaaagggggcagtaatatcagtcccatatttgtcccagggggatcccacgtgctgatgagaagggacttgcaataaggaaatgtaagaagtgctggcttaggccgggtgcagtggctcatgcctctaatcccagcattttgggaggccagggcaggtggatcatgaggtcaggagttcaagaccagcctggccaacatggtaaaaccctatctctactaaaaatacaaaaattatctggatgcggtggcggcaggccccggtaatcccagctacttgggaggctgaggcaggaggattgcttgaaacttttagtgagccactgtactccaggctgggtgacagagcaagactccgtctcaaaaaaaaaaaaaaagagtgctggcttagcacctttggccctaacggaaatagggttctcctaaaacagatgactcagagaacatccttgacatcaatgccgtattcagaatgaagatcttgaaaagcagacatgtaatgttaaaaagagaatagtagctgtttttttttttaacaatgcttaatttctttgagagaatactgaactcctgaaacatccaattcctcatttgcaaaatgggagtaatgatgattgctgcctcaaaaggtttgtgtgagcatttcaccagcagatgtatttaaagtatgcctggcagagagtatttaggaatgcttagctattatttatctcatcctcatcaataaaaaacaatgataaaacctttttacttaattaaatatgtacaccattaagcacatatccttaatttaccaagttttatgtaattaatatatttacaaatcattgcttttccactttaattagctaacagttaatttctaaggtaccaaaaattgagactcttactgagaaagattctcatcctattttatttattaaattagaaaaacagtacctcttaagagtttaccaggtgaatttcttttagatgaaaattctccctcagttattcctgggttggtatcttgactgagtgtcttttcttctttatttatctcaaaggtgagttccatctgcagactctaataaataatgattagtttcaaatcatagattccattttaactcttaggaagggaagtgtgacaattcaggaatgtggtgttcatggaagtctgtgaaaactttgtgtttgggtccattcgtttgttcacacactgtttaagacttttgtctcctgatgccacatgtgacagagaaacttcttcattttgctcatgacaagatgctcctgttgctggggtcccacaggggtctcagtgcctgcagatctcagtttaaggaatggcttcagcccaagagcttagggcacagttccccaggctcttaccaacaccatgatgcagttattcttcgctaataaaaggtgggctagaaaatgcattgctctggggttttcaacttctgagtttgttgttgttcatattggaatggacataagcttatgcctgcagggatgtctggtgtatcagatgtctggagtgttgctccagcagctcccagagcatggcctgagggtgcttggccctgggctggctgtggattcgtgggcccatcctgcgttatgcttgaggcaggacctcagcttggtgatgaagggcgccttgcccatcaactgtggcctatttttagaagagtaatctctgtcaactaagaaaataaaactaggatcattaggctgtctgagagacctttcagatgaactgtagatgttcatttgtccatttttattgtgttgtgacaagcattttttaataaacagttttattgaaatataactcacataccacacaattcaccaatttaaagtgtacatttcagtacttttagtatgtccactgcgtgtgaaaacatcaccacaatcaattttgtaacacttttgtaccccacagaagaaactctgtacccattagcaatcagtccccattcccctcccacccacgccttcccagccctaagcaaccactaatctttctatttctataaattgtgcggcaaacattttattttaaactccgcactgggaccgccctgcctagcagcctggctgtcgcaggaccgcctccctcctcctctgcctccagccccctctccagacgcatctcctggaggtattcttcttctcttcccctgtgtcctgtccctcccgtgcccctcaactgtggccgctctggcatcgctgtgggccacagtggggaggtcggatttctcctctgccctcctcctcctcaccttccgtctctactggggccccaaatcccatcttcctcagggactttagggtcacacgagtcagaaacctatgaaaaccgatgcaatcaaaggagagaagagtgggggaaggccaggggaaccccagtgcagggacttggcagtgggggttgattctcgtcaccctctgcatccgagtgggcctgagctctactttctgtctctcttggtgcttctgcttctctctctctctctctctctctctctgtgtgtgtgtgtgtgtgtctctctctgtggactggcgtcttctggtcctcttcctcccagtccataagtaatagtccctaaaacagcttgacacagattcaaatccctgaatctcaattataagctcccagaaaagaaaatgagttgacttggactgaattggggctttgaatcaagcagctctaaggggcatagaggggtggggggtcccgtgctcactgcatagtccgcaggagctctacctccaagtgggagccacacgcctgcagggttcagagcagacccttccccaggccccgcctctctatttccaggggtgataaagccatctctgggctggcttaagagactgagggctgaactcagagccctgccacccccaacagccttgcagcctccctggtgactttctgggctgctggggagtcttaactattctctcctccctacctccattctttcccccacagggagcccactggcctcactgctgctctcctgagcgctttgtcttctcctgctgatctgctggtcaaacggcagaacttcatgtcattgaaacttgctcttagacctctcctcgtaggagaagttgccattctcctggataaggaaagggtatagtacacactggtctcttcagagtactggctgcctgccctctttcctacttcctcatcctgattaacggtctgtcctgcctcttggcaacccgttggcgctccttaagttgtctgtggcccacttgatcctcccaggtcctcctgaaaagcaggccccagggcctccaaaccacatgcaggccaagaacatgttcaaaatgaagagatttctatattttaaaatataaatgcttactcaattatattttaaaactttttatttcaagtgtaccatagcttagatttggaaagttgacctctagaaatctaaacacaagaaataacaaagtgggaccaaaagtgtattaattcttagtactcaataaactttaaaaaaaaatttccagttttggtaaataaatccagcaatcttctagactttgaagctaaacaattgggactgacattttctgtggctgtcattgttgctgtttagtaagcttttattgcatgtatgcgtgatgtgtaacatacgtgcacaaacaaacacagtgaaatgcagctccaggagcatctacagaatgaaccctctcatatcaccagcatgtggacgaaggagcagcgcctgaaggcccctttgatgcccctgctaggcagcggtcccttgtgggtgaccatgagcatggcttctaatactctgaattcatttgccttttttttttagcttcacatgaatggtattatacaagatatattcatttttgtctgacttctttcactcaaagttgaactgaagagacacattcctgttgtacgttgttatggttcacttattctcattgctgtgtagtattccatcttgcagatttgccaaatcactctattattgcttcatgtttagaaatttatttccaatttgggctgttaaaaacagtgctgctctgatcatttgaatgcatttctttgttgaacacatgcacacatttctctgggtatatacttgggagtggaactgctgggtcctaaagtgtgtatgtgcagacactgcccaataatttttcaagttgttttgccttttaataatgattttaaagtataaaaaattatctcacatctgataaaattttgatttttcccaaaagagctaacataattctttatgttgttttacctcttaataatgatttaaaagtataaaaaattatctaacttctgataaaattttgattttccccaaaagagccaacatctgtgtaatgcaataactacattttttctacttctagaagaaaaggaatcattattcagagaaggaaatggcacagaagagattataatttttcgattaaaaggggccatcaaggtcttataggacactgagatatgaaacacacacacttggtggtgtgcccgtagtcacaacatgaaggacagtcaggaaaggatgtgcctccaagtcccaagaatgacccatgtgcttttctttgttattcaattctacagacaagtgtgggttcttctgcgggcatgtcagtacactaagcaatgtgcgaatttccggtaaatacagcaaagagccttgtggcgtaggagcctccccttagtggaaaaccaaatctctacacacagtaattttgctggagtgaattttggctcttaccagacttctatctctaacaggtaatctatcatttacaacaacttggcccctttctctctgctttttattacttctcccctaattcaaatcctcattacttcagagctgaattatcgcagcagacttttggctaggttcctcatttataacttctgccctctctaatctatctcagcctatttctgatcagattagtctttataaaacaacacattcattttgcatctcttcttgtcaatattatttaacaggagtttcacacccaaatccctaggggacctggtaatgcaaatgtgtaaaggccagataatggcctttgcaatgttaaacatctagagaattatgctttctttaattttcattgaaacccagggatgtcttggtctgggtttcatttcctgatttgacaaagtctgtatggaaaacaaaaaaaatttactttaaaaaaaaaattctataataagaaagccaacagcacaagcccacctagaaatagtgcttgaaacccagggaaaacccatttaaagagagccgtctgcagctattcagctccaggcaaccgttgccatgatggattttggcctagtgctgttagatcttccaatttttcaaaagaaattggaaagccagatttttctgtgaaatttcctgatatttaaattttggcatctaatccaattttttttggataaaacttgtaagtcatagacaaaacaaaacaacataaaaaagaggttcggtatgtgaagtgtggttctcgagctgcctgtttgagctctgccctgtgtaagatgccttaaatgcattcacataatcccaacagtcctgacatgggaagctaggccaccctccctattcacagtattaccactattttattttattttattttattttattttattattattttttgagacagaatttcccattgtcacccaggctggagtgcagtggcgcaatcttggctcactgcaaccaccacctccagggttcaagcgattctcctgcctcagcctcccaagtagctgggattgtgggtgcctgccaccatgcccgactgatttttgtatttttagtagaaacagagtttcatcatgttggccaagctggtctcaaacccccggcctccagggatccgcccgccttgggctctcaaagtgctgggattataggtgtgagccaccacacctggcctagtaccactattttttattctccccaacatgtacttctgcaggcagattggatcaccccttcatagaacacgcctactcattcctgtggtcatcacgttggtcatttaaacattttaatccactcacacgctctgcagacatctactccatgtccttctcttcttgaatgctcctctgacattctactccacctatgaagccattcttaatacttcagtatacattgatttattctttttctgaacagagtgtatttaaaatcactgccactacagttaatacctaaaattttttctcaaaaaaaaaaatgtaatttccctaagaggattgcaatgttttagattcattctgtagtgctcctcctcccagaaatatttggcataatttggggcactggagagagtgtccaatatctggccgatttatacaaaatgtgagatggcatctacagcgcatcaaaatgatccaaatatttttgcaactttttgaatagttgcaatatatacatactttttaactcaagctgttttatttgctattcaagaacctaaaagagatttaaatagtctggattttgaaataaacttctctaattacatgtatgctcatgaaagtacatttctattgtccttaagaacaagagctatctgtttacatcttttcatctcataaattttgtgtgcagtagatgcaaaatgaatgcatagcagcccgccagttcactccagtatctcatggggagatttgagtggtttcatgtttggaaacagatctatctgtgaagtaaagacatatcactcattttgatttggaaaaaatgttttaggttcatgtggtaatgtagacattatctttggcttatgtttattgattgggtgagatgtgaaggaaaactgatgctttgcaaatgggaattatgaaatgacattgtaacctgagtcatcatagaacatgaaatgtgatctaaggccacactatttttgctataccttttatgtttcataatttgacttgactactagtgttctaagaggtctgaaagatgtgttccttacctactttaaaatcaagcttgaaattaccaaagaaaagccgagactgcctgggaaccttcctaaaccgctgacatgagcttggcagagatgactgacgggaaggactgttcagagttggggacaagaagggacctgttttccaagaagttaaggaaagactttctaaaagaatgttcttacatataagtataatgaggtggaaattagtttccaccatgacaaataccattcttttacaaagtaccatattttctagaagagtgctttccactgcagaactttctgcagtgatagaactgatctgtgtctgtgctgtctgacatgtgtctatttgcacacttgaaatgtggcaacgtggcaattgtgattgagaaattgaatttttaattttaactcacttaaatgtaaatagtcacatgtggctagtggctactgtattggacacaacatgctggaggaaactgtatctttttcatgtcttttaaaggggcttaaaataattttttgctctgctgtctgggtcaaagaccccaaatattttcactgagggcatttgctttttaatttctcaaggtgaaacgtttttaggaagaaatagggtgtgggcagtgcaaatgaaaggtgggactggcccagcttcagggatgtaccaccttctgctgtcccttgatacagatgccctttgggtaggggagggggcagctgcttctgcccacgctggagctcccttctggagagatgcacatagcagccgatgttgcagtttagaggtaatcattccacagaagggaagccatgcaatatccaacacaatgaaatgctgtttttgaaaataatttgggcactttattaaagccaaaggccatatgatatgataggtcacagtattcaacatattcatacttatcactaaaataggttctggagatctttaaagtcaagcatttgtttttcagtgtattttattccagtaaatgtgagaaacaggtatataagaaaatcaagcttcaattaacatgtgctgtgactcaaacaaaagaaaggaaagctttacttagaaaaaaaataactcttcagaaaataacagaaaatgtgaactgtcagttaatacaacagccagtagccataagcaagagattgggaaagccttgggccacttaggtggaccagcctcaagagtgagctgagaatgctgaaatcacattaaagagaggaaagtctctcctatttttaaagacacttagggaggagagctaataacctctttcagtaattatgccttttaattatgaagcacaaactattttgtgctgaagctcatgattcagattctagttcacatgcttttgaggggcctccttgcctcctggtggggtagttcctgtccgaggaggcaagaggcttgtggcctgcttgtccctttcccaggcctctaaatctgtctctttggcttgaaatgtagtgcgtattagagcactggcatcgagatttggggagaatttctatgaatggatgcatgtgatggcaggcccataaattaccaatgatgcacgagaagtaaaatctcatctttgaagctttggtcctgtgggcctattttgtccattttatgattgtccatcacaaatatgacattgtgccaaaagagaaaaatgtaaccagatgaatgacataaaccaagaaaaagaaggctatgacatctgtgagccaagatgtctgttctttatggatccatagctgtctctgtctctgggggacaagactcttggactctcagtggggacaggggctgggacttctggtggccttggtctctcattcctcatttctctaacctgtaaaaaaaggaggtggcattgaattacaagtgcactggtccattttacaaaattgcaaaaaatgcatgaacaccgagtgctcaagtggttccataaatacagagctctgatatctgaattttaagatggaaacatttcacaaaggcatatagcttccttttcttaaaaattaccatagctccagcctggacaacatggtgtaaccccgtctctactaaaaatacaaaaattagctgagcgtggtggtgcacacctgtagtcccagctacttgggaggctgaggcacaagaatcacttgaacccaggaggcggaggttgcagtgatcctagatcacaccactgcactccagtgtgggtaacagaggaagaccctgtctaaaaaaaaatatatatatatataccatagcttaggttgaccagtaaatgacaatatgacaatccaatccctatctccttgatgaggactgtgcctcatgttcagacctagaatgcaatgagggctttttcttttcagttattgttaagttatcgggtcaaataatgtaaaatgcatgtcagagcatgaggtatttaaattctggcctctttattttccccagcaaaccatgttatattttatccgatttaattactttaggattataatttattatttgtctttgaaataattaaagatttttttcttttctttatttccttaaacaattaacagccaactctaaacccatgaagtggtcaattagctcaagtggaaattaaaatttggcgcatctattttaaggtcgatgttgttttatttcccagagctggactgcagacttccttggctctgtcacagaaagcgtccttagcagagaatgggtttctcttcctactgaggtgcttccccactatgaattattaaagacttgaggatgaaagtgttattgaagacaaaagtacaaataagccaagtgcacccatgtcttaattagatgacattgaagaaatgctgctcaggaaacacatttacttttttttttcctttacttctaaggtgtagccctatttaatctttgcctagaaacaagtttgtaatgaatgtatttggataacgggcagcatggcttggcctgagccttgcaagcagagctgctggctgtgtctctgccattcgagagtctatggcttctttataacttgctagacccatccagctatcctgattgtccctcatattatctaactaattgtttccatcatttactttagtcaactagttctctctttcagttgactccctttttctaggtgctagggaacatgaaaaaatataatactagagctgccttacgctgtgacgtaggagaatctgaagggaggtcggggtggggacaggagcaggagatgatgcatttgaaaggcttaaaacacacaagtaggagagcaagagaaacaaaagaaaagaagtgggcctggatggggtggtggggagcctttggcatcgagaaaaagtttaaatttatacattacataatgttcatcagagtttcttggcagcacggggatggtttttgataactaacagggtgatcgttctcagaatggttgtcaaatgggaagagcgtttcagaagatgccccaagctctggcctttggagtatttatagcttagctgagcccatagccggacagcagccagcaggctgggattaggaaaaaactagctgatatatttgagtctagttgtttgttaactattgcagaagcaggtgctgccttaagatgtacctcatgagcacctttcctaggagcatgtggtgctggatctaaggaaacttgcctatcaaaaatcatagtgagggccttggctatttatggataaccaatccatacaaggggaaaccatattgacacattctttatattggaaaggcttgccttcaaaggtgcaccacggttcaaggggaaaacctgctcttcaagctcaaagatttagatccaagtactggccattctactcctagatgtatcatcccagacaaatcagcctaaagcttctatttttcatctgtaaaatgtgggacaatattacctggattatgcattactgctctaagattatataaacaccatttcatgggttatttgctaaaattgttgttgatctacataactaggtcttcaagttaatcagagcaatagtttaaacactgaacattgctaggtaactgtaactgtatttctgtgccatttttttctcttcttgttttggttcagtttacattaaaatctgtgcttataagtaaaacacagcagatttattgcaggctgatgctggtatgttttagtatatgggttgctaaagaagaaagtaggaggaagaaagttgttagcagagggttagatttaactattccagactacgtagataaaatataatttgagcatgcaacgattatagtatggttcttgtaaagatatcactcatacttaggaagtcgtgcatgacccttcataactctcccattcctcagctcacccccggaaccctgccagggccctctgctccctataactgcacctgtccgtccttcttccctttttctgctcagcaaactcctcctcaccctggaaaatccagttcagatgttaccagacaattttttttgtgtggacatgcataaccccttctaagcatctcttatataacatttatgacatgtcacagccatttatgtgtttttataccccagtaaagttcaagctccatgggtagatgatggtgtctttctcatggtggtctccacaatactggtgcatagtaagtgccaaaagtcattggaaaaaaagaaggcatatatggaagaatggagagtgaatgaacacatttgtctacatttatgtcagcaagacagctaacatttctccctgcaccattccgtctaacctttttaagaaacagatgctttagccaaggtatgattggttggaaatccatctctaattttggcaattactcaacttgcactcagtatttaaaggaagttgaataacagcagtgtattagtactttttgtcagtgtaagattgtcttttatttatcatctctcaagctataggtaatacacaccccaaatcatctccagacagttaaggcaatattagcaacatacgaatatttaaagaacaagaatagcaccactatcttgttaaatctagaatttatactttcatttctggcctgccaagcaaacttcacaggacattatctgaccttaacaattatctgatctaacactgacagtaaaagaagctgaggctatgggaaaaacagcaggaatacaaggtgaatttctatcaccaacttcatctgaagcataagacatgctgccaattgtaccgcaaacttctgtctctcctcattgtctcatacatgacatgactacaaaatgatcagtgaataagctgcacatagaaattcaagcattatgctgcattcccagcacaaatatctagctatatgacaaaaaatagattatcataatctattatagtagagtgtacttaagaaacatttatatattgttttttataagtataaaagtaatacatatttcttgtaaacactgaaaaatctagaaaggcatgaaaaaagaaatgttaaattgctgtatgcgctcccctcactatcaataattttgtgtatttctattgaaatgcagagacagagacaggtctacagaattgcatgctactattttcactaacacttcattatcctcatatcattaaatagttatcaaaaacattattttaatgccttattaatattccaatgagtgaattcaccaaaatttatttgaccaatttagccatttccctaacatcgtcactatctttactgtcaaaatacaatgaagaatcttgcaagtatttctttcttggtatttttatttcattaaattaaattcctagaaatgtaattgctgggtgacaatatgaggatttttaaggcttctgatttataatggcaaattgcccatcttatctgcgttttctaagagcagcaagatccacttaaatgagaataatttctacccttccaatagaagaaaagtagttttgaaattacccttacctagaaaacttccaaagaaaagggaatattagcaaaataaggtgcttctaacatgaactatgtttatgaaagaggactctagatcagattcaccagaggttaatgaggtactagctttgatagttttattatctttacatttccatactgtttaaagttagatgatagattctatgtaattttaaaggattctccagagagttttaaggcctgatttgaaatccaataagatgttcattatataccatatatctttgctttacagaaaaatggcaggttttatacagaaccattaatgaggtaaaaattaagaaaataatgcacaggttatgaaaatttttttgtcttcaaagaatgataaatgaatggtcagtcatttacattctaaattattaattcttataaagggttgattactttttaattgattctttccaactttcatgtaatttaaattatataccaaatctagcaatggtactcatccaaacaaaaaatgagaaaagctgataatactaatgctttgtgaagctggaaacaccaagataactgattaaaaagtagagggaaaaaaatcaactgatttgttttgctctaatacagttcagtcatttcagtattcagataataggagatgacataacgttttggactgagatactgaaatccaatttaagctcatcccttaactacatttgagcctaggcaagttacttcatggctagcacctcaattactcacctgtgaagtgtgagcattaaatgatgcagtgtagctctagggtctaacttgaagtctggtacctgttctttatagtatgaacccagggctttggggttaaaatggagaagcactagaggccatagcttctattccaggggatgtcattggactagttctttctggagctcccataggaggatccaggctcacgctgggttgaccttagtgtgcttccttgtttgggaatgatccagactcaaggtccacacttgccacacacacactctagcatcaaggtgaccttttttgagggcctcccagttttaaaattggacgagttgtttgtgtttactcaacttacaaacaattcttggtccaactgagttatagaaaagcttttgctggagcaaacatcaaaaaatagacatttttggtgtttttaccttctagtttttctcccgagggaagatataagagagaatgaattagttatttctcaaagcattggactcttaatggaagaaaatattcaaagactattccatgaccttgtgaccttcgaagaacatatacaccaacatttcagcctgccagagaaaagaagaggaggaaattagcattgctgtttctaggagaactaccttcacaaatatgtgtccactacaatgataaaaataaaatcaatgtgggacaagttgaatcacatgtttcttcatactttatgatacgtgatgaaccctgagaatatgccttaagagttccaatacaaaagtaacatgcttggattaagaagaattcctttctctttgaaaggcttactttgatgacaaatcttaactgttaagtgcccagtgctgatatcctcctgggcatggagacagagatcaagtgcttggtacagacaaatcaaagatttcctctgccactagctgatatgctcatgctttcttgatactatgcgaatccacttggaaaaaagaaagcaagacttgttaatgcaggaagatattagacatacaggcaaatcaaagatagaggggaattgataaagcatgttggcttagagtataattttgatgcgatgtattcccaggaaaagtaaacacattgataaactcattgctcttgatcttcctacacagtttctattgacatttctttcagctccaggcacagattagagagtatatggcccattgattgcatttaggactcttaatgacaggaaagaagattgaattcctctccctatatacatagggaagattagtagcatttctgatcttaacacattcttggatttgcaaatctgttttcggaatctgttactaattcaataattatttcaggggatgcttttattgtaatccttaaaaagttgaaaaatgttatgctatatatgacaatttaagttatagttttgagcctctatacaaataaaattttgagaaagctgtttgaaaaaggctcacatcgttcttgtgttgtgatgctttccatataatatcaatcatatgttttacaaacttgaagcctagcgagagttgatattcttatttagagaacattttctatttaaatttaattttctacttttacttagtttttaaaagttaaatattcccaagaaaaatgtacttaatgccagtgacatcagttattagattccaccaaaccatgtccaatgttggataggagacagttaacctgcacccatttgcctttcctgggctttagactttgacaacattctttgtatattcttggtactgggcaaaatcctctgaaaagctttccagggagatatactggggccagagacctatttatcacaaccctgcactttaatagagacaagaagctcattcccatcattaggttattagcagctgcaaatagcctaaattcacttaaaaagtgttcatagaaagtggttataattaattaaaatcagcttgtttattgagaagagaaataagtcaattaaatagagatttgggagtatgtattgactgggaaggatcactataaaatttatattcacacagcccataaaatgtcgctggtgtacgacgtgaggaccaaatcagggaacgtcagtataaacatggcagaatgggcacatgggtctttgtagcagttcaaggagctctttcctccatcccaggaaaacagatgacttctcttcttcaccctttctgcagaccagaagttgattctctagagaaattgattcagaggctttggacatgagtccaaaacagagtagggtttgaggtgtcagtctgaaaacacattgaatataatgctgcgcgctgatctccaagatccctgccctcttcccacattgctgctcccagacagctgcagcagctgtgtacccctcatccttttcagaagaaaatgaacaacgctggtgaaaatacaaccacatactcttcaatgtgagcagacagctaacgatgaccagaaggtagaacatcctcgatgcgaagcacagaccagaacaaattaaaaaatgaaagaattattagaaataacataatatgggagtagaagatttcaaaatagatatacattttaaaagatattacatatgatgtaaaataacaggatgttgtaaaaacaggaacgtcagaaaataataaagtgctcttgggaatttaagataaggtagaagtgtgaaaaaaaaaaaaagaagtcgaggatttggaagaagttaatgaatttcctagaaagtagaacaaaaagataaaggcattaagagagagagagagaaaaaaaaatctaaagttctaaattaaaagggaccatcaaacacccagcctaataaacaaggaagaatgcatatacccacccgaatcaaaaatattagaatatcggggacaaagactaaatacaagtgttgggaaaagatgagtcacccacagtgaatagctttcaaccctggcatcaacagcagataacaggaaacagcagagatatactctaaaattctgaggggaatatgattttcaatatgaaattctatatttagccaatttatccatcaaacataagagcaaaataaagacactttcagacatgcaagaactcacacacaaaaaaatatcactcaaaaacctatcttaagacactgctagagactgtgattctgccaaattaagaatttaactgagagtgagtaagacatatgagatacaagaaaccgcttcaaacccaggaaggtggcctttaggaggagatagtgttgatgggaactgggaagtgtgactgtgggagaggagcttccgcagggaaaacaaggcttagactgtttagtattgtttctgtgtatttggtggggggcggggaggaatcttgctaggtatttggcagatctgttggaacactcagggaaaaaaatagcaataaatgtaagaaaaaaacatgaaaatatgcaataattttgaatccaaatgaccgcgtaaagactcgtaaggacttgcagtcaacagtgagctcaaggtaagacgctgcgcgcatagtcacggcgtaagatggcgaggtgggggtggggagagggaggaagggcgggggtggggtggggtgtgtaagtcagatctttgccttctgtaacaggtgttcactaatagttcattctgtaactgtgtctaagtttcataagacaacaaatagaaacataaagagtttggcgataactgaagaaatgcctaaaaagggttaaaagtgcttggggtatgggattgggcatcctaactagaaaagaatggagtgtgggcttgttttttttcccccattgtaagtctcttaatactatttcattttaaaaaataagtttaaacgttaataaaagttaaaaagttcttaagaaatgaaagatgggaaaagggatgtatgctttaagtgttcagggagccaaaatcctgtgacatgccccctgggccagcatgtaaggttcacctgtaggaagattacaccaacaacacgtttccgtaaactttctgcataaacaagtctctgagaaaattgttaacaattggatgaaactggtatccaaaatacagtaacagtccataaaatatgaagcagaggaacacaccttgtcttctgatttggcgctcagtaaatatgtacataatcacttttcattgtgtttgaagtttcatgctgtatgttagtgtctgctgtgaaagcttctataacaactttccatgacccagttgtcctatggaattgtagaacaaaccaccacctacatgtctgacttaaggcaaatcacgaacctttatgatttttaaaaatctgttgactaacattgattgtatcgtacattatttatagagatatttatgaataggtttaaaaatagaagtggaggaagcttcaaagtggaacttattcagttattgtaaaattggaataatgtgtattgaaggaatctctttttcttaggaataaagaaattatgataaagagatagcatcatctaaataacactagataacatgataagagggagatgtggtctgttttgttatttagaacattatttcaactcttaatgtgtgcttatcttctgcaagatgagaaaagcttataatacctctaaacgtttttggaaatactttttttttttaaagaattttgccttttaaaaaaacttttaggttcaagggtacatgtgcaggtttgtggtacaggtaaattgtgtgtcatgggggttgggtatacagattatttcatcacccaggtaataagcatagtacctgatgggtagttttttttattctcaccctcttcccaccctgcaccctcaagtaggccccaatgtctgttgttgccttccttgtgttcatatgtactcaatgtttagctcccacttacaagtgagaacatgcagtatttggttttctgttcctgcattagtttgcataggataatggcctctagccccatccatgttgctgcaaaggacatgatctctctctcttttttatggctgtgtagtattccatggtgtctatgtacattttctttatccaatccactgttgatgggcattgatttcatgtctttgctattgtgaatagcaatgcaatgaacatacgtgtgcatgtgtctttatggtagaatgatttatattcctttgaaaatatacccagtaatgggattgctgggttgaatggtaattctgttttaagttctttgagaaatcacccaactgctctccacaatggctgaactcctcactggcagtttgtaagccttcccttttctctgcagccttgccagcatctgttagtttttgactttttaatagccattctgactagtgtgagatggtatcccatggtggttttgatttgcatttctctaaagattagtgacgttgaggatttttaaatgtttgttgctagtgtgtatgtcttcttctgaaaagtgtctgttcatgcctttgactactttttaatgaggttattttttgctttttgattagtttaagttccttatagattctggatgttagacctttgctggatgcatagtttgcaaatattttctccattctataggttgtctgtttactctgttggtagtttcttttactgtgcagaagctcgttagtttaattaggtcccatttgtcatgttttgtttttgttgcaattgcttttggcaattttgtcatgaaatctttgccatatcctatgtccagaatagtgttttctaggttattttatagggtttttatagttctgtgttatacatttaagtttttaatccaccttgaggtgatttttgtatatggtacaaggaaggggttccgtttcaatcttcggcatatggctagccagttattccatttacctttccacattgcttgtttttgttaactttgttgaagatcagatggttgtagatgtgtggcattatttctgagctctctattctgttccattggtgtatgtgtctgtttttgtaccaataccatgctgttttggttactgtagccttgtagtgtatgtcgaagtcaggtaatgtgatgtctccagctttgttctttctgcttagaattacctcggacattctggctcttttttggtttcatatgaattttaaacgtttttttccaattctgtgaagagtatcattggtagtttgataggaatagcatggatctgtaagtttctttaggcagtatggccatttaaacaagattgattcattctgttcatgagtatggcatgttttccatttgtttgtgtcacctctgactattttgagcagtattttgtatctccacaattctcattgtagagatatttcaccaccctggttagctatatttataggtattttattcttttattggtagaagtagtcttttaatccacaaacatttattgaatgtcaactctatgccatacatttcaaagcacttgggatatgtcgatgaacaaagcaaacatccctgccctcacagagcttaaattctagcagacaagacaaatactaagcaaaataaatgagtcaagtatacacacacacattttatattacaaggcaatacgtgctataaaaacagaaagatgagtatgacggggttgtagggaacatccaatttgaatattatgaaatggcatctgtatcttttgagcaaaaacttggggtcatgttgccctatataagaacagtttaaagggaatgatgaaaaagtctgaaggcacgtgagtaagtgagaacatgggatgaggaatgacttgtaaacatcaagtacaaatgaccctataaaacaattttcgtgccaacctgaacatcaaaaaaaggcaagataagattccatttgtctgttggtttaagatgggaaaaataatagttggtagaagtaacccatgaagttgaaactgaagaaggaatgagatctagagcacagagaaaaggactagctagagatacatgcgaggctagttcatctgtggtcctggctgcatagcatcgcatatagactcaagtagtgatgtggtaggaaagttgacatgatgctagggatggttcttctctgatcacttcttgtcatgagattattggataaaagtcaggatgtggggaggtgctattgatctgagcaaagaaaagaatgtagaaaagaaatgatgtaggaatgtagaaaagaaatgatgtaggaatgtagagaattgtctaggaaagtagggaattagtgcactaaggaagtatgcatgattggaagcataagggtgtagtcatgagtgggagtcaagggtgtaacatgagaccattggcgtggttgtatttttactccagccatattcagctcatgggtgcagccctgaactaggcagaaagttgagtttatttaagatgtggtgttttcaagtgagaatgcagcattgtgtatgcaaggagtgtttaaattagttgccatgtaatttgcaatataagctggaaaggaggggaggaaaggtgagagacagtgaggagggagtaggatcagtggatcaggagggttagaattagaggtctgtaggcatgaactagaagtaaaagaggcaggggtaatttagtgggatggtgggcctaagatttcagattggttgctaactgcagcttttggcaaggacaaggtctagggtgagtccaaaggccagagtaggcagggtgttataatttcacgaaacacagttcctggcagagccttccttactccctcagagggattcacatgcctcactctgtttccgtaattccctatgagtatgcattgtatttcattttcattgttgttatattcggttgaaccacacaaaatggccaatgtttgactgttttgcctgtaaaaagggcagattcatgtggctcaacctaatgtttgtactagtctgagctgcttaagaatagggactgttacatttctctatttctagcccttatcacagtgtctctggtataactggaattcattaaatatttgctgaataaataaataaatgcaattccattaataaaattcacacaaaaaagtttgaaggcaacatctggtgtatttcggtgggtggagtttttcaaagcatactggagatttaaaggaaagacaagggtgctttctggagacattggtgattgttgagtaggtgtgatggcttctttaatccaaatcagacctgtgttctgagcttcggctttggtggttatctcttccattgagtattgccagcacctggacctgcacaggaagtgcttcccatggtggctctgaatgtgggctgggggttccatccttcacagcacgtggccatgcacaggagcagcagccatctttctacacagtcatagataccacacaggtgcaataaaaccggaagctctcctttctgctttaacagacacagttatttcactcgcagacatctttcccagaaaaaaaagagatgcagatttagacttattcaaatgtgttcatagcatttttctgtgtaatgggattggttggtcccctccttacatcacagtgactgtcataattccctgcttctctctgaggtcccaagggaaactagagtctttgagcacctgctgggctgggcagtgatgggtcctttatagccaccatctgaaaaaacagaaaagggcaggatgagcagcgctcaaaacctcccactactgctgctgtctgtccggtcctagacaagttgtctgcatttgttagatgtggacgaatagtagtaccaacttctaatgttgcagtggggattgggtaagtgaatacttggacggtgtttagaagtacctggtacctgcctactggtcactgagcaattcctccaggcaggtgccacccatggccacttactgcacatacattcatcactaaattcttttctccacttcacaggttacaaaactgtgcttagcaaagttaagtatctgaggtcttaaaaaccagtgcatttctgtcagctcctctttaaaatcctgtagtgcttcctgtatttttgatcaattctttcacaaactggcctgtgcattttctgcaatctctgtttgctaccaccacaggcctttgatttgcagaagagctggtggtgccatattatttcaaggctttagatagaagtgtattcatgatctcacctttatctattggtcatccttgtctaaataattcctacctgtctttcaaagctcaccttgatcaccaccttctccaggaagcccttcctaacctaactccatgtctgactgtgactcttttcctctccactcctggagaaccttgttcattttctcctcatgatgttcatcacagtctactgtggtccctagagtacacaccgagtgcctccgacaggctgtaagggcttcaagaatacaacccacaccttatttgtctctgtgtccttgacatccagcactgtccagcactgtgcagagtagcagcaataagcgtcttttaaaataagtgagttaatggtgaagcctactgatctttgccatgagatagacctaaatgttactatctcctgcacaacttgtaactgaatgaactatgtttcttaaattcttaagaccacaacttcttcatttgcaaaatgaaataataatatcttctttataaaagtgttgtgaggattaaataagacaatgtatctaagtgctttactcaaagcatggtacatactagtcgttgaataaatgatattattgttaatgattgttacttttaaagccagggttccaaaatccctgttctttccactacaattgaaagtccctccttgaaaacaaggtaagcacacagaaagcatagtcagtgttgtggtctcaatagtacaatttagggtattactgtgtgaaattgaactaccctttcaatatttaaactacttggttagaaatgtccaaagtctatgctaggttcttttttctaatgaaaaaaactgtactatatatgcacatatgaaatagttattcttagctgaattctacagaatatctgaatagtatgtatccctgaacatatatatggggcataattttaaaaatataatagcctaaagtgttacaaaatacatattatacaaatatataatattgtaaaatgctttacattttttattaatgtcaccatgcagagaaagatcagagttcacatcatttctagtcttggccttgcctgtcacgaggcaaaattctttatgttgtaatttcagtgacagtagaatgtctctctccctaaaataaatccactcccctcctgttacatacacatacctgctgggacatctaaagcttaattctttgaacttaagcctctgatctctgttaacatgaagataaccctggaaagagaaggcttttacttattattagctacttgcttttaagtgtgagtggctttcagatccttctattaaaatagatcgcatttaggtaagggctgcaggaagagaggatgaggccctgtgggcctgagagaaaatacagaagcaagtaaatggcaaaagaggcagctccagttttgttggtgagctgcgtggttccatatagaatttcacttcaatgtagacttctaaatattcccagtttattcctgtggactctgtgtttttttgttccatagctcagataaacatgttacataatttgcattattttaaataattataaatattagaatgggcatggtggctcacacctgtaatcccagcactttgggaggctggggtgggctgatcacctgagttcaggagttcaagaccagactggccaacatgatgaaaccctgtctctacaaaaatacaaaaattagccaagcatgatggcaggtgcccataatcccagctacttgggaggctgaggcaggagaatcggttgaactcaggaggcataggttgcagtgagctgcgatcgtgccactgcactccagcctgggcaatagaacaagactccgtctcaaaaataaatcaataaatgaaatataaataaataaatattatataaagaatgttaattagtaccaataatgatcatgtgtgctctttaaactagaatgggaaaacatacttagaagtgctcagttcattaatgcctgcgtgcatatgctagcatggaagcagaaaaaatatttgcacacacatccctcgcacacatgcacacaactgtttcaggaggctcctttgcccttatctgtgacccacattaagacctccaccttctcttttcagcagaccacagccccagaccagccctacaggagtttgctccaagcgccactggcctggcccagcacacaggttgcctcgtccgccgcctccccacagcacctttcctgaattctgtcggcattgagacccatctcctctttctctgtctctctttgcctgaccctcgtccattctcctagtgggcaggatgctgtcagctattgctatttggagggtgagatgacccctgagtagaaataactcctataagttcagaggttcagcctttaacaaactcacattcctgtttgactgacagatctcccagaaaggaaaataaaagcaccttgaggacagagctggaagtagtctacctgggtattctccacagctgcaagctcaatgtcctgagcttgctggtactcagaaaatgtttaggaacttctttttacattgagggtagtgcttatgggcaaaatgaatgcccatgggcctagccctgagatggctggacagcaagaaaggagaaaggacagcatgggcaattttccacacatgttttaagtttacagggggaaagagaccaagagaataagatcaagtcaaatcaaacccatgtataataataccattaccaattgttttcttattttatgttttattctgattccttctaacaaaagttcacacacacatacacacacacacacacacacacacacgttcagcagagctcaggttgaaaataagtgccagtccttataccaaaaagtagtatgctgtgctttgaaattcctgaaagctcatttgctgcctcaccctccctctccccatgtcctatagaccctgtgttccggatccatcctttgaattcactcggaggcaaggtggtcatttcttatcaaaaggcgaaatctacaaaattatggcccagtggcagaaaggaagtagaatgggcagccctaggaagtaggatgggcaggtcccatagaacatgggacaatgaaaattcagtatgcttgttcctcccaatagttcctttttgaatgcagagacaaagttaactcaactggtctttactggaattagaatgctgattggtgagtctctcaatgtgagactaatgacatgttagaggtgtgttaatgaatttatgtaaagggagacaaaagaggaaccagggctaatcaaaatgccagctattttaagatctttgaccatgtaatgaccttcatacatattatgcaccattagtattcatgacaattatagctttttaattttctcggtgttataaaacattaatcatctgtaccagcaaataagatatttttgcctgaatagttcatataaaattttggcaatgctaaacttgcaaagtatcatgaaatatatttcaaaaagggccgcaaactgaaactaatccacaaaactctcactaaattctaatcattgacaatttgtggtgtcataatcaacatcagcgaagaggggtttcaaactcttagtgacttaaaatcttcatctcttcatctgaaaattcatgaaataaatacaaaaaattagctgggtgtggtggcgggtgcctgtagtcccagctatgtgggaggctgagggaggagaatggtgtgaatccgggaggcggagcttgcagtgagccgagattgtgccactgcactccagcctgggcgacagagcaagactccgtctcaaaaaaaaaaaaaagaaaaaaaaagaaaaagaaaattcatgaaatatggtatttgaaggtcaaagaggtttatgggaaaataggatgtcaatgcttatatatcctgagaaaaagtaaccacttgcctacaaataaaatgaatccagatactttctacctttgctgtgtgtgtatctttgctactcagggtcaagtgtgatgttgtcagaaatgactttggcattactctgaacaagcttaatgggagcaggaaaacatacatgtagtgaggcctgtggatctggctgcctctcacatgcaaatgaggtgggggagggaggaagtaatgatactggggtttcccaaattgtggcccaataaatattaaatcagcaataaaaaattgctcaattcaactgtatctattatatttggttatagaaggtatattcttttcttttgccatgatgcacagcgactctgataatcctgagggataactgaactctgaatctacagagaagttccagcaccatccttctgctgacagagcacaaggagacagtctggttggaaggggaacagtcatctctgctgagtctttaaagggaaatattttatctgttcatttaaaaaatatgtgttaagcacctactatgtgtcacacagtatcctagcactgtggatacagcagcaaaagcaaacaaacaatagacaaaagtgtctgccttaatggagctcacattctaatggaaggaaacagaatgaaacaccttaatagaaaagcacatagtatgtatgatgatgatatgcactctgaagaaaaaataaagcagagagtggcatgaggagttttgggtatgctgttggaataatttaaatctccctgagaacatgatggtagtgaattatgtgatatgtgggaatatgcaggcagggggatctcagacagataacatcgcatgttcaagggcagcaagaaggtcaatgtgtctggagtgagcagtgggtgaagagaaggagataaggatgggaccaaacccagtaccatctggtggactagagcacagattatcttttgctttgaatgatatatgaagccattggagacttttgagcagattcatgatcagatttagattttaaaaggctcatttgggctaagtgttgagaacagacttcaagaaggtgagacatttaaagctttcaagggagagaggatggaaacttagactaggatggaaggggcaaaagtggtggaaggtgacctaattctggatatattctgaaggtagtagcatcagcagatttcttactggactggatgtgggaagtggaaggaagacagttgaattgggatgatgccatggcttgagcaaatggcagaattgagtagttacttaatgtgaaggggaagactctggaaaggatgagttttttggagaggtatattataagttctgtacttgggtatactaagactgagatgtttgtcacacttctttcatgagattcagcgaagctgtgtgtcctggcctccttgcagtgagtctgggtttgtgactgagctctagccaataaaaagtgagcacaagtattatgtgtcacatccaggctcagctgtgaagacctcatgagtatgatgctccaagctctttccccatccttagaggattgctgaaaggagaaggcagaaccgtaggacgaaaagaacccaggaccccaaataaccaggtgcaaagccacctgccaacaaggaatgattgcgatagacttcggaagcaagacatgaatttttgttgcatatgaccactgagattcagtagtttatctgcatataaccactgagattcagtagtttatctgagacagaaattagtgttgcactaactagtacagtgtccagattggacatatacttttgggagtcaccaactaacagatgagtgttagagtcatacaaatggatgtaatccccaaggtaatgaacactgattgaaaagaaaagaggtgcaatgattgagcttgggggactccaacatttagagaccaaagagatggggctgaaccagcatagaagccagaggagtggccagggaagtagggcaaccaggcaagtgtgatatccagaaaaccacttaaagcaagaatttcaaggagtaaccaactgtaaaatgaagctgatgggtcaaatcaggtaataaattggtcatttcattatgagaaatataggtacttttgggagatgattttatggtagaataaaatacaaccatgaaaattgggaaactcttagattctttaaaaataataatcattgtttaagaagagaatcgtacagaaagtctgttgttctaaatgatagtccagtgaaatatttatcattcactctctgaatctggaactcttctattggccaaacattccctttttcttcatttctggacaagtgggaccctgagtagaagagctgtttccatttcccttgctgtttttggtttgtgtgtggtggtgtttttcatcaaaaacgtagaggacagaatggatgttttaagttggggagcaggagatgagtgaatccaatatcatctgtcaaatccttcatcctgttttgtttcattctaaagtacatgagaggctgaaggattattaccttataataattttaaaatgcatcctatgttcccacttctgtgcacttttctctgttcctgtgctttgagtatcgggtaagtcactctggaaatgtcactcgcattaaaatgaatggttttgatcctcaccttggaaagaacagatgtctacttcccctgcctcatttcatctgtttgctttagtttttcactctcttgttgtttttaattctgaagcctatccaatgtatcttcttctatcaaaactgtggtaaaaattctatcagctcatccttatacttttagagatgtttcaaatctcctgctcagcttctccttgctggtcagactctctcccttcattatgagcaagaaatgccgggactgtctgcctttatgttacaaatgcaggtatggtaattcactccaagtgtatatgctgaatattctgaatctaccagcttgtctgtgtcctgttaactgattaaccagtcatgtggaatagtcctagcaaactgcaggcctatgaaaaatccacttcacatttgatagatcacgtcttgatgaacatttcagaaattgataggtttatttgtttcaaatcatgttcttttaaaaatactttctggtccaatttttatctttctagacatgttgcatactaaattctgaaagggtaagcaatcaggtttttaacacgtgccctttaaaatattgacatgattcaatactttcatatttcgtattcaattgttcttagccatttgcaagtgtcttcatatgtagtttgaaacattagaaaacttgtctatcttatttcccttacctctgtgctgggtggctcgtagttctttaagcctttctgccagtggtggtttctaactagactgttgccactgaacgctgcagggaggaaggtgggaagggcaggtaaaatggcagtaatgcccatccgtggtttcatcccttttcaaagattgaatctgaacagtaaatgccaaacccaatatgaaagtcatcagtttagagttacagaagggtatcgactcaatgttttctccaggtcctgtgtgtttttacctctcacttccaacataatgccaggtgggcaaggacccagcatcttatcctggattatgtaggggtaccaggttggcccttccacaaaaccatcatgacagcatggacacctggatcaggacagtcctttctctcttgttgtcagaaacacagtagtgtgcaaaaagatttcattttttccccacgttccatctaactgtattttattatttcaaagaaagtggtattaaactctttcgttaattaaatcaaaattgaaagttgtaaagccacagtggaactatctcctattcagaatttaagtgtacaactttgaataaggatatttgtatagataagaaatcccaactagaaaggagtcatcgtgtgcaaggaattcctactctgctcctaaacagcattgattcttgtaagaataaccagaatttgctaacacttcttgagcctagtttaacttttattaatctgccattttataatgttgcatatatcttgagttattaaaataacttagttatttcatagttcaacaaaacaggcaatagttctccttcctgcttcaaatttgtattcatattcatattctttatgtacttcaaccaaaagttcacagcatgttctaaacataccacttttggattatgcatgatgagctagtcaagtttgtaagagagtgtgatgggcagaataacgggccccccaaatatattcgtatcctaatgcctggaacctgtgaacacgttagcttataaagcaaaggggactccatgatgcagatgaaaataaggttgtgaatcaactgactttcgatcagggagattatcctggattatgtaggggtgtgttgtcatcataatagtcctaaaagtgcaagagggaggcaggaatggggagtcacaggcatgctgtggagatggaggtatggggacatgagccaaggaatgtggtggccccaggcagcaggcaaggacaagaagacagattctccccagagcctgcagaaggaacatagacccgctgcttgattttagcccagtgagacctgtgtctgagaactgacctacagagctgtaagcaaagtaaattgtagggctttaagtccctaaatttgtggtagcttgttacagcaccaataagaaattaatgcagatatgcatgagacatatgtattcatcaccttctctgattattgattacacccattttaacctggcaggcataacgactgtcatgatgggcttgactgaaacatttcagtcagcaaaccaaagatggatcacttaggccccacagtttgagtttctgggataaagttttcctctgactttccggacacgggcgggagcttggaacttggcaaggggtgagctgcacggctcctagtctgcccgtccaacctcagaaggtcaaagtctctccccctcccttcttctttaacatggaactttctgcttcctgtcagtattatctgataatttcctgccaactcccctgtggtatttttggtatcagattattacataccttctggaaattaatatttcctgggaatagccaatatacttacttcctagatttatattgctttctacagataagagcagaaaatgggtcaaaatacttacacatacacactgtaccgtgaagaagagctcaggaaatagtgaagatgattttcagtacctacaatcgagaaaataaaaatacatttctgagtaattaagaaatatttgtgaggtgttaatgctgacattgtatttaatggtgaggcgtttgatagaaaatgtgtccttaccatcatctgttacagcgtctggtgggagacacaatggagagaagggaagagatgaggcttggggacaggcaagctggtgcttgaaccccacatctagcactcagccatagacttttggaaagcttctcaccagctcagggcctctgtgggctcacctacaacatggatatggcaggtcttcatacgtctccgtgtcattttacctggtgaccagcttaggtctccctggcctttattttgagccttatacctctggagagttgcctaatgggacttggttcctcgtctgtatgttcttagcacctaaaacacatttccaagatgaatcccttcacccttcctcccacaagttgtcttttgctttgttttccctatctctgttgggcagcctgccaacactgacagcctacactgtcagccacagacccaggcattgccctgcatttttcctccccttcgcctgacagcctggtcataagccaagtttatgtcgccttccagtatccccgagctacattccctgttctccatctgtgcctcccgagtccagatccccatcgtccatcacctgcactatggccactgcttcccggctgtccttcttgccccactgccaggctttgcaatccattcctccagaggggtctttctgatagacgtgttctatcattaaaattcttccctggccgaggcaggcagatcacttaaggtcaggagtttgagaccagcctggccaacatggtgaaacctcatctctactaaaaatacaaaaattagctgggcgtggtgccgcattcctgtaatcctagctactcacaaggctgaggcatgagaatcacttgaacccaggttgtcgggggtggctgcagtgagccaagatcatgccactgcactggtcgacagagcaagactctctctcaaaaaaaaaaaaaagtccccgttttccttcacttacaggatataggccttaggaagctactcaccttttctctgcctcagtttcctcatctctgaaatggagatcatcatgctttatttttaagtaggtaatatatctcatggtacaaaaatccatccagtgtgaaaaattttgcacctactcttgccccacccatccaattgctcccctgctccaaattggtaaaaaatgttatattttcttctacatcctttcaaaattaataaaatatatgcatatacacacccatatgcatataaatacatatatacaattttctaaaattccccctttcctatagtataaaacaaagacagagtgaaaagcatttagaaaaagaagcaaacttgtgcctaagtataaggtggatagccaaattgaaaacagcacaggtatttaaaaaacacatgtatgacattaccaaatttatcaggtttacagtctgtctgttcatacagacaaaaaagaaatgttcttgcatgattatcatagccacaaagaccatgacacattttcagatgtctgcaatggaaaatctgggagtaaaatggcttttgttagggtatcagtgatttacgggaaatgctcaaggtttcatttatcttgggaatgagagctagacgtatgaccccttgagtttctattggttggttgatctggtttcgtttcagtgttccatgtgatagtgttttcttttcctctgactgtagaacatgcttgctcatcatggtagcagggaaaaatgtcagtgttgcttgcacacaaattttgtagctggagtgagtattgttgttatttgtgttataggaaatgctcacttcttaacctcttttgtcctggagcatagaattactgcaaatgctcacccctgggagctgtcctgcccccgatctcccacacaaacactcagctgataggcagacacattagcacttaagagtccccttggcaggccccctttccagcattgtgctgacaattggatgggtactgcacgcacactaaagtccgctcccagcatggcacaggggctcccatcaacacttttttttttttaattattgttggtatgaccttattccttcctacttctttaacctactttccaaatactccccttcctccattgtcttgcacttcatgcaacatcaatacaaaaatatatatagtttattttaaaaatgtttctttagcattctgtttctgaaagaacgtatagctttagaacacatgatactgtttcatgctttacacctttgattgtgttgtcctctattctccacccttcctccaacaccttttctggtctccttatggaggagctgatttttattctgacagtgttttcctcatctctgaaaccccactgcctagcacagtgccaggcacattgtgaaaaaagtgttgaactcacataggtcaattacaaggctagacacaatagcctttcccaagtatacttggcttgtcggcagtaccaccaattaagaatgcaaatgctgtcctacactgcatttcttacttatctccagcatcaaaggaatttgaacaatttggctggtgggcacaagggaaggttatgcctcactgtatatataatcatttacacacttagtgctctcaaaaatgtgtcattctttcacaactcaaattttgcatgaagtatttataaaagataaagaaattgacatattttaagaaaatattgcaagaattacggatgtgagcatttgaagcatcattatacattaaaaatccataaagttttcagagatactgctattttggtgtagcatcaaatcattgttctaataaggaacacttttgaactatgaaatattattggtatctagagttcggtgcagataatacaattaaaatgtttttatatgatcatttaaaaaaaaagaatgcaaatgcttagtttaatgacaagtttcctgtttcatggcagactttttttttaaacaatgggaacactgaaaaaatatcttctaaatttctcgcataaatccatcatcctaagatgtcaagagatctggcttttgtaggtcagtttctatttagagtaaaagcagttgtttaaatggaccttgactccacctaaaagaagagtatagctgttttttctgcatcctgcattgcacatctcacaaagaactaaaggatgttgcttggactagaggaaaaggatggggactacatcttctgtattttggagcatccggggcttcacaaagtgcttgtcataaggcatttaacagtgcttgatgaatatctaattgaacatttctattataaaaaaaaaatacagcaaccacctggtgatgttaggttaattcctactacccttcgtccatagctgaatggctctttgttgtaatgtgttggatggtacgtaggtaaagatgggaaggcctggggctttgacttttttcagtcctactttttgggtggttgaagtagtaactgtcactagtctctcccagttgacaggataatcctgcaccacttagagacaattcagggatggtttgtcattcaagaggcttaaggtgggactgattcggtggcaccagaaacatctcatggagcagcgtgtgtcacagcatgactgtctcagccaacgatcccatatcatggcctgtttgtctcaggttgctctctaggatctcattagggatctcaagttcctctccagatgagaagacaatcaaaggagatgtgatggaggtcagctaccactgaaagaaaggaattccactggtagatttcagaattttacacatgtacacacactataatgttaaatggtataattcaaaataagacctcataagatgctgttgcatttggctcagagtacacccaaagacagcattttgaaacttatcatcattcacgtgagatttgtcaggaaactcagggaatattgtgccactgtgaataagtagagatttagaaccaaagtttcacctaatggctaaagaggtttcaaagatattttaatgagaagcttaggttttgtaactgaaagattcaacagaaattggctttgacagaaagcagttttatattcaatattctggttgctatggagtccatttgggcagattatgagtaatataagaataatataaacttcagcttccaaagacctgatgccctggttaagagatgcagtcacttgacaagtgaatgttgactaaatttttaaatgcccagttttataattgaatattcctgctgaaataatcaagatttatgcttggtcattcagtgactgaagaaaccttatttaggcactttactacatgtctagaattatgtcaaatgttagttccacaaagaattgcatccattcagagtctgagctttcttaatggctaggccagtgtcatggaaatagaggcaccaaaaaacatgagcaccgtcagaataaaaataaaatgcactaagcttgattatgctctattttaggttttgtctgtaaagaagtgatctgcttttgtgttatttatagagaagaccatatcagtgtgtaataatacttaaaataaatagtaaataaataaaataatcatgtatccactatgtgagtggtgcataaagttctagggaaagtgcacatttagatgtttgggatgtaagacccatcagactagttattgttgttagaagaaatatgttaagtcatataatggtcagtttgcactctatagaatgaaaatattaatatccataaaaatatgacacttttttctctatttggcagatagagagttgaggctgtcttctaaagcttgagataaacacacatcctctttctaggttacctactgaaataaatcatagatacgcaggtgacctgtgacaaagtgcagatctatattgtcagaatgaaagaacaatttgtgcacaatcactaatatttatatctggcatgtggaacttacattgcatcatttttcaaggtgttgagaagtatgtattctataaatgcagcatccagggttggggctgagcactgcgacatggattagatccacttgtcactgaaagagttcactgtggggttcgctctgctagccttgcaccctgtgcacggtccccagccgctgcctccagagacatgttgaaaggtagagtgctccactccattgtgcacatcctactcacatggctgggcactggggtgtgagtgtgtgtgcgtgtgtgtgtgtgtgcatatgtaggaaaactttccagttaaatcttaatgtccggtctttggaacacagaataaagtcgctctttctaaaagcaattcattttatttatagtaggcaccagacacgcacaagacattgttactctagaccttcataaatgtccagtttctcaaatgtggacagggttctgacttcgaccttatttctgttgagaatcatgtgtttcttgttcagattcctcatggtacaccttggtatactttttacatctattaaaatttctcccacaaaatagctaatttttttctcatacataaataatgaactaatgattgcatgagaatcatgtgcccaggatgatggtgatagggtgagctgtggaagtgttgatcagttatcttactccgtggctcattcgcttttacacaccaatatctatctccagcaaatgaccacgaggcaaatttgtgcgcagccaaatcacaaaagtaccccatataatttgcctagtaattttcagataaacacaagcagaagtgttaaatccataaatgtgagtggtctacccttcttcttcttctttttttttttttccagacagagtcttgctctgttacccaggctggagtgtagtggcacgatctaagctcactgcaacctccgcctcccaggttcaagcaattctcccacctcagcttcccaagtagctgggattacaggtgtgtgccaccatacctggctaacttttgtatttttagtagaaacagggtttcaccatgttggccaggctggtctcaaactcctgacctcaggccatctgcccacctcggcctcccaaagtgctgggattacaggcgtgagccaccatgcctgaccacttcttaactataagacaatttgactctagggactcctaataacacagttaagtactgggctcccacccaggggacatctcaggcacagctgagttttggggaagaatctgagtgtagcagcacataagaatatcaggaagaggattgtgtgcccaccttttaatctcttcatagggctgacccatgcacagttctcctgtgggctttgaaagtttgttccccaacttgagttagctgtgtgtgtcacagagtgagcaggcctgtgagccctggcagacatactcctgctgggaggaaacatgttctctttgtcattcctcgtaggcagccttcactaacaccaactagggagatgtcattgttctgaagttataaatgtcacattgcttctttcccagaggatttgattttatagcatggctattgtggactttgagatggttccaatttgtttggcatttgtcatggttgttcttcatctcctgaaagctatttttttttaaagtgtgatgtccttactttccctgctcaactccagtcccctttcctcaaatgccactggccagagctgtgtaggcagccaaggatcaatgtcctgccaggaccagccttgactcacttaaggacacctcagtgccctgtggaggtgctccaaaatttatattattaaggattgaaacaaacccctttaataatggtgatttctcaggagagaagccactgtcagcaatttctgcattgccctctggtttttccaaggtcgctcacattcttgtgcttgtgtgcatacaaatggacaaagcgataagaagcattagaagccttctaggaaaattgctacaaagcagagaatgttattccttacacttaattgtagaagtggacagtcatatagtttaatcctctcattgtcttggtgaagtaatcgctgagatacattaaataacctagttgagtgagctttgaagaccagctataccagctattgtgtgatcttgggctgacagcttaaactgtgccagactctccccgtctgtaaaatgaaaatggtgatatcacctaattcactgagctgttatgaaggttaaaagggttactgaacgtcaaacgttcagtacaatgcctatcatattttaaaaagtgttttctataataactattattactaaaacagatctcctgaccccacccagcagagggcttcttctatcattctatcatgtgttctcctggcaaaataaaaccaaaacctgtctttgtactgtggtggaagagagacccctgagctgaccatcagaactagaccccatggtttctagtcctagctcgacactaactagttgtgtgacctcagaaaattaacccaacttcttttgacctccatttcctcatttgcaacataaaaaccagagttggaaaaaccttttggaactcttccatctctaacagttctggtctgcatagacaaaaatggccccgcttatacgtcctatcttgcttcctactgttggttgtcaccatggccccaactaccttggtgttccccaaagaataatccaagacactcctctcagtagcagagaattcagaatgtttactttttggcatcttgttggtggggtatggcatagttaagtggatttatctgaggactagggaaatatgaatgatagtgagaacctgttctttgtgttcccagaaaaaattagacaagaggaagagggcttaaatatggcaggaggagctagacatcatgaaatcagagattgattggtatggagtcataaaatatcaaagtttactagtagaaaaaaatcctgacaataaaaactgaattgaattaccaaacaatatttggaatatctaccttagaaactttaaaataaagcaggctaatttttctgagatggtttaactacaactctgtccaatgacaggagcatgacaacattccacctattcattcactcactcatcctgcattgagtgagtgactgctgtatgccagtgccgacatgcaagacttctcaaaatttctttcagttctaacgttctcaggttttagcaagaggggtattgttttgccccaaaacaggccatctctcacattttcagactggtatccatttgtggcttttgtgctgggccgttgatcattagaaagtaatctgtagcctgaaaatgattgatttttaaatagccgaagtgtattaatcagctttttgtacagattgaaggagtatgtttcagctttgcatccttatctgtaaatgccaaaagcacaactagcttgaggtagagtatttattctctatgttctcgctgagaaattgtctaagtcgatttttgttgcctagataataatacagctttactttggtttcttggagtgcagcaatagtacagaatggattataagaaacagtgcactgtgactggcataatggaatattgtcagaagactatcagttttacccttttttatttatcttctgtgttattcccactaatatcacattataataaaattacatatttgaatataatcatattttcttttcaatgaaagctggaaaatttagagaagtatttatagaagagtttcttcctctagcagaacctagaataacaagctctcctagaagaccttaattatactcattctttttgtgcagtgacatttaaacacaatgttattataattatatgcataataagctatatcttgatgtcaacacatggattataaacccttctatttgaattaaatactggttcaaattaactaaatcatcttaggttagatagttgaaaagattcatgagtcggaggtagtttataatgaccatcaatagcagcacacatttcagcatttgttgaccattaatcagtcagggattatctgtaaaggcacagctgcatggagtggtgtgtgaatatacctttacatgaatgagcataaattggatggatatgcagctgctgtatccaagtcttcgtcaaggaaaatgaatatgcaatgttgatagctctaatgaattttattttagagaggtaaaacaccaactttatttgagagataactcattccctatgtatcttctctgctaatatagctcaggggtgtcagtgtggcgaaaggaacttgggagacatttttctagcgtcaccaggtatattcatacaaaaatacgtattctttttttttctttgagacgaagtctcactctgtcacccaggctggagtgcaatggtgcgatcttggttcactgcaacctccgcctcctggttcaaatgattctcctgcctcagcctcccgagcagctgggattacaggcacccgccaccacacttggctaattttttgtatttttagtagagacggggtttcaccatgttagccaggctggccttgaactcctgacctcgagtgttccacccgccttggcctcccaaagtgctgggattacaggtataagccaccgcacctggccccaaaataggtattttttaaaaattatttctttctcactaggctttcttgtctaacaaaagagattcacttttctctcaaatacggaggagttacttgacacagatcacaacagacttgctaatgagtagtatgaatgaatgatgccaatgatggtatcaatgcaaattgattgaggaatccattgaattaaaacattaaagttagacttaaagtcctattggcagatcttctatgaatagatccaagctcctactatgtctcgagagtaaatttgcaattacaagaaaatgaaccaagtcttatttaggacacctactctggtttctgatgttgttttggtacttaagcttaaatgtcaaataagcatctagattctccagctcatcctttgtgagaattaattggttgggtctaatatcatcgtttctttctctgtgtgtgtctcattctgaccctaacaacagtgtcatctccttgcatcccacaggtgttctctatgtgtcactctgataactattccacaaacttttctacatcctcccctcatatctctacattttacactcctcccttctctcttttctcctcagccccttcccttctttactgtcctccttcctttcatccttccagaaacatgtattatttttattgaaatatcttagccaagctgagggaccactacggatatgcagtaggcatttgatagacattcgtggagcaggtaagtgaataatttgtatgcattttagaagggtcatgtggacagcagcatgaaggttgaggcagtaatcctattagaagcctgctgcatccctgcaggcaggagatgatgacagtgactttggggatagaggaaaggaaaaaggtgaaagaagaggaagtcagctggtagaatgaagaggacttcgaggttgacttcatgaaggtcagctgtaaaatacagctatggagcaccgagaagataagcatttttgtgctgggaaatttaagaccaatcagcttaaaaatcttctcccatgtgaatcctttttgaactccctcagactgaattaattgctcccttatcttgatttccataatgctatatgttattaaaatatttgtttttgttgattttcagcatctaaaagttatgatctcccaaaggccaaggctgtacctgactctgtgttgttccctcctcatgtattccatgacttacttgctatccattattcttttttgaagtgtctactcagatcttttgctatcttttatcaaatttttcgttttcttattgttctagtttaaaaattcattatgaattttgaaagttagttgtttttttttaattgaatatgtggcttataaatgttaccttccagcctgtggcttgccttctcattcccataacattctctttcacagaggaaaagttttaaattttggtaaagtccagtttatcaatttttttcttttatggatcacactttgggtgcatttcttttatggattacactttggtgcatttcttttatggatcacacttggtgcatttgcaaaaataaagataatacagatttttctactatattttcttctaaaagtttcatagttttatgttttagatttagtctataatctttattgttagtgtttgtacatgaggtgaggtaagtgtcaaggtttatgtttttacatttggatgtctagggtttctttttgttgaaaaggcttccatttcttaattgaattgctactttacctttgtcaaaaattgattgactatatttgtgcacatctatttttgggatctctgttctgttttacagctctatgtgtctatggctttaccaataccacatagttttgattactgtagattaatagtatgttataaaattgtgtaatatgaatctttcaactttgttattttgaaatattggcttgactatgctagaccttttgcctttcatataaagtttacaatcaacttaacatatacaaaaaattatcctgagatttgattggaattgtgtagatctgtagatgagtttgggaaaaattgaggtcctaattatatctccctaattgtgtctcccaatccatgaacatggtatctctctccatttatttgtcttaaaacgtttgtaatgagcattttggtagtttatgtctttcaggaattgattgattttatctgcattgtcaaatttatgaggagagaattgttcctagtatcccattattatccttttaatgtctatggggttaatattgattttctttttttatccccaagattagtaatttctgattagagtttatcaattttattgatctaagaatcagctttagcttcatagatttaaaaatacatatctttctattttcaatttcattgatttctgctctaatatgtattattgcctttcttctgcttgctttggattggaattgatcttttttcctctggtttcctatggtaaaagcttaggttaatggttcaagacttttcttcttttgaaaatgtaatcatcaatgctacttttctcttatcacttttctctaatgctgctttagctgtgcccataaatttttatgatgtatgttcattgttcattttcattcaattcaaaatattttaaagtttattttgacacttcctcattgatccatgggttatttacaagtatactgcttaattttcaaattcttaggaatttttcttatatctctctgttactgatttagagtttaatcccattatgacctgagaacatgctttgtatgatttctattattttaaatgtgtcaagatttgttttatgccacaggatgtggtttattagggtgaatggtcccagtgcacttgagaatgtctattctgctgctattgggtggaatgagccataaaggtcagttagatcaaattggcagttagtgttgttcaaatcatctatatccttacttattctctgcctacttactgtattaattactgggagaggagtgttgaagtctcttaagtacagctgggatttgcctatttctcttttcagtcctattagtgttctctttatgtaatttgaatctctattaggtgtgtacacattgaggatggctacctttcccctccccctgccagctccatcaaggatgctttctcaggattcttatcaaactttcccgaatgcctaatagggttcatggagagaaagctgaccagagtgtgaacacgtttattctgcatctacagggcttctccctttttgatagcccatatttagcctatagcaatatattaaaaaaaaatttagctgaatcttcttaacagcttacatggagtgtttgcaatgctgggttttgttggtccctgtagatacctttctgaccccagatgcatcttggttggttgctgtccatccttagtgttctcatgggattaagaaaagttgttaatatactgtttatttacccttttccttattgtaagggtgggagtgatactttcaacatctctaagctgaaactagatgtctcgcagataattttgagatttgaaaatctctgtgtttttcttgttgccaccatattactcagcgcaacttgtgctttttgcccttttgcttctcttgttgtaggaatcagagtcccctgaagccctttgctgggagaattttacttacatctttctggacattaccaagccttgacttttcacaatggaagttgtgtatttttctgctgttttctttcatgtgtatctgctctgtgtgtctgcacaattacattggctcttctttggaaacaaacttcgtatacatctctgtgccacgctgggtttcactgttaagtacgtgttaaataagggtggtgatgatctcagtgataattttggtaaacattagtcacctttacaacctccaaaaaattacttctccaatgtcaaccttaactcttatgtcttctaatcaggatgtctgttgtgtttaggtaatataaattattattctcgggtgtagatctatttttttcttttttaaggctaaataattattagtcacagcatagtaatatgcaaccaaagggttatttaattcccaaaagttatgaatatcaatatcttaatattcaatagtgaacatgcccaacaatgaatgccaatcattaattacagttcgtctaaccttataccatttgaggttcagtttaaaattattaaataaaaaatgcacacagccaaacaatagtttctgcacataaactgatctgagccattgtatttttaagcagtaacacaaagtaaatttattttttaatagcttggtttgatgaaaagggatcagagaaatatggcaattctgtttttattgcttgaggcaatctcatttgcaaaatcatttcaaatcaaagttcatctatcactatgtaaacgacatggaataattttttcagtattgatatgtttcagttgagaaatcccacttcaaccactggcattgaggcaataattcctgttgaaaggtcaccttctcatgctttatttcttcttaacttctttacactactgatgtgcatgtattccttttcaataaactatttttcttatcagctggattttctgatggacagaaacagaaaataaccataatttgaacgctcttttaataattgagagacaatccaggagctaataaaaggccttcttgctagcatacctgttaatataatatttagactaatagtaatgaaacaagcttgaactttttatgaaaagcagttgtaaatattcaagtattatttggaattctggaacatttgggctccagggcttgccatcactttctatagctaggtaaaaggtacctgttttaaatacttagttctgggaagagaactatgtgcctcatggctctagctgaaattgcagattattcactcattaatggacagtgggaatttctcagaagagagtataagagagtttgattccacctagattgcctagttggccctcaactaccctaccacttttgatcattctggggacttcatgcagtcaaattattgttaatttcatgtgaccctcttagactcaaaaaaggccagtggtgttgttgatataccaaaacctaaaattgatcataaaaaatcatttgtaattgccaaactatattttggggaaagaaaatacttcatatttacattgaaataagggtcattctaaggttttagacattcaaagtctaaaacagtgtggtacaggcaagctgcaaacacagtcattcagttttcccacccttctggctgcaaaccaattcatctcccagaataatgtgaaagatcaacaagtttgaccctcgtatcaaaactgctaatttgtatttttcctaaagggcagagaaataatagtttagatttaaaaggtcttctcttctgattcttgcacatacataggccccatttattttaacaaaatgcttaattaagccaaaaagatgaccatatcagtaaaaatttgaaaacaatatttgcctttaaaaattcaaatagaggccgggcgctgtggctcatgcctgtaattgcagcactttgggaggccaaggagggcggatcacgaggtcaggagatcgagaccatcctggctaacatggtgaaaccccgtctctactaaaaataaaaaaaaaatagccgggcatggtggcaggcgcttgtagccccagctactcaggaggctgaggcaagagaatggcatgaacccaggaggcagagtttgcagtgagccgagacggtgccactgcactccagcctgggggacagagtgagactccgtctcaaaaataaataaataaataaataattaaaaaattcaaatagagatgaacccctgacataatcaactgtgtattcttttatatagaatatatacttttttttccacactcagatgtgcttaataatatatcctgtttttcttgaaggaaaatatgatcccccagattaagtaataatagtaatgaaataaaagattgttatatttgtaatcagtaattatgcaatcaccaaataagtggctggtatctagggaacaagcaattatatgagctatgattactaaagaagtaattatgatggaagataaacctctcttagttgcgctattttttttttctgaagactggcatttacataatggttcctaatccacagagaatatttgtttaggtctgagagaatgtgtatctgtcatgcacagtttagtacaggaacccttgcctttcacagccttgacattctcaatttcagctcttcattagtggtttgaaggacagtggcttcctgtaacttttctatggcatgaatttgaatcacttgctgtagtgtttctgcgggggaatctagactgccaggcaccacactccagtgttactcaggtccgacatgtagagtctcttctctagtgggaaaatctctgtttccaggaccaaaaaaaaaaaaaaaaaaaagaagaagaatacctgctattgatagtgacacaattaaggaaatatagtgaacacatagatacactaaaaagtggggagaattatagactgaagttgttgtaatgaatttggaaattcttaagattctgagatcatgatgtcgtaattaggaaggggctttaatgaacttggttgacaggtgagtcaagtcgaccagtgtccccttctcaggaatctgaccatcaagacttggttttaactggcacaatgtgacataagaactttactttagaaataatagcacttaaaaaattatatttggcaaaaataccttcatttcaggttattgttattgttttctatttgtctctgtttggggatgttttatgttttcttagctcattggtaattctatgtgtttattcatgctgcacatatagagaataagagctatggtaggcagagaaattgagataagacaagatcaccaatcgctgaaaacatatgatagatcaaaagttgcaagcaggtctcatgaaacatgtccaggagttaatttattttttgtaagcaatttcttgcatttaaagtgacgattaattatataaaccatttcttttgcaaacatttaaagattgagttttctctatgtacttggaaatttaagtgctttttttcagaatgtgcatccttttttgccttttccaatgaagacaaaaatcaaaataacttttgcctagtgccggtatcattttttaacctgttaaagtaatgctgttaattctgttttataatataagacatatttttaagtagacacttgggtttgaattcataggaacttagaggagtatatagttgagttacaactagaattaaatctatgaaacacctcttgcaactaatcttttaaagttgtttagtagtgtttcatgagtaatagtcatgtttattgtcttactcttctaagtcttaaccatgaaatgaagtcgatttgatttattcttaattttcctttataatggtgggaattgaatttaccaaattcagagtaattacttatttctcctaaaaagacaaaacaacctctcaactttgaggtcttataataatccacaatttgtccaaagtaatccttagtcattaaaagaagccaaatagtaagaataagacctcaagttgagactataccctcttccaagacagtcgttcaacagctcctgtctcgtgcatcctcttaagtttaaagacaggaacgttttctgaagtgtctcctttgaaaacagaaacctgaattcctgatattaaccaagtaagttgatacctatacaagagtaaagtgaaatactcaagagtttttgggtctagggtcaaactgctagggtttaaattcctgttccagcactttcaagatgggtgacaaaatcatgaagatgcttagtaattgtgtgagttgggcatgttacttaaccctgctaagcctcagttcccccatctataaaatggcaataataatcaaaatacctactaatagagttgttgggaggataagcaagataatgcaagttaaagtccttaatacagaatctatccataacaagtgttcagttaaagtcggttattattatttattcagctggaagatatggaatgcctgctctgtggtaggtgataggattcacaaatctcttctgtcatctagatcgggaactagaatctaaacacacaagtgtaatttgaggtccaagctgagataaacaggattggagtcttgaacttctctctctgccctactacatcctgggctcctaagttgaagagttaattgtgatttcgataggtttagggtgcctgttaaatttattttcatttatttccattttttttcctgaggataagcataccttgttatatagtaaaagagcctagcatactctgaaaaaggtagaactttgcctgtcagctgacaatctttttaaaacttcctttcaaagatgtagttctgaaacttcttaagaaacgtctgccgaggcacagctaatgtatgagtacgatcatgcctcaatgaacggcggggatacattctgagaaatgcatcggtaagcggtttcatcactgggaatgtcacagagtgcactttcacaaacctggatggtagcacctcctacacgcctaggctatgtgatagaacctgttgctcctaggctacaaacctgtatcatgtgttattgtactgaatactgtaggcagttgtaacgctgtggtacttgagcatctaaacatagaaaaggtaatatgttgtgctataacatcacaatggctagactgtcactaggtgacaggaattttttagcttccactataatcttatgggaccactatggtaagtgaggtctgctgttgaccaaaacatcgttatgctgcacattactgtatttgtatttgtcagcacttttgtttcctgttctttataaagtctcctttctgccaccatttgttctatgctgagttggtatcagtgtgaatctcatattaggaaaaggagagggaattagaaagaggtgttcacatagcctaaaaactcacacgacaggcacttctgtcacatttcaactaagccatatgctttattccttaaagaactttggttctgttagtcagaaaggtattcctgaattgaaataaaaattctgaatcaccaactcacttgcccggagacaaacctaccgggagtatattgctagactgaatccacctgaaacattggctttaatctgcgtgtgtgtttaaaccattttgagatgactttttactggagcatgtctatgaatggagcctgtgaaggtttgtcctctgtttgtgcagtttcttttcctaagcatgtgggagcagaagtggggctggaatggctgggcttggaggaggaaggaccatcaagccctgtgcttcaccaagtaaaattgtctgtgcctaacgatacagggcaaacaattactaggcttcagtgacttatagtaagacaagggcaataagggcaattccttgccagtggtcatagctctatgattagaaaaagaaatatttcttttcagaaagtgtgaggtagagaaagaggccttggtttaattcaacagttctttatcacagtttttcaaaaaatttccctcactagacccagccactctttacaaatgtacattcctgggccaactacaaaagtagggaatcagactgcctgagagatggtcctctgaatttctatgtttaagaagaactcagttgattctatgatcacttaactttaggagacactgctatgtgggcttagataaaaataagggaataaaaatgtatttgaaaaggcataataattttagaaaggtaacgtgtggtatgctgaacagacaggggccatcacttgttttaaagtatgttgcgttctggaccagcagcaaaaagagaggaatgccagggtccagagggcctccgctttatggaaactcgtacatgacgtgcagccttgaaaatccgaaaatggttatttttgaaaatattgaaaacagtgtgttttcagtctttgaaaccatatagtataggattagccttttccttctctcacttcgtcttatgtggactaggcttgctgataatgccaaccttttcgttttagcaaagggcttccatggataactaaaatgagccagaaccagttggatccacagggcttcccatctttcctaggatttggtgatggagtttgccttagtctgtagctctgtggaaaaactcccttctgtgctttagagcctgggtgaataggaggacttctgagggatccttctccaagctattcatgagtctggagagtcttccatgcacaggataaagaccacctccacctcctcctccagccatccaaaccctcctggctttgccacctgcttggactgctcctctctcctcccaaatcgtgcaaccatcttgaaatgcattctacagcagggattgcagagtggccagccttctctatggtaataatatgtgttcaatttatatttactggtttagtctttcgattttatctgaaaccagatctatggcattagacttttagaccttcatttgtccactttggccagtagagctcttctgtgcccagggcctgacttttactaaagatcatgatctgctctctaatgatcttcccactcttcacaagtgttcactgaaatggtctgatggatatggctttaatgtctatgtaaatagtcattaagtcgttcagccattatgtaaagacacactgtgacatttagactaggacacgcttccatttcccagtttctttctctccttctctttttttcttttagtacaattcttttttttttttttgggagtttcagaaagtgtttttaatagtaaaattttagaatagtctgaagattttttcctttaattttacaattttactattacattcttgacaaagaatcagaagaacattcccactttttgactttaatatccacagctgccattcctaaaagtatcactctatggccttcaaaaatgccagctacttttctccctcctggaatctttaatacatcttgaaactctagtcactttcttatcgtttgtgatgacgtaatgacttgctcagcagatgtataatttattaactttgagagagttctgccttaaaagtgttacttttgtggttctgctgctgtgtctatgtacttgttgacaatttacaactaatgaatttatttaggaagcaataaatctcaaaaatgattacttttcactactatatacttttgtttttatgctccaagtcacttctgactataatggtttgtggaatggctagcacaggatttcaacaaagttaagggacttaatacaattcttacaaagtcccttaactttgttgaaatcctgtgctagccattccacaaaccattatagtcagaagtgacttggagcataaaactactaagatagaagggatattttccccctcaaatattaaaaaaatggccacactgatgtttatataacaaaatttggggctattttgaatgattgggagttgcaccaattattgaaagtgaatgttttgtttatgcaatttttttatacctacttattttgcagttaggcagaaaaataaagcctaatggcttgaaaagaaagtccaactttttccgtactggatcaaaattaatctgaaatacagagccatgtgaataacaggagactcgggttattgaggcagaccctgagggagaattccagatttttcctgttgtcaggtgcagaccaacacagcagctgggactgtatgggtacattgtgcacatgtaaaataaagcagtgattcctctgtccatctttaatctcggggtcattattctggttagatttgtggggcaaatgggggtgagaacacatgaaaatgaacaaacttgtatgtaggaagctccatttgattgaggaaaactatggaattacagtgaggctgggcctttatgggagcgttgtagggtggaagaggctgtgggggctttccatccccgtgtgggagtgggaactccactgagtgaggctgtgtggatgtgtgaccagcagggccacagtgtcatggctgtccccaccccaccccaagggcctttttttgtttctcctccttcattcttcccttcccctcctttcctctttgtgagatgacagaaggcagtggtgatgggagtgtccgtatcacaggagaccttaggtcttcggatgaaaaaaattcaattatatcggactgggttagaactgcacttcccattttccccccattacccgtcgaactgtgtgttgcctgagaagaatgatttgctttctctgtgcccctttcttctttttaaccttcgtgcttgcatgaggattgatcagtagatgttttttctgtttctacacttctcagtccctttcatgccttctctctgtggttcccttgtttttcgcttgctccagtccttcttccctccccaggtctctccgccaccccactgcatgcatctttccttcactgctcacttacagagctgctgggatgtttcccacctgtcgtcagtccctccctgccctgacctctctctatccggctgaggctgggtctctcactgccacacatctttagagctgctgtgctagggtggctggggcccccttctgggcctacagctgctctctggggtccatgcgcctgtgctcaccttcctgatagatcccttcgggagcaagttatttgagttgtccccactgtcggggttaacaaatgctgctcatctgcagaaatgagagtccccatgctaaaaataatctgaagcaatacaggagagattgaagcctggctgtgtggtttgcttaggaccccgtggggtgaagccccctcaggtccccagatcccctgccacagtcacacaggctggtgctgaatggtgcctccaccagtgtttgggagctctgggtatgagatggctgaggatcagaggctgtgcttgtgaccatttggccagctaccaggccactctgccctcctgcctcatagccgaccttgcagagtggctgggaatgtgaggcctcttcactggccttgttttcctgtcccctggggccctgccgtagccttccctagcacttagcctgaaaccacagagctccctgcctgggtccccctcctgtccacctttcagtctgtgccccaggcagtggtcagggcctgctccatcagtgagccactctctttgagtacctaagtaactaaatgccaggttggatttctctgatgagtcagagaaagagtggtttcttagcccacagggcatggtctagctgtcctgcaaattgagagtgtggcgctgccagcaaccactgaaatgatatgtcttttagccatggagacgttcctgaaatatttttgtcagctcccatgaaccctgactacgactggccaggcctccctctctggctgcttcagggagatctcaaggctgacccacttagaggacctcacagccaaggcaagtaaggctcccttctctccagccaggattcaggcttaggtgccttctacccatataccacgattgcaggacattattcttgccttagctactctgtgggtgccaatcaaagttacagaaagagactcgtagcacactttaaggcagcggtcttcaaacaggtataaatataccgttggaaaaaaatgatggctctcaacaggatatgtgggctcagacttttcagatcatttgcttccttatatattgtgctaaaattaatctccacagtgctcccttcctgctaaggctttcacagtcagtctttctcactttatgagaaagagatgcacccatttggagccctctaatagccctggggtagcaaaaacctctcaggtgtcaaacaaaggaatgattcaaatattgatgaaagaagtcagtggtattagtgagtgggaggcaatctgtggctaacaaatccttttacaagctagctggtttctaattctttgcttttcataaaattaaaggagggcctaatcaagttgccaggtgatagatgagtaaaaaaattatattccatgatagatgtctacgtgactgggaacgtataatttggaaagagtacagtgaattgaatagatctctaaaaagaaactgcttctgttcccatctatttatgcgaacaagattttttagtatttaattctaaaaataaaaagggagggaagaaatagagtcgatactgtcccttgtttatttcagcaacaaataattttcaccgacaagtccatgaactaactggaaaaaaagcagtatctatctcatattagattcatttaccatcagattttactattaatgttaataattatctatcaaaaatataacgtttatgtttttgatgaattgtacactaataataatataacaaaaataaaatttaacactgagagttctatgatcatctcttttacattttcattttagtttgtatacataccttttatttcaggcaagtataattgcatgatcaattagttttttaaataaaatatactattatatataacatatattttagtataatatatagcctaaatataaataatttattattagcctgaaatacagtataggaagtacaatggaaataaaaactcaaggagaaaatggagttataaaaaatatctagttttttaaaaaccgtttacatatttttaaaatgaacaatttaaactcccaaattgctcagatatttggaaaccattgcaaaattaaaattgtagaagttaaaattgaaaatgatgtcaattatatgtcctttacaatttttaaaacttaagcacttttaggtttctactttaaatatcagaggaggtgtttagttttgcatatacaaacaaatatttgaagactgctatttatgttagccgccatggtttctaaacaaggctgcccatcaaagcacctagaggtattttcacattttaccaataccacagctcaggccacgccccaaacctgccaaatcagtctctcaccagatggcttaggaatttatggttttatagatgtctccgggaaagtcagtgccatctgctgctttatggcaccagagggacacagcatgctcctgtcggaaactgttgcagagggactcttctctagctctcagagctgagggtggtgtcctcatgctgcaggtcaggcagagagaagccactcagtcaagagacagtttccctctacttctttatagtaaatatagcaaatcccacaggaacatgtgggtggttgtgcttccttttttttttttttttttttgttgagatggagtttcgctcttgttgcccaggctggagtgcaatggtgcgatcttggctaaccataacctccacctcccaggttcaagcaattctcctgtctcagcctcctgagtagctgggattacaggcattcaccaccatgcgcagctaattttttgtatttttagtagagatggggtttctccatgtcggtcaggctggtcttgaactcctggcctcaggtgatctgcccgcctcagcctcccaaagtgctgggattacaggcatgagccacagcacctggcctgttgtactttcactaaggattttgaatccagatttggaaagtttgtaatggaatatctttaaaacattgcattattatctaacaaactaagaaaatcagattgtaggtttgcaagagaaaatgtcatatggggattaagacatggtttgcttaaataatgttaagtgctggggaaatttaggaaacaattgaattagctgaataaaggaaagaatccaaaaaaagcaccagtgctattaatatttagattttcattctattaaaagaataagaatgaattagaaagagggagagtgaattagaatcttttaggacagcataaaatggataaaatggacgaaatgaaggatgaccctctttttggtgctctctgggtgtctgcctctgcttgcacacagtgaatgttatgtgattggacggacgctagaagaagaaaggtagcgttggctcaacagaggacttccggctccttcacctatagccatttctggtatgaatgatgatgcaagctcagtaactagtaacacagcccataatggagacaagtggggagagaaaaacaattcatattcccttacaataatctgctagttatggatgtcaggagggagaattgaggacctgatggtttacactgcagtttgaggggctatgataatgccactgatgctttggggtaataccataaaagctgtaacaactcttgatgattcagctcaacaatcgtctcagccatttccatatatctataatctgattctctcctgctttgtgattctttgaatgggttgtctccacacacctctatattaggtgatacattgctggtatattaataccatttagtaggatgcgtccttaaccacatcagctgttaatgagctgcttgttaaggaactgcttgcgaaaagtggatttttgctacttcatggacaaaaagtattcactttgtgatatctttaatgtgattacatgaatggataaaataagctccatatgagctttctattttaaactttaaaatgaaatctgtctaacaccaaagcgctgggttcagctaaattttttttttttttttgagacagagtctcgctctgtcacccaggctggagtgcagtggcacaatctcggctcactgcaacctccgcctcctgggttcacgccattctcctgcctcagcctcccaagtagctgggactacaggcacccgccaccacgcctggctagttttttgtatttttagtagagacagggtttcattgtgttagccaggatggtcttgatctcctgacctcgtgatccacctgcctcagcctccgaaagtgctgggattacaggcgtgagccaccacacccaaccgggttcagcttatttttaaaaacaaagtttcatgactaaaattcctgattaaaattacagtaaaaaattttcactgaagttgtgcctaattgtatgttgggcctgagaattgtggtaccataaataaataaataaatgcccagactgaaggcctctacactggccaagtaaaatgttttaatgaaaatcaaaggtcttgcttacttggcaatgtcaggccctgatgctctggatctgttcttcatgaagcgcaggaacatctctatcacggctgccattgattccaatttggcagccaacaaattcagggcagaattcctctgcctgtgcagatcaaccaggttgggtctccgtggcctgagaccaaataatataatatctgcgctaccctgatggggattttatcaaagtaatgactggttgtgacaatgacatctactcaacctgggtaacttgtagtgtgacgccaaatctaaaacataccttcctgaatgtcaatagccttttttatggaatatggtatggatgatcaaaaaccagtataaacagtaaaagagcaactttaaactgataataaggcattaattattgatggtctaagtcaagaaaagttataaatataatgttataaataggtgcatatttttatatgttataataaaatgtatatataaatatatgttaatatatttatttgtataactgtaactcatatgggtgctttcatataagttgggaaatggattcttacttttggatacacttgtcatcagttagaaaattatagtaaaatactgattttgctagaaaaattatgttcatatcttagaaaatgttagaagaaatactagtatctgccagaaatttgttataataaataacaatcattacaatgtgaatggcattcttatagctgtataatatacaaccctgtaatagtgggtgatagccagaatccttttatgacattaggacaagcataacaaacacacactgaccccccactttgttatagtgagagatgctattatcttgatgtctacagaaaatataatttagccttaactttagcaaactgacaatctaagtttgaaccagctataaaccccccatcttcctgcatttggaaaggatatgcaaaacaattttttaaaagattcagctcacgtataaggaagtgattaaaaacttatctcaatgtggacaacaaggttaaggcaataaatgcacttgtagtacttacagtttgtatttaggaagttcttacatattaacgcagcattgtaaagtggctcattacagagctagaggtgatgtacagtgatagaaggtcaaaggcacttcccaaaacaacagtggactgggtcagactttgtttacaaaaaagaaaaaaaaatggtaaaactagagaggggaatatcagaattcagctatccctagattgctaaactgcataatttcctttctgtgatatcagattacagttagggacaggagataatgaatcaagtgcttagcattgtgtgtagttcatagataattgttagtttttgtcatcatttccttttatttaaagcacccattaataacttacatcatttaggtactgtgcgctttctaaaataattctgcatatggttattttagttcatctttaccacagacctatctgtaagttatctttaggtccccattgtgcagatgagggggaacagaggctcagggatattaaccacctgcgcagagtttcagagttcataagtaacaggatctgagcactgagtctttggactgttaatttgactctctctaccacatgccaactcttctgatcacagctatggatcactaacattagagaaaataaacaaacaactcctctagcttgatcagtggtccctttagtgttgtactgtaagatagccacataatagtagcagctaacatttatccaaggcttattacgtgacagatactgtgttatgcactttatttgcattgttttttaattttctcagtatcctgttgggtaggtactattattttctccatttttcagatgaagaaaccaaagcttaaaaaggttaaatttcttgcctgaggtcaggtagctggcaaggtgtagaaccttgtagcagttataacctctgattccaaagccctcaactccaaactgcatcactatgtcatccacatcagacagtaccatgtgggtaaatctgtatccttttttcttttttgagacggagtctggttctgtcacctaggctggagtgtagtggcacaatctcggctcacagctgcaacctctgcctcctgggttcaagtgaatcccctgcctcagcctcctaagtaaatgggattacaggcgcccaccacaacgcccagctaatttttgtatttttagtagagacggggtttcaccatgttggccaggctgtccttgaactcctgacttcacgtgatccacctgcctcggcctcccaaagtgctgggattacaggcgtgagccactgcgcccggccagtctatatccttttacagttccaataaaacatggtgagggtaaaggtagccagacatgtgattacaaatacagttacatattcagaacttttggtggataatttaggcaatcctacaatttatacttcatctatttgctaagaaaattaagtataaacataatattagtaaaatgtttatggaaatagaagtgaccatagcttttccaagcacttaagacatatgagttaaaaaatcactgtatccaataagtcaggttattctctaattcagatttgcaataatatgttgacacagtagtatgatgtagtgtgatttttactgttacaaaaagaaagccttgctatgaaagtcttacgggagagaggtatctgtggctgcttgactatacatgagataattaccttctggacttctgtagcatatgccagcagaaacagtaatgttttaatattttaataatggctaaacaggttacacatttggtaataaactaagaactttatgtttgtagacagttgctattagctgtattagtattgaatcatagttaacaatgggctaactgaatcatactaaaatatcctttctatttatattaactaataatgtaggtactacttatttgagaagcatttcctgccagtggaaacatcatattaatttcttggggattttgttattgttgtggttatctgttgtttttttaaggatatgtattggctccagcacagataattaaacaaatgtgaatttaaaaataaatcaagtttataaaattgactttatgtctgctagttgaaagccttgaagaaatcaagattaatcagtactctgtcttttcaatatatatctgcagagcctagaataaggcaggcaaataaagaggtactgaaaaatattgtggctgcagttgaattgagaagacaatgcatctgaaaaattgtcatgtcactgggacatttctatgccaacaataggtatggtgacagcccatgctgtgataatgcaagcttagtttaacctgcacagtaaggagactactctgttatatttatatatccctgtcctctctagactggagagtaatttaaaatttgtcatttttctcgtagcatttctgggaaaattgagacccagagaatgtctggaattcatcagggaggacacaggtgctatgtggtgggcagccccctcctgtctccactttgacctcttaccctgtctctagaatgcttgctatttctatggctaaaatttgtgacttaagtggggagctttgtaaccataagctataagaactgaagttttagacctgtttctggaattttccagtgttctgtgtgaagtgagggatggctgcatggcccaattgaaagccaatgttctgatggccctggataagtactgaaatcgcatgcacattcctgctgaattggtacagcctcttgttgcctacaaagttgagcatttataggaaaggatggtttccaatcaatatcttgtgtccatatagggcatctatttgtgttgtttgagaaatgtgttattaaatcaggtgtcctctattaaaaaggagtgtctttcttcggttgctaaaactgagatatggtttatttatttacaaaatggaggccatgatattagctttattacccgcattaaagaagagtaactgctcaagaattttcccactcaggcaaatggtgtgaagaggaaagaactggtgccaacaactgctcagattctaataaggacaaaatcctaacaaggaagttggctccaaatttgaagggcacttgatagcttggacctgccttttaaaagttggtgaatacatcatcagtcgggggtatgagggacctgagggttcgatatgtcattacagccagttggctcgtggccttaccagaagtgaaatgatttatggaaccagagtgggataactaccgagggaggctgggagttgcctcgggaggtttataaaaagggcgaagcaacgtagtttctaggctggagtcatgccctgaaaggatgccctcaccaaggggcccctccacaaacgtggaattcatcttcagtgccttccagacaattccaggccaacaattaacatttcagggtttgccaaggagcgttagtttcctgctcagcatttggcttactataaggctctttaggtgtgttttccaaagttttgtcatcgtggctcacctggaaatgatgaccagcacttacagctgaaggtctggggtttgctgggctccatgccctgtgctgggatctcagcatacttgtgacttgtaactttcgagatattggagtactttcatttggctaagatttaagtctgcttctaagcaaaggccaggcagactaaaatgaatcatcgttgatgaagatttgaaaaacaaaatgagaccatttctaaagtcaaaggctcaaaggcaaacttatttttcaaggtccaaaagagcaacctttagacatggagatttccaagctcattgcaaagtctgcagagcagccctgctggctcgtacaccctgacctttagggagagcctgtggatccagccacagctggagggttggttacacttcactgaacgaagttgcaggcatttgaaagaccgaggagactgcttcactgagtgcttgttccctgtgtagcaaggtacaaacaatttcaggcttggtaaaatgtggggtaaggagcttggcacagaatagctaccagggtgtcggataaaatgacagacatgtgtgcccagcacaactggcaccagctgtgattcattgtctgtaataataaagcactggcccgccaagcacggcgcctgtaacttggctttgcactattgcgcctgccatgctgtcctcgcttctctgcccttccctgccaacccagtccccaactgcatcttcacacacctcacagctgcatctgctggggaagggttcgcaaaggtgggcacgaagacgacatggcacagatgaataagagttggctttattgcacctagttactttcaggggagccatgagctatccctgtgtttcccaagttccctgaagataaagattactgcaggggtggttagatttcataagagagacctcatctcagacctattgaatgaggatgatgtaagataggcttggtagcctgtgtgtacgataagcttccaggtccttcttactggggaggtttgaagaagattgtggcaggggcagcagtgctcagcctgggctggagttagaaccacctggggaacctgactcagcaccacgtccaggccatactcagacaagttaactcacaggctttggtaatggggtcccagcactgctatcttttaaactccccaggtcactggaggaatgtgtagccaacactgaaaaccactaagctgcagaaaatgactcataaaggggtttctggctctcgggaaaatctgggtcttaacaagcactcacgtaacttttgtgtccagagcactttgcagggcactatggagatatgtggccttattttaagtaacagaaagaacctcacctttctggagcctttgattcactggaagagatgtgtacataaagtgaatccatagtagttttgggtgtttgttttgctttttgttttttgtttgttcgtttttagacagggtcttgctctgtcccctaggctggagtacagtggtgtaatcatagctcactgcagcctcaacctcccggactcaagcagccctcccaccgcagtctctggagtagctgggactataccaagtgccaacataccctgctaatttattgttttgtagagacagttctcgcaacgttgcccaggctggtcttgaactcctggcttcaagtaatcctcccacctcagcctcctaaaataaatccaaagttattgaccaacaaatcacaacgacaagcagcattaaaaatggaattaaatggaatggaccaaactttatgtcgccatttagccaccgaaatacttacattatatataattttttcttttaaataattgtgataaaaatcttcacacatctatatgtaattctctgatattttggataaattctgaagcacaaaagttccttgacaaagagtataaatatttgtgagtgttgataaatattgccagatgtcacccacaaaggctgtgccagtttatacccacgtagcccatgtctgcaactcttttctacacaagaggtcgtcaataaaaaatgaaacacatgaacaaaaaacctggataatgtaaatctgaggatacagagagtagagaaagattggaatttggagtgggttaaggaagggaaaattcttggaaagaatattttgagctggaatttcaaacatataacttctcatccctgagaataatttataaaaaatgtaaaagtacattttctatactttttttagtttctggtaataatagaaatgacaaaatggaagagaataagaatgactcggtgatacattttcacattttgatagtagatacaaaaagctctgagacactcccaacaggggcactgttagatgacatggaaggcagctgggtgggcccttggtgcctggctaggcactgactcagatcatgtgtcaggcgtaattcgtgttcctaattgctgccgacgaactgtgaagacagttccccaggaggctttccagaagtgctgtgattaatgctagcacagctggaaaagtgaaaaacacccatttgattttgtgctttcttatatttactaaaacataaacagcaaaataaaattttccttattttgagtaaaggagatggttattaggccagccttttctaagaagcaaaaatctttcttgcctagctgatcatgttttacaattttcatgtcatacaacatgcacattgtactttctgacattttattttgttttgtacttaaactatttgacatgtatttgttgtcataaaattagactcaaatttgttgtcataaaattagactcaaatttagaggcagagactgttccttctattctgtttttataacgagaggctgcataaagacttgggaaataaatgaacaaatgtacttaggatgacaacaaaccggaaacagcaaattcagaaaaaaaagaagtgcagcattattttcttggggatactggccaaagaatgtttcctataacatctttttaaaaaactaattattagtgaaaaatgtgacctagaaaaatcaacattgtttaatttccattcttttgcagtatcatttactcaataattttaagaaggtagtaaagccacagtaaagttttatatttgataaaacattagatgtgggaattcaagtaagtcatttttctctggagcatctcatgatgagaaaatgtacgtcccatatggtcttactgtgtccggaattggttccctccggtgggttcttggtctcactgacttcaagaatgaagtcgcggaccctcgtggtgagtgttagggttcttaaagatggtgtgtccagagtttgttccttcagatgttcagatgtgtccggagtttcttccttctggtgggttcgtggtctcgctgacttcaggagtcaagccacagacctttgcagtgagtgttacagctcttaaaggtggcgcgtctggagttgtttgttcctaccggtgggttcgtagtctctctggcttcaggagtgaagctgcagaccttcgcagttgagtgtcacagctcataaaggcagtgcggacccaaagcgtgagcagcagcaagatttattgcgaagagcaaaagaacaaaccttccacaccatggaagggggccggagcgggttgccactggggctgggtggccagcttttattcccttatttggccccacccacgtcctgctgattggtccattttacagagtgctgattggtccgtttttacagagggctgattggtgcatttacaaactgttagctggacacagagtgctgattggtgtgcttacaatcctctagctaaacagaaaagttctcccagtccccacccacccaggagcccacctggcttcacctctcattagggcatatattaataaaaataacttatgaagcatgtaaaatttccttcatccacagcacacacaaaatgaaaaacattctttttccttttgctcatctacatttattgaatatctgctctgagccagagatgaaaaaaaataaacctacaattatgataaagaaaaccccaacttctcaaaaagagaaactatcagataaatcacaaatattgcccctgaaaaagttagactgttcaccttagcaggcatttgatttttgacatacttacgattttgcagaaacattaatttttggttaaaaatatgcagttttgaagaccattttttttcgtggtcaggagtaaagatttagatttgaactggtgaaagaaatcccatatagttattgcagaaagaatgtaaattttactaaagatgccaaggcttagaattacagagcattcttgcaggaatgggaattggaaaccctctcattcagctgaataactgacacatattagaagaccaccctgccccgcggcatagtctgcttaatcagggagaatccagctgagtcctgtgatccacttggcatttctactagcaatagaggcttggaagagaaatttcactctccccaaattcccaaactgaaagcacgctgagcagggaaggagaggtcctgccccagatggcatggtgctctgctgtcccgttctcgtctcccctgcctcactggtaaggactgtacttctttgcagcttccaagctagctagctggaatttatcatctagcatgcatgggtcctgggggcagggtggggcagtggctgaccggtgacctgcccaacacccctgttcctcccacagtgggacatttgtgtccagagcctatctacaaatagagattcaggatgctgtgtcaatctcacattctctgtgaccatgcctttcctcaagcatctccccaaccctaattattccattcattccctgcacaggagattgtatcatactgtacatgtgtgtactgggctttcttttatgtgtgacacacttgtcagccccattacattttcagttctgtcatagcagggatctttattaccttgtcattatcatccctagccccaatccttcctcaattactgtccattctcttgcaaaatgtgaatgtcacaccttatacacacacacacatgcgcgcgcacacacacacacgcgcacacacacacacgtcttttgctcctattgaattttagtaaatgggacaccaatccttgttcatcttctcataaagaagaggaggaagaggaagaaaaagaggaatacagggggagggggagagggagtggggagggagaatcaatttgggccatgtgattaaatctaagaaaccagagaggttgattttagggtgtctagacctcacctccagcacgttccccaggccctctcttcttcctcaactccccttgttacaactgcttcaggaaaccatgtcataaatgtttggagacgacatttgacccacaaacttccagctaccttgttttagcagaatgatagtagcctgtgggctatagtgatcctctggtctaatgtgggatgttttttattattatgtttattgtgtatatttaaggtgcacatcatgatgttttgacagacatattcataaatgactactacagtcaaataattaacatattcttcatctcacagagttacctttttgtatgtggtcagagcacctaaaatctattcttgttagcaaatttccagtatgtaatattattaactagagtcctagtgctgtattttagttaaagaaactcaagtccataaaacccaattcgcttgttctgtgacatgcctagtagcagagatatgatgaaaattcctcacatttagtattttttcccaatacacctcttagccataagagaaaatacctttaagtgaagggggtttctaattgtgttattttagatccagtgattaagtgggaataaagtttctcattgttatagtttgttttcttttttcttttcttttttttttgagactgagtcttgctgtatcacccaggcagtggtgcgatctccgttcactgcaacctctgcctcccgggttcaagtgattctcctgcctcagcctcccaagtagctaggagtacaggcgcccaccaccacacccagctaatttttgtatttttagtagagacgggatttcaccatattggccaggctgatcttgaactcctgactctgtgatctgcctgcctcagcctcccaaagtgctaggattacaggcatgagccaccacacccagcctagtttgttttcttttgtgagagaaaccttaaaaccctaccgtgtggacccccgcagtttgtcccctgcaagcctggcctgtgctgatgcatgtgaatggacaagctgctcttggatcagtcccaagctaataagtaaaaagatccttccagtggatggacacatatcaaaggttgtatgtagaggatgaagagaagttttgccttatttgataaactgtaattcaacactgtcattggttttcttggtctttttttctctcatgtttcaaattaatatcttcccaaaagatctcctgtggctcataggcaaccaggtttgcgctgaataaccggctgagtagctgcagaaagccatcccaagccagtaaattccagctctgacctcactcaattccacacaatgaacgtggccccaaagagggagagcagtgtgtttatgtgtgtgtgtgtgtgtgtgtgtgttattcttctctcacctgctcagcccccacttgctagaggcatgcactgagctcagtgctttacacatgggctcccacacttgctgtcctcgttcccattttgcagacgaggagactcagcacagagataaatcaattaatctgctcgtcacttagagtctcaccctagctagtgatgggtctggaatttaaacacagacagtctgactccagagcccgtgcgcttaattccacgctgtgcatcctccacctgattttattaagacacgttttttaaggtagagagtattgtggggagggcagggttaaggatagcaatcataactggtgttggcagagttcttccacacactgctgtggtgtgctccgcggacgtgccgtggggaagccaactttctcaggaggtcccattgtggtccatgtcccacacatggtttgtgaggttgatgtggctgtgaggccaggtgcgtgttgctgcaaggagctgctcatctgctctgccggccaggaggcccatcctcttcttttcacatcacaacacacatcccatccctttccagagagagaccagaagaggcttgagtgcctgctggccttctaagtaagatttaaatggacagaccagtatgagaacccatgcctttttctgattttgaacgtatattttttcctctagacatgagtccaagtatttggggcccaagaagacagaatctttgggagtacttgttttttgcagacctagttatggaaagatcctaaaattttcccaaagattgaatgatgaactcatattggtgtccaggccaggaaacacagacttcatcttttctagagttttatgccttcatcctctccatttttttttttttttttgagacagtttcgcttttgttgcccaggctgaagtgcagtggcgtgatcttggctcactgtaacctccgcctactgggttcaaatgattctcctgcctcagcctcctgagaagctgggattacaggtgctcgccaccacgcctggctaattttgtatttttagtagagatggggtttcatcatgttgcccaggctggtctcgaactcctgacctcaaatgatccacctgcctcagcctcccaaagttctggaattacaggcatgaaccaccacatccagcccatcctctccaatctttaattctggtcttgtaatttgcatttgtctaggtagttaccacacctatgtgtgatcaagattaactgctgtggtaaatgtaaatattttttatgacagttttcagatctttttcatagttttcatctttctcccatgaataaaatggcaggtttgtaaatgattataaaaagaagaaaaactattttgtttttccgtattgttgagggatttgaagaagccccattttctggggtgacacccaagttttgttgtctcatggccacagagatcaaggacgtggacacacacagggtgaggtttagagcagaaatgtaataagtgaaagaaagacaatagctctttgctacagagaggggtgggtcccagaaaaatgggttgccaattcacagtttggatacagaggcttttataagaaattgacagggggcagggtgtctcatttgcataaggtgtgcatttctggtagttccaccctttcctcctagtgcacacataggttcttagcttgagttactccatgctactttgttcccctgactgcacatatgtcaggggatgaaattttccattgtgggcttgtctgggcaagtatcctgtgtagtctttcttagctatgcagctgtggggatatcttaatcaaggccctggtcatgttcccttatctgtgcctgcaacttgatttttcaggctgttcttttgtttgaaagaatttaaccaaggacccaccttaactgcctgcctgattggtttcttcctttctcctctctcacattcaaattgtgttcttaaactattagtcagttagagacaatttagatagaaggtcctaaagcattcaaatatcatttatagtacatctacatttatttactcagaagctttaagtattgccattttgttctttatatttcaaagaagaggaaaatttcattgtcccccctttaatcagattcagacttggagattaagtcaagcactttgtcaaaatgaccattgcacacatcaagatttgaaatacaacttctttgacaggtgtctgccaggaatgtcctacgttaggaagggagtactcaatatttccaactcaaattaggtctttactatggtatgtcactatatgaatttcactttttaaaattactgtttctctgtcttttaataattaccataagacagttttatttaattactccatgggaaagaatgtgggcatgggttttcaatttttaagaatttgtgcttcctttttcactcgggtaaaataaagccatttagagttacgtttaaagtatatcctgcccaaatactaacctactggtttcagttatagacatgaaaaaatagttttccacaagtattcttcattgtctttgtcattgaaaaagagttaaactctgtaaaatatttgaagagatttattctcaagcaaatatgaggaccatggcccatgacagagccccagaggatcctgagaacatgtgcccaaggtggtcagggtacatcttggttttatacattttagggagacataagacatcagtcaatacatgtaagatgtgcatgggtttggtctaacttggaatgaggtggtggaggccccaagggggtggaggggcagggagcttccaggtcataggtggattcaaagactttctgattggcaattggtgtttatctaaagacctggaatcaatagaagggagtgtctgggtgaaaaaaaaaaaaggcagaggggtggggttgcagagaccaaggttcttattatgcagatgaagcctccaggtggcaggcttcagaggcaatagattgtaaatgtttcttattagactttaaaaggtaccatacacttagttaattctctcctggatcaggaaaaagacatggaaaatgaagaagattctctgtggaatgtagattttccccacaggagatagctttgcagggccatttcaaagtaggtcaaagaaatacattttggagtaaaatactttgattttattcaagatctgctctctgtcatgttggtatcttattgctggaaagagtctgtttggtcagtcttaaggtgtctgtgttaatgttaatgctggtcagctgtgcctaaattccaagcggagggaggtataatgaggcatatcctaccatctattcccatcatggcctaaactagtacttcaggtttactttaaaatgccattggctgaggagagggccaaaggcatttaaaggcagctggttgggaagcttagaattttatttttggtttacacctttttgttttgtccttaaaaattcagaggctactactatgagtgctattcatggaattcagacagaagcaaatctcgttacagcaaaactctgcaaaggatgatgcattcctgggttttctccattctgagcaccagccttgaccaaatcgttgggtggtgttcatccagtttttgtaacagaatagctatacattaaagagtataggaattattttaaaatattagaattatttattaaagaatattggaataccaacataaaatttattgaaaaggattgattgcacactgtgagataaaggtattattatctttaaagcaaaattaggaatgcttctgttctcaagatattggaatatcaggacactcgtaagtctgggtctgtttagtaaatgctaccagtctgttcctttaaccataaacgtctagaagctaggaatgcctaactttctgagaatgcagctaagcaagtcccagcctcattttcctaaccctcagttaagatggagttgctttggctcgaacacctctgacaaaatcagtctccctgaaaattcagagactggggttttcgaagcataatttggtgggtaggggtcagagggtgaggagtgttgattgttgggtcggagatgaaattatagggagtcgaagctgtcctcttgcactaagtcagttcctaggttggagctgcaagaccagatgagccagtttatcaatctgggtggcatcagctgatccatggagtgcagggtctgaaaagtatctcgagtaccaatcttaggttttacaatagtgatgtaacctctaggagcaattgggaaagtttagaatcttgcagtctctagctgcataactcctaaatcataatttctaatgttgtgactaatttgttagttagactatctttaaaggtagtctggctcccaggcaagaagggggtttgttttgggaaagggctgctgtcatctttgtttcaaaattaaacgataaactaagttcctcccaaggtagttcagcctatgcccaggaatgaacaaggacattttggaggttagaagtaagatggactcaggtcagatctctttcactatcgtaattttctgttataatttttgcaaaggcagtttcaatagagtcaataacagtttactattaatacttctttttttctttctttctttttttttttttttttttttttttttgagacgagtctcctgttgcccaggctggagtgcagtggtgcaatctccgcccactgcaagctccgcctcccgggctcaagcaattctcctgtttgagtctccagagtagttgggattacaggcgtgcgccaccacacctggctaatttttgtattttcagtagagacagggtttcaccatgttggcctggctggtctcgaattcctgccctctagtgatttgcctgtctcagcctcctaaagttgccaggattgcaggcatgagccaccgcacccagctgtttagtacttattatttactttgtcagttcagacaaagtaaaataaaaatttaagtaactaaagcacaattcagtaaatttaaaaagccctggtacctgtatgcatattgtgaataaaaatgctagatcgtaaacatgctgagggcaataccatttctaagctcatccaagtcaatcatgctgccttatttaactttgtaattttcacagtgcttaacttagtgtctagtactattttattttctgttttttacataattcttagctcaataccctactatagtgagtattgtacatatggtgataaagaaggaataaatgaatgagaagattaatttgtcctgaatgtccagctatcactgatcacatttatacaggtacatggacatcaccaaaatatattgagtagtgatggtttttcattttaaaacaccacagattcatttaggaaagcccctcaatctcattgaaattgaagttttgcatccctgtaatgaccgtggtaatctagagtttaattctctggcccaggggtggagtgggcagggttgcactgaccccaaagtcccctgtttacctgtgggtacctaaggggaggggtgaaaggaggaggaactaccctccactttgctgtgtgaaggagctttttgcttgtctctgggaccagtaataaaacaaaacaaagcatcatttttttatgtctttcttgatgtatgagagaattttcatttatgaaatacacatataaaagaagaaaatatgccagaaattattctttctccagggtatgtgtctttagcaacatagaatagtaaattgtgattctaccatcagttcatatttcctatattgtgaatttttaacatctttatcatttgccttttaaacttacttgggtttagagtatggttaaaaaaaaaaaaaaatcctaaagcccagaccaagtttgttattttttcccttactcttcatttagctgctgagtattatcacatgtgatagatcataactcgtcattcatcccctgtgacattagggggaaccctgtagggcttactactgaggtcataacttgcccaaacatgtataggttgtatgcctaaactagtccagcaaagctccttgggtgcatatagcataataaagctttttctggaataagtagttaagaattatttcaatcttaaaatatttttcccaaggaatagaaaaaagacagcacaccttacagacaattcattatatggtaagaaactacacaacatcagtatgagaaagaaaaatttcagaccaattgcactcatggatacagaagttaaattgccagacaaaatactagcaaactgaatccaactaggatcaaattggattcatctttagaacacaagaataatttaatgttagaaaacctataaatgtatttcaccataacaatagacaaaaatgttaaaaaatctgatttttagatttttaggttaaaagcctttgtttaataatcgtcttatttgatgcaggaaaaaaataataaaattcaacaactaattataattaaactttctcagaaactaggacaagaacatatttctttaaactgagaaaggacctctacctataacaaacattattcttagtagtaagacattagaaatatttcctttaaaatcaacagcaagacaaaaatgcccactagtgctgattttgttttgaggtattgaatgatgcaagaacacaaaataaataatgatggcgattgaaaagaaactgttttcttgtagatggcatgattgtctacatagaaaactgccctctccccacaaaaacatagcacttaccactttattagaatctaaacacataagttactaaagaaaaatacatatgatgaaaataaaccagacaattgtggaaaaatcttataagtcattgaacatttttatagaggaattaattaagtggatatatactatattcatggataggaaaattaaaaatcatgcattatcaattctctacaaattgatcaaggaaaatgtaatccagatccatagagtactttcacaggaatgtgacaaattgattctaaaatgtatatggaagggaaatgggggcaaaaaagcaagtattgccaaaactctcctggagaagcaaatgaggtggcacatgccctgcttgctatcaagccctagtgaccaaggaattaaaattgagcaatatagagtaatatttttatgaacttagggtagagaaggatttttaaaatataataaaaattgttagccacagaccgggcatggtggctcacgcctgtaatcccagcactttgagaggccaaggcgggctgatcacctgaggtcaggagttcgagaccagcctgtccaacatggagaaaccccatctctactaaaaatacaaaattagctgggtgtggtggcacatgcctgtaatcccagctactcgggaggctgaggcagaagaatagcttgaacctgggaggcagaggttgcagtgagctgagattgtaccattgcactccagcctgggtgataagagcgaaattgcatctcaaaaaaaaaaaaaaaattattagccacaaaacgttgatgagttcaacagcattaaaattaagaagttctatttataaaaaaaaaaactataaagataatggaaaagcaagtcatgagctggagtaagatatttgccatatatataaataagaaagcattagaattgcaaataaataaatatttttgacaaaaaatactgaaaagaaatatgcaaaaaagacatggatagtccttgccaggcgcagtggcttacgcctataatctcagcactttgggagggtgaggtgggtggatcacgaggtcaggagatcgagaccatcctggccaacatggtgaaacactgtctctattgaaaatacaaaaacttagccgggcgtggtggcgggcacctgtagtcccagctactcgggaggctgagccaggagaatggcatgaacccgggaggcagagcttgcagtgagccaagatcgcgccactgcactccagcctgggcaacagagcgagactctgtctcaaaaaaaaaaaaaaaaaagacatggatagtcctttcactgaaaaaataaataaatggctggtaaacatatgaaaatatgctaaactacattagtaatctgagaaattcaaatttaaactacaaagtgacaccactttatatcctccggattggcaaaaactaagaagtctgataatactgagcactggaggagattggaagccataagatctcctacatactgccagtaagagtgtgaattggtacaccatgttagaaaataatctggctttatctcatgaagttgaacatgtgacctagccaatgcattcctgagggaatatatagcccagagatactcttgcactgatgtggtatattcaaagcatggactattactcaaaagaaaaaatgagtcattgacaactaaaaagagttgtggatacaggctcgttgctgaagttcaggtaagtataatatccttttttacagagttcaaaatacataggaagacagattagatagatagatagatagatagatagatagatagatagatagatagatacacacagataaatgcattctcagaagactgctttgcaatggcaataaaatcataaatatgaatcaggatggtagttacttctaatgggggaaaaagtaagaagagcaaaggtaaacatataagaagactttgttctatccagtacttcaatggcaaaaacaaacaacaatgatagtagaaggtcttttataattcttctctgtgcctctctcctttcctttttgactggatgtttcaaagctgtttgtctcaaaaaaataataggagatggagaaagggaactgtgggccagcattcaacaaatgttatctcatttactcttcacaagaaccagtaagctacatattactttacttactgcaaagatacaaaaactaaagccaaaaacgaataattatctgcacaatgtcttacagctataaaagctgaggtttgaattcacatcagtattataaaagtccacttttgtaacaagtgatataattatgtcatgtgatatgtggttattatcctttaaaaccaaaggacattttttccctagaaaaaggaagcatttcagtttgcacttagcaagaaactcaattctttatgaaacatagtatgaggctaaatgctctaaaatttaagtgagggttatccacatatcagaagagactgagatactgtctaatatacatttgtcctgcacaggttttgagtgataaaaataaacaaaaattaccaccagaattaaatttaaaggttaaaaactggtctccaaatcattgcaaacaatcccttttaagttataagaaataggaagatttttacatctattgtgaaaatggattttaaaatagttccaatgtgtatgggcccataggccttgtttttccttatgatataaactttcatacagaacatttcagtgttcagtcacaaggcacctttatagcaagctatcatattctttgaagtaagtataaatttgaacaaacagtagataatgattctacagttttggagatgttgttacatttctccaaaaaagagcattcctctcatctgctcagaatcattactcggcttatgaagagctgttagtgttctgtaggaattgttctcacatctgagacgcacacaagagcaggcatttgaaacacctccaaggttcagatagatatttgtctcgaaggcccacccagcaaaattttagatcctcaaatcaaattctagaagcagtctttttttttttttgtaagatagaagggcctttattctttattctggcataaacgtctgaaaaaaaggatagtcatgaatcccttgttagagttgggtttctgtgagccattctccaagcaatcaggtgctcagttctcatcatctctcagtaattacaggaaatggcagtaatgcctaaggtacctgtcaaaagcattgttgtttgccgggcccttaagtagtaaatgaaagctgattcattcatggacctgcgatggatctttgttcctttcccattcagaatctgctcttcccacttcactctggatgtttgcagttcatgctgagagtagcaattcattcttggcaaaggctcccctatggcttggattacacagctcttgtgtaactgagctctgcacaggagcatggcaggttggggtggggcgggggaagtgagtcgtactggttttcagtctgtgccagttctcttaaaattgatctgcttaccaaggggctccaaaaactaaaatacctcagttattttgtctggactctgagaaggatgtctctgcataatgaatgatatgctctcttcagtcaatttctgatgaatcagaaatggacctcaagtcttgcaaaccaacaacctctccccatcccttcttagagcaaaccagtgttgactcccagtgaaataaattttttttaaaaatccaaatctgaggctcatataaatgtaagctattgtatagatgtttgcttttttataatctttactcttccctttgctttggtgacaagggctcagaaataaagttaaactttttacatatcttctgttttatgggagctttaaggaaagagaaaaactggaaatttctcctatgcatttgtttcacatatatatactccaaaaattttctaggattccatgtttaggcaatggattttttatgggcactaatctggaattttgtaagaataagatttcgtgatctattgcactgtgataaccatagttaaaaataatatattgtatgtttcaaaattgctaacgaatagatttttaatattctcactgcaaaaacaatgagaaattggtgaggtgatagatatgtcaattaggtttactgaatctttctataatgtatgcatagataaaaatatcactttgcatcccccataaatatacataattattatttatcaattaaaaataaataattttttaaatgtatgatagcatcgaaaactacagatttcattttttggcctgtgtaatcaaatgaatagaataaacaaatgattaagtgtaacgaatgtaaatgctctgaaaatgggcaattatattccacaagggaaaggaagcaagtcagtcttttttggacactaaacatcttatataaatgctgcaacgccaatgaaagtgaacataaatatttaattttcttgaaatataaaacaaatttcaaaatgtttaaaaggatatagcattgtctgttctagcaccaactaggcttcatgactaaagcccacagctcctgagcctgtagtcatcaagcctggctctagaggaagtggggcaggtcccagtgtgactgaaatggactccatagactctcaaagctctcccactggggccttcccactgaactgcacacatttttgctctcaaacccagccagtttggtttgaactccgaccaccttctaggtcttactgtctcctttttccccagaagctgagccctccattctcttcccccagtatctggttctagcattaccacttactgagtaggtgatcttgaaatagttaatctccattttaatctttaatcataatcttttaaatgaggacattaatatataggattgttataaggattaaatctaaagtacttaatacagtgacttgcatatagcaggctccacgttcgtggtagatactatgctaatggttcaatgtggccagacctttccttacctgcaatccatgtccaatgattatctctttcaagagatacttattgttcctcccatctcctcattggcttatatgttttgagaatcattgccagccaagatttgatttgagtggccttggaacactagaatttgcaaggctggccggccaatgtggagcccagccctgctggttggagtagtccttctggaagagtcttctaggttttttcttacttttattgcctgtcaacctatggataaaacaatacaaaaattatataagataagccgacaatgtgttttatgaacctgggacacagatgaattatgtcaacctaatctctaaagaggtgtggtaaaatagaaaaggataaagcaacaataatgacagtctttgtcgctaagaaagtcaatgagactgtctcattttatgctgtaaggtccccacaggcttcatttgctctcctgagcagcccctcccttgagagcagggtgtggcggtttcctggcccacacactgaaggccctggtttgcaccctgatgtttctgatggtcaaagccaaggtgatcatcaccttagggctcagatgtccttgggggaactttgtggtgctcagactacacgttggtgaccctctttgcattggcactatcgttctttggctgagctcaggaagttccctctcccacccccatcgctctcttcagcaacctccccagtgcagtgatggggagggagacacaagctcttccagggtgctctagtgccacagtgcctcactggactcgctcgctgtcttacagccccttctccagagggtctcaccggacaagctttcctctgtcagctgggatttgggtgacaccaatggttggacactggcccactccagccaccaaccccagctgtcagttcatgaggaaagaggagggtgaatccacctgtctcaccagaggtaggactagacacagagtagattctctactctatatttgttgaattggaatgagtgaattcttccttacaactaatctgtcccaggagactgagtccatgggccctgcatatttcctgtcccagagagtgccccctgcccacttagtaaccctgagatgtgggtgcatcctcttctccaccttcccgtccttgcttaagacttttgtcctggtactgttagttgtagcatgtgtagtctctgtcttctcagatgttttcttagatcatgtttttcaaactcatttaaaccatgacccagggaaacaaaaatttaatgaaatactcacctttcctgtgggcgatgttctctaatatttctgcattctgctctgctctacttttctagtctattttattctgtcctattgcacttttaaaacactggccacagctcactgaattgatttttaaactcctgaataggtcactgttcacagttttaaaaaaatactatatgaagaccatattccaataaagccactgacattcagccatgacatgccacagtctccttagtgaggaagcttttgtccacctcacagtcttctcagttactgaatctaaagtagatcattactatgattctttgttaattcccttcataacattaacagcaatccacacgtattttattcatttgtctatgtccttatttctgcctcttcaaaatgaaagatccataaaggtagaactttgtcttattcacgattgtgttcccagcacaaattctctggtacatccatgttgaatgatggaatgagtgaatgaaacccttactacacatgtatatacaaggaagtttggttctctgaggacattttgattctctgtcaattttgtgtaaatgattatagctaatatatttaaaggaggggattttttttttaaagaatataaggtcattcacaccacagaaagggcaggagtcaggcagcttccagagtcaaagtggtagatgtaggggactatgtcattagggcaacatcatgaggttgagttggctccagtcactgttcagattcccagaaaagagcatctgactggctgctctttatctcatggccctctcttgtccaggagaggaaagagcacctgactgaggtcaagactgcaagcatgaggaggcaaagttaggtcctcaaagaaaaaccctgatgctatcagcacaggtaaggctgcacaggcagaaccaatgggtgtcaactacgcatgtctttatgtctgtcattcttgcaacagttaaattatagcccgggtctgatgttcgcataactgacataagatttcttagtcttctaacccttcccttctccagatctatagatgcctcccatggaagacctctctagtactctggttttgtattagaattattctgaatctatttatccaaaaattagttaatatcctgttttgtgttcagtaatatatgggacactgtggaaacttacaagataaaaatgtgacttcgtaccctactccagtttacagtccacatggagttcagacatttgacactttaagaaagtgatataaaataggattgtatcaaaatttgtaaagtaaataattgcatttctttcattctgcatttctagaaagtagctaaaatttttccaatgcatttctagaaagtagttgaaattcctctaaatgtttggagtagttataatgaaaaatatgattgctcaccttcactgtaaacatccttaaacaactgcttgagttgttagttgattgaatatagggataaaagaaataaaaatgtttagagtgaaggctagatttttgtcatgggtacttaagcagaaagatattgttacctttcgccggagggcaacagatttttggggctgaagagagatagttgggttttggacatggtaggattaagctgagtgattcttcaccaaacttctctttattctttctgctagtgagcagaaagaatagacctagtagaaagaatagacttgctcacaagcagaaaagaaaaggaatcagaggagagaaagacagctctaaaataaattactgcatttgcagaaaaatatttaaacctatttgtcttacatttagtgagatggaaagaacattgcataactaaatgtgcataaatatatacatctgctttttctacattttctttttccctcctctctcccttttcatttttgcctccttcctctaagaattatattcttttattctgtcaggtactgattatcctatttctttttatttcacactggttctcattttccctgagatattaaatttctaccttttaaaattagttccaattaatcgagtccagtttagcaaatcttagaattaagaatatggataattgtcaaacaatatagataattgcggttgtgtcttgaaaggaagtttacctttcattgaagcaattttagaatttgcaaacggatatattaagatagaaaattaaatgatgtttggctcttgtgtagtctacagaacagactcaatgattttgtcataagacttagttcactctcaactttgtcacttacttttaattattcttgactctccacaattgactgaagctataaactcctttaaaaatagaacttccaaaagtgtgctgtatggaactttaatttcatgagaatttgatgttcaatatttcgggataaaaaagaatggcctaatgaagtactgggttaaacaaatttggcaaatttcatttctcaagtgtgttgagggttactgagagatgtgttatgtagaacttcctaaactcatttaactttacattcttttttcctacaaagaatcctaaatgtttattatcccatggtaaacattttggaaaatgctagattatattatctaaatgttgctttatggcatttcttgttctatagaaacattggtttcaaataatggcatttactgtgcgtgatttcagaagcactaaaggggttaaaagacgttaagaataagaattaggtgttttctgttactaattaatgaacgatacatatgttgatttgggtatatggcattgtgaattaagtaaaataattttaaagcttattagtacattataaatacttagaataaaacataatataaaacttacattccctgtgctttccttaagctattcaagtaaatacctgtgtctcacttcgtatttatgcaacataacgtcacacagtatgactatgcataatcccgattttacaaacttgagtgactcttttactgcttcatgtggctatttttaattttggtaggatataatgtttcaattcacaatgtacatttttaaaagatgatgactaactctacaagataaacagttacttacagataaatatatgcattgtatggcacaattgtaatatttagaaattacgctttaggtgggatagattatataaagagttaacatggtgttctttgcctattagccattttgcattgcccacagtctaaatgggctatataatagaatcattgctatcattgaccccatcatggtgctcagcgaccaatggtcctattaatgacattccatgcctggaaatatctatggaaccattctcctcctatggagacagatggtgggtttaacagtgacccacaaggccagcctagtcgtctgttttcattttagtcataattcatccagagccagatgcagaactatgcatgaaaccatcacattcttagtgaatgcccacatgaacgtatgcacatcaagtttgtttgaatgcaatgagtggttgttttgaataagatgacattgccctgcatggtgctgacgattgtttcctagagaattttagagacaggcgccaaccagtgagtgaaactagatactccacataaaatgtactattataatgtctcaagtgttttagtttgtttgcttttgttgagtaggaaagtttgttttgttctgtaagaagtgaagagtataggaggcatttggtgaccagatttggccaggatcatgaaggccaaagttttaggacccttgcctctgtctggcccagacaacaccgtccctgaccagggtgcccactttgcatccacagcgactgtggtccacatgaatgcctgggccaaaatgatcaatgagtcagcatttaaaaagaaaaaatccttcaaaatgtgaccaagaacctcaaagtccatactctgatgagctaagtcaatcatatctttaaatacaaagattaacaaaacagaatttatttgaagattcatgaaaggaaacaggaaatgccggaaatgtggtttaatgaacttcaaaataaaagcaagagtataaatcttttctcaggtctataagaattgtgtgcattaattcatggaggaaagaaaatgcactctcagtaggtgattgaacatataaattaggctgaaggagaaactttgctatgcgtgaagttaaaggcatggtaaaagaggtctttcacactgcctgtgacctatgacatgattgctgactcagagaacaaagcatttttacactcaatgtccaggagaatggtggtggggctggaggtagggacaagacgtatccatcctgttaagtgaaaaaatctatcttcccaacccattttttagaaatccctccgagattcctccttcctccttagaactcctgaggtccaacaagccatccagtgtgacctgtcctactttctaaacacctcccaactctacctttcctcctcatccccactgtcactaaactagttcatgccttcattgttcttgcccagactgctgaaatcaccttctaacagatcttaccctcccaccttcctttaatacctcttgtttgaagaatcttaccactgacagcagagtatcttcctcaaacacgagtcttatcccattatcctgttacccaggagcctttaccagctatccatcactgttgagatgaaagtcaggagcctgagcaaaatatgcgaggaccttgatcagcttgcccttcctatctggctgcttcccaaaaggcacccacaacctggctcactcttacttacctgtgtactcccaggcatgctctcattcaagaagtcctctggaatactgcaacaccacccccacccccttgtgtgtggtggcaacccccaccttctgccagtgcaccctgagcacagagtcctcgtggcgtttagcacatgccattgtggctgttggttttctcatctgcgttgttccctaccctatgagcaactctgccatttggcaggcctcaactaattatagatgttattatcatagctgaaagatgtgatgatcccactacattgtgcacaaagactcaaaaagacttgaaaatctttacttagtcaacagatacaatttccagatcatggtttcattctataaagaaccactgagggaccaaggcaggcccaagactgagggtggtaccaacacttgctcactaccctcccaatgacgttgcttggtaagagttgccattactttctcagatgaggaggaggaggtgctcatccagcctgaggttgaatcaatgcaccaaccagttgtgtctgagtccaagcccaggcgctctccacttccattcaaagataatcactgtctcttccttaaaatgtggcagtaaaattaattgcttgaactaataagacttgaaagggccctggctgagctgcctgactcatggttacattgggacagttgggtgacacttctgcagagacagcctgagaccaggtggagacagatagaggaaaggggtgcaagtgctgagagcacagatccgccacagccacccctgtgtgagtgggacattcaatgcagcccagggactgctccctgctgtgcatgggcatgaccaagaatgtgcagctcaggctgttctatgaatccatggcttttgttggttctctgtatgccacataatatcattaccgttttttgttttttgtgtttttttgagatagagtcttgctatgtcatccaggacggagggcagtggtgtgatcttggctcactgcagcctctgcctcctgggctccagcaattctcctgcctcagcctccagagaagctgggattacggacacgcaccaccacgcccagctaatttttgtatttttagtagagacggggtttcatcatgttggccaggctggtctcaaactcctgacctcagtccaggtgatccacccaccttggcctcacaaagtgctgggattacaagcgtgagccagtgcacccggccatgtcattactgtttttagcagagctgccacgtgggaactgagaccatcacaatagagacagaggcatgcatagctttgaatatggcatatttcacgatgcagtccttaagtacgatttgctaaacatattagatatcaaaaagaaccacttaataaaaaataactactattcatctaaagaggatgaatctacaagaaatcatttttaaggaaagtcagattttaacttagaatccttgaagaatgtcttttatttattatgtattatttatttgacttattacaagttctcattctcagaagccttaggcacgtatgtgaaatataaatggaataattaaatccaatagctaaaatccccacaaagaaaaaaaaaatcaatgtaatgttactatttgcaatttaattgaagaaatcacttaaaacatgtagcaatttaaggaatttaataagaccttcacccgcttctacaaaatgaggaggcaatctactgctggcctccttctgttcttctttatgtagtagcgccatgtctatattcttcatagctcaccacagttgtaattactttgttttccttttgcatggttcattaaatatgtgttgaaatgtatgtatatgtgtgtatgtacacacacacacacacacacacacacacattctctcttctatttctatctctaaaatatgattctggattagggaatttattaaaagaaaagcctctgaaaaactctgatcacggggttcccttccattcaactgatgtttttctaaagaacttgaaaaacaaacaaacaaaacaaaacaaaacaacaacaacaaaaatactcctttgcaaagggagctgctgtccctgactggagcatgttgtcatatgtccgtgaccaggttcccaaacccagcctacctgctctagcaggcttctagtggggctgcttaaatccatcctgtttgtaaggcaggcagcaggcagccatggagcctgcccactctctgaaaggggccggctgacagcactacccatccgccctgtgtcgatttccacacggcacctcagaccaatgctcctggacaggaccagaggttgtggagcaaaagaggatagtgaaggaaagagacagctgggagacgcagagctgacgcaggtgaggcacatccctcagctggcgctcccttcccggaaacctgattgtctccgtcagtcgtttcaggcttcgtggtatctagagcagcactggactattccgtgcagggctcagggcctggaacacaggaagtgctccatgcgcagttgtatggctggatggatggaggatgaatagtgcatgggtggatataattaagaaaggaaagaattgaacattatttctttcatgtaaaaacttctgattcctcctgagtttctccactttcacttgtctccttcactgtctgcttccttcccttctgtcacggatgtattactgtctccagtccttggtcccttgtgtgtctctcttcttgcgtctactacatttatgtgggttttcccataggatcaccttggcccccctacagaagcttagtcctgcattgccaactccagctggacattctcacttatgcatctaccatatcctcaaagccggtataactattgttaagttaattagctttttttttttttttttctaattccttctccagattttcctggtgcctgtgtaactcatgccccttttgagcacctggctcgaggccttggcatcgtctttgctctgctcctccgttgcctggtgtcctttgttgcgggccttcctgccatttctctcactctatgtgggttgtgttgcaatcattttctaagcacacttcctgactccattttcttcccactgaagttgatactatccactaaagaacaattaattttctcagattacttctctgttcatgttactccctgatttaaaaatctccagtgactcgttatggcttaaggcagtggtttcccagaatgttagatatgatagagcagtaaataaaacaattagaaaaaaaatcaaaactagaaaaaactagggaggggaatcacttttatttctcctactacagacatgttttaaattaccatctatggtggcaatgattatgtttagaaagagacacttttttttttttttttgagacagggtttctctcccatcacccagccttgagtgcagtggtgcaagctcagctcactacaacctctgcctcctgggcacaagcaatcctcctgcctctgcctcagcctcccgagtagctgggactatggcatgtgccaccatgcctggctaattttcatatttttagtagagacagggtttcaccatgttggccaggctggtctcgaactcctgtcctcaagtgatccgcccacctcggcctcccaaagtgctgggattataggcatgagccaccgtgcccagctggatgagacattttaatcttgaaaagtaggaatgaaaatctcataatagaggaaaaactggaaataatagaataataataataactggaaataatgcttttatgaaaagctcaaaccactggtcacctttatctccttgttctggttccttgactggtgacaacatctctgtgctacacagagatcccgccaagccactggtgctcggagtaggagagagcttcaacaagcactcacggtcctttcatccatccatccttccacactcatctctcctcctgccttcagctgctcagtctgattgtgtctgagctctggggattttgcttaagaggcatgtgacacattgcctggtctctttgggcctttccttcctgctctttaaaatgaagagttcgaaactgacgttaatgaggtttcttccgttgctaaagtctgtattcaaattgattgattcgtttatctaattaaaggtggtatctatatgtgcacttaaatctagctttctgtctcataaactcaaaattaaaatattgaggcttataggcaagcatttatcatctgaatatgaggaatgaactgaagtacgtacgcaattgaaacctttccttatttacatgtagttagcttgacatcagggaacaccctgagtaaagtaggaaaatactcatttcatacatattgctttagtgtatgtgtgtggaacatattataatagaatatctgcccttccatttcacttagctatgaaggcaccagtgatttaacgtatactgttgtttttgcttttatcttattttattttgatacagggtctcactcaattgcccaggctgggcagtgatcatggctcactgcttgtttttatccccagcctgccccatccttcccacacaactaagatggggttcaaattgaagtagcacagacaaaaaaaggggaaagggatgatcgatcatattttttttttcaaaggaattaccaggcttgggatgtttaatcttggcagatggatgcagtctcatgagcctgttttgcagatttccagtgctatctgggcagagccaaatgaaaaataaatgcaggggaacatggacacaggttctagagtgggcaatccctcctgcagagtggaagtccttacaaatcctgtaaactccactccagtctcttaaattggagagattccctaccactctgtgtacatgaagagcagagagtttagagagcttgagatgcttggctgtaatctattcatgtgcacatttcccacctgagggccaattatcatctcagattcatttagttgtgactgagagcttcataaacacttctttgatattgacatcatatgaaactgatagatgggctcctaaaagaaagacatgggtggttcaaaatggaatcttatctcaatcctgtcattctgaccacagatcacatcttgcccctcaggagtcattttccgttgggttgtacatccaagtcccctggctcttgtggccaaggggagggacctctggatagctctcttcaaataggaaagtggaattctcacttttggggtgggcaggcaacttgccggacattagtgatgcttgaccaagtgccaggaagaggccattagctgggtgcactgctgagaagagcccattagcacccagctgccaggccacagtttggaacttggagcaagctatatattcacagcttagaaattgtgattctctcagtgtcctacagatggcttggaaagcgtgcaaagatgaatcatactctataatcattttgaaactttttccccaagatatcaaagagacagaagaaaaattaaaattgtggtcagtttcctggacattttatacacttgcggctgctttggaaacatcaaattttttaaatttttatgaacatacaaaaaatcatgtagaacttgaaaattgcctgaatttttcccacagtggcactttgttaaatgcaaaacccatttttcaaaaattactcatgagctaaataaaaaataacaattataatgtatcaaactctcaggatgattttcctccctattcttaagacagcatctgttttgccctccaagtcttaggtattcccacatttccaatgaggagatcagggaccaaccagggtgtgtttatgagctctctgcagcctggcccaccttcattgtctgattctttctgctgtgcattttggtctcttccactctctctgttctggctctgtgtgacccttgctctcttaatagcctctgttcttgcctcctttgcaagctatgttaatctatgtatttgctgcccactgtaagtgggcatggactagaatgaaggatggtgtatctgcgtgggaggaagtaggtatctggagggctggatgactggtttgaggtcactttacactctgtgttttgatccaggcaactgattgtaaattaaagtcactcaattgaaagggggaattcattataaggacacagagctgcctcacagaaatccagggaaagctacaacgcctggcttcagaaagggaggaactggagcatttttgttgatctctgcagcaataattcagagtttcaccccagttttctacaatgaataaaatttatctatactcctcatgtcttctggtttttgtcctttgtccttttactaacatagtctcttatgtcattctaaattcccactggggccatctgatctttttttttttttaaaccaggtcaaagttatggtcaggccagagatagctacctttcaggtcagggaacagcacttggtcccatcacctggaagggcatggcctcatgcctgcacaggcttgcaaaggaagtgggttcattgcaaaggtgtgggcatgccaggcacacagagcatgtcttatcacatggccaggggccatgaggcctgccacactgaggtggacctgattgttcagtcacactgcatatttgtcatgggggatggggacacccccaaagtatgcaaatgcctgaactgtgattttaaggaaaatgcaaaatcatgaagtctgacattttcgggaacttttcccacatttgctttagcctttcatttccttaaacccattgaaacaccctcctttaatattggattaagaaaatgcagcaagcacatacctgttgctaacacactgaataaagcatgaaaaaaagcagaagcagaagattatatttcagagattgtgattattacatttatggacttagagatgaaagataacaatcagataataaaatttgtcctaaataggaaccccagaatacatgtgtcagagccagaaggagctcatgggtcagtaccaaagccaataccattatcgattccctgaagtccgaattaatagcacacaggatttaggaaactgtggtcaagatagatattagcaaaatgtgattcctgtggaccagggagacagaagcctttattacccacagagatgcagctttcaatttcacactgctgtaattttaacagcctggagctgctcagacctgaaaatactgtcagccttatacccaccctatagatttggatattctcctccaaaaagaaattgttccttttgtacttaaagtagtgcaaaatcagatttttgcaaaaatacattgttttccatccttgttcatttatggctacctcgaacatatttttcactaaaaataaacttgaattttgaactaaaattgttaatagaaatagaaaatgcatagctttttagatcaccccaaattgagtatctttgggggccgagtctgaaggctgcttctgaatttaaacatctcctgtctgaagcagacattactaaatgtctcatactgaaatcactctacattacacctctcacaaaaccttattacttccaaattcaaactcttgttaaaatttgcatcactccagtagttatatatcagtaggaacactggcaatgttgagtgattttaaggtaattgaagcatatttattttaataggcattgtaatctggcaggcagtgaagcaaacacaggaatattgtagcaaatagggatactgaatggctcatcatcaagaatacaataatcaaacgcattaaagacacacagtgaaaaccaggtgtgaggctctagggaagcctctcaggacatagcgcagacccctatggctgtggaggcttcagagcagggtgaccgggaacatgagctctgcatcccggctccttggccctgcctttaatacctgtgtgttcaatgggcaagggcatcagctgccacactagtttcctgtggccgccataacaaattatacaaactgggtggcttgaaacaataacaacttattctttcacagctcaggaggccagaagtataaaatgaaggattggcagggttggttgctggagcctctgagggagaatctgttccatgctttgctcccaccttctaaggctgctggcagtcctggtgctcgttggcatcacccagtctctgtctccatcctcacatggccttctcctctgtacctgtgttctctcctcttcgaataatgattctggccattggatttagggcccaccctgatccagcgtgatctcagcttcatcctgacactaattacatctgcaaaaaccctattttcaaataaggttactttctaaggttcctggtggacatgaattttgagaggatcatgattcaaaccactacagttgcctcaaatgtaaaatatggatgcaaaaaatatctgcctcgtaggttgttgaaatgtagcacttaatgaaaataaagtgcttagaacagtatttggtatgttgtaagcagtgtatgtgttttaactattgtattagtaagttaaaagatcacactacataaatatgtttgtttttatttggcaaagaatcatttgcaggtatgtttacaagaacattacctttccccaccacaccaactgtctccctacctccctctccttgacctacaaactatccacctttaacaaaaaagagagttcagacctgaaggcaaagcttggcatgaaatgacgctgcagcaatagaaaggaaaatgtaagccaaaccagtgcccagcctgatcctgggtgatagaggacagagaatctgtcaaaaaagcccatgactgctgggtgccaagttacaaattggcaagctttgttgggcctagataaccaactcactttaattaaattgcctctgattgagctttgggccatgatttttcatactgagtttggctctgtggtgagccagctcaggcctctctgcattaaattgttcagaggtgtctttatctgaccatatttagaaccccaaagcttgccttgttccaggcctgcttggctggtgtagtcatcacacctggtttgcactgatcctaaagtgtaacatgttcccagcctacaggctcagggtggcccttgcaggacacagtgagtcagggcaggtggagaaaaataaacaccagtgtggaactaatgaggttcaggtgggagccaaagaagcccagatcctggcaaaacaaagagaggtgagtgatgctttgctgccttttttcttctccttacctttgaatggaaaatggtattaaagggaggcctcatgaggctgcatacagtccagccctggcctggatctccagtggttcctggccttgtacctcctggtctgcatgaaggagcatttcatgcctcagagataatcgattcaacctgactccagtgcaatccaggtgaggctgagacctttccaaatgcaggtgtgaagggaatcacctgtgcttgcttcccagaggaaaaacagtcaagaggctggcccacagagctgtccttagtggactccctgccatcaaatgctgcatgaccgataaacctccccctgaagccatgggtgaccagactcaattgtctaaagtcaattcagcacccttgatagacctctgtcatcacacctgccccagtcaggccctctaccctcctgcatctctcgccccagctcctccccatttcctgagcaacaggcccttttctcctgtttctctttgaatgtgtcttccccacatctcacctgaaatattgctatttgtcttctgagaagccaggccacgttttcatgccttggagagggagccaaggaaaaggctggagggaaaccaagccactttgacccaccttgtctggactctctctccctctttctggtgttttcagtcactattcctaccatctcatttaattatcatggtcttcaaaaccttctggcaagctatcatctatttattgttgaaaagcgggaaatgaatttctcccatgtcccctctggttgtgcttcttcttcaaggtctagttcaattgttcctctgatttgaagtcgacttccactctctaaggcagaggtagttttagtttcctcctctgagtccacataactttatagaaaactttgtgatcatatatcactctccttcgcggagatgaattccttggggaggtgagtgggtgcaacagagaatacagttgacctttaaaaaacatgagggttaggggcatcaaccccccacaaagtcaaaaattcacatgtatcatttgcctccccaaaaacttaaatagcttactgttgattagaagccttaccaataacataaacagtggattaacatataatttgtacattgtatgtattatatactgtattcttacaataaagtcagttagagaaaagataatgttactaagaaaatcatacagaagagaaaatatacttgctattcattgagtggaagtggattatcataaagttcttcatgctcattatcttatcttgagaaggtgaaggaagaggagggtctcaggggtggcagaggcagaagaaatccacatataaattgacccatgcagttcaagcacatgttgttcaaggatcaacttctgcatatctccactactttcacatcttgattatgagcagagggtctaatgtatagtagaagaactaatacaaggactaaaggggatgaacactgtgtgatgaacatgatatttgttaattgattttatcctgatgtagtatgtgaaaatccatcaagtataaaagacataatcatttcattttctgttacttcacctgatttatgactgactccttgtgcttctagactggtggaaaattagcctgtcaccatctgtcttctcccctcctccatccccagggtagtgcctagctgaagagcttaggtaagaaaaaaaaggaagagggaaagagacagaaagagagagaaagaaggaaggaaggaaggaaaaaaagaaaagaaacaaacagaagtcttggtcacacatttcctctgagacagtgatataaaaaaaataagatttgaaggagctggagatgaaaatgagaattaatttgtaggcaaagcaaccccaaagtacaatagcataaatagacatttatctctctctctctctctcataacacaatccaaaagtagataggccacccagccacatgtacagctatgcgccaagaggccaatgataccattctaagcatgcagctttcatctctaggcccaaggctgctggtttagctgcaccatcttccagccagcagggagagggaagcagaattcaggaaaagcatggctaagtggaagtggatcatcataaaggtgttcatccttatcctcttgtttgagtaggctgaggaggaggaggaaaaggaaggttggtcttgctgtcttaggtggcagaggcagaagaaaatccagatataattgacctatatagttcaaacccttgttgttcaagggtcacctatatatgccaggaggggtcaaagcccctgacctggagttacacataccctaaacctgatctggagttacacataccatttttgcccacttccctgtgccctcatctaaatatggccacacctagctgcaagagaggctgggatgtagggacaggagccagccaccaactgcccagcgaaaacccaggaggaagtgcagttctgttattaaaaggagaaggagagaattaaaagtgggtcccagtcagcagtctgccacatacagagaaaaattaaaacaacataaattaaaacctcaaatttcatccatccatgttagcaacaaagtgattcttattttaataagtgaggttcagaaacatgaataatttatctaggttcatataggtagtaaataagtaaatggtggagttacaactcagttctctatctatctgactttaaaacctatgcatttcccctaaactccactagttgctgacacattttattcacacatgagtgaataaaatttaagttcatctttccatttccctggttaactggcaggttttattttttcatattaacccatataaaaaactgtaataatttgggctctgttttaacatcctttgttctccacaatgatttaatttattgttgcagtgatgtttgagatatcaataaatttttaggatattggaacctggaaaacactattagcttcaccattctgtgttaggtagagatgtcatgaatttgtgtcactttatacatgaagtatcttgttgtttggtcacgggtgatagctcaaattgtgttcagatagaaaaggaaggcaacagatcaatatcaataaagcctgtgctcaaccatatgatacttttttatatgcaaaagacatactgcctgcagcccagagcaatttagaaatgcctcttgctcactgaaaaccaagtagcatctttgcactgacttttaagctctggagaataggaacatgtctttgtctgcataacttactgcactaccttttgtctctgtgccactctccttctgctgccccacctggcttctgttgaattgattgtgttcctcttcccctctcagcctttctatatagacattcttctaatattctgccctgtaactgttctcatgtgaggtgttcccattcactcccatttctacaataatttggaaaaataaccaagtttatacatctggtcatgacccttcttggtatattataatcatctcttgacatcccttcttcaattattcaacccaaattcccattccatcccgcagctttcaaaagtggcctcctacacaccagttgcatggtagttgatacttcaaggcagctcttgagaaggagaactcttgcaaaccatttcctcaaagtgcttcttattcacacttgacctaatggtctctccccagacctcagcaccctctgccaccaccaggctgaactaagtaccctgcttctgtgagtgtgtatatctacctatatctgtatcagtgaacctagagtatatcactgtgtgcatgtttctgtctacctgctaaactgttaagatttttaaggcaggggtcatgttcttgtccccagcatctggcacagtgcctgaaacatagttgatgtgcaggcaactttgaactgaattaatcatatccttttctaacaatgaattctcacaagccagccaattagaatacatttatgaaatgccccaaatagtaaaaggatatatttatttaaaaaaatataaaaacacagatcaaatacataagaagctaaatgaaagatattagacatcaaagctaacattcaagtactaaacaacctatatgttctaagatatatagtccatgtgtttttaaaaaaatacatttacagacataatgctgaaggactttgtcacttatattgatgaattacgggacagtttaactagcatctgaaggagtatctgaacctgacatggcagagagataggaaaggctcaagagccagagagaacatgatcaagtggaatgggagattaaaactttagttttccaggaatcatttgagcctcattatcctacagaggacaatacggaaaataaaccttattttccccacaaggagcatgagcctataaggaatattagtagattccagggcacacaggcaagggaatagcctcacatctctggaagtccattgctaaaaaaagagagagaaagagcttttcataagtaaattatcatttcacaagataacatactaactttatggccgtgacattttccaagatacatgtgactcatgtgactcagaaatgaagaaatgattgagttgcacatggtgaggaaagcaactccaatatgagagaccgtccttatttccagtgttatactctggtttgtaggaaaggtaaggtattctggaaaccatctgaagaggactacttggccctgtcttataacagatgacttcacatggtaatcagactgagtcttcagccagcagggccaagcagcctgtctattttaagaataaaggcttcaaactttctgtgctcacatctactttaaaaaaagaaaccttcaaaactagtgtatttgactttgcttaacctcagacatttgagtgcacagtagattttttattcctagcccatcaagtgtttgttattggaactttcaacccgtgcattcatggactcagtcatttattctttcaacaataatttattgagcaacttgtatattcctgtttctcttccctcatagatccctatcctcatgaaacactcagtgttttttctgccctacagcaacctttgtggtcctggcattgcagctgttctcacttttctttaagttgcaggagcattttaatcattaaagtgaataagagttattttttaagccctgaaaagctagactttctctgtcttcactgcagtccatcagcccaggcacatgaccaatccctggggtattggcctagggactcctgggacagcagtaagtgatgcaaggagccttcagtgtacctggcactgatatgtatgttgtttcctgcctaaaggaggatttctggccttctgataagccaaatttggcttcatacctttttctttccaaatctcaatactagaatttcagggtttcaatcattcccctaggtctccttcattatttctcatatatggcttaaggaatgtgatgtgaatacctttccttcctgcctaccttgatgtttcagatttccagaggtggattttaatctgatgagataatgttcataaagtgcttaacatctaacaggtagtgatactcagtgaatgatatctattagacctagactataataatgatgacaagtgtacagattaaactctgcacataaacctagctctgtgtagcaacagcaagatgacaataataataataataatgttatgggtatagctgtgtttataaatctgtacatgctaaacttttagttattatttcttcttgaaatgtaaataattttaaaataataaacccttttattctgaatggtttaagtgccagaagattttacctatgaatgcagctcatattcattcatatattcactattaaataaatacttgcctcattcctgcttcccctcaacttaatcacatctgaatcttttttagtcccccataaggtttcaaaagctttgttcttgtcctgattagcatgtgtttcttcagagacaccactttggagtggaagtcagcaccagcatctccttggcaatcttctctcctgacagtgtaatttaaggttatgagtacaaagggtctggtgggaacccgtctacagcagccttatctcagctccatccctgccacatcagcgtttatcatcttcctgagtctctgagggagacagactggaactcaggatttggatcacctgtgacaaaggaaatgcgaggaggtaacaaggcactgcaagaaggaagcatagacaagattctgaatcactttgttcaaaattggatatagagtaaataacagtattttaagatgtttgctaaaaatcaagtaaatgcaaacagaataattgatgagatgccattatcactttcaaaatggcatcgattaaaaaaataagcactcagaaggttggtgagtgggcaacagaagggacgtgtgcccaccccacagcgggatgttgagttagcccctggctttagaaggcagttggcagggagccgcagaggaggcatgtgtgcagagctacgtctcggatctagtctgcgggcattaccagagatgtgtccagagagttctacagagagctgtctgttacatgagggaaactatgatgtgaagtttttaaaagtccaaaaataagaagtggatcagataaataatggcacatctgagtcgtgtaaactatgaaatcaccaaagtcatgtttaataaaactaatacctgggggtaaagcaacttataagacaataggcctatttttgttgtattccttttttcactacatttattttttagagcagttttatgttcacagcaaaattgaagagcaagtacagaggtttcccatataccatctacccctgcacatgcacagcctccccacttatcaacatcctccagaggaatacatttgttacagttgactaacctgaattgacacatcattatcacccagagtccatagtttaccttaggttcactcttcgtggtgtacattgttctggtttggacaaatgtacaatgccatgtatccaccattgtagtatcttacagaatagtctcactgcctaaaaatcctctgtgctctacccattcatccttccctcccttgaaaaccactgatctctttatagtctccacagttttgcctttttcagtattttacaggatgtaaccttttcagattggctttctttaactattaatatgcatctaagtttcctccccatcttttcatcggttgcttccaagttttagcaattatgaatagagctgctataaacatctgtgtacaagtttttgtgtggacataagttttcaattcatttcggtaaataccaaggaactcaattgctgggccgttggtgagagtgtgcttagccttgtaaaaaactaccaaactatcttccaaagtggctttaacattttgcattcccaccagcaataaatgagagttcctgttgctcaatatgtgcattttaattgcaattctgtaaggctctagagagaagtaggcaaagtccaggccctgcagtcaaaaaacttgagttccagacacagctctgccaagggacaactggaagaggaaggtgacggtcggatctccctgcatggtagcgatgaaggataacctagacagtgcgtgcaagtgcattcacagcacctgccgcacacaataaacactaaataaacacaacagtaattattctatgtgcgtgtgcatgctcatttaggaaaaagtagtcagtggctacttttgaaaaaaccaaatatccaatattctggttcttatttttcttctttgagtattttatagctttttagacatttttattttaggttcaggggaacatgtgcaggtatgttatacaggtaaattgtatgtcacaggggcttagtatacagattatttcatcatgcaggtaataagcttagtaacagataagtagtttttctatcctctccctcctctcaccctccagcctcaagtagaccccatgtctcttgttcctttctttgtgtctacgtgtactcaatgtttagctgccacttataagcgagaacatgtggtatttggttttctgttactgcgttagttcactcaggataatggcctccagctccatccatgttgctgcataggacatgatcacattcttttttatggctgtgtagcattccatggtgtatatgtaccacatttcctttattcagtctaccattgatgggcatttaggttaattctatgtttttgctattgtgaatagtactgtgatgaacatacatgtgcatgtgtctttatggtagaaatatttatattcctttgcgtatatacctaataatgggattgctggatcaaatggtagttctgttttaagttgtttgagaaatcgacactgctttccataatggcagaactaatgtacattccaccagcagtgtataagcattcccttttctccgcaatcacaccagcatctgttattttttgactttttaataatatccattctgactgatgtgagatgacatcacattgtggttttgattttcatttgtctaatgatagtgatgttgagcattttttcatatgctcgctggctgcatgtatatcttcttttgaaaagtgtctgttcatgtcctttgccaacatttttttttttttttttttttgagatagagtctcactgttgtcgcctgggctggagtgtaatagcgcgatcttggctcactgcaatctctgcctcccgggttccagcaattctcctgcctcagcctcctgagtagctgagattataggcacctgccaccatgcctggctaatttttatattttttagtagagattttatatttttcaccatgttggcaaggctggtctcgaactcctgacctcagatgatccacccacctcagcctcccaaagtgctgggattacaggcatgagccaccatgcccggccctttgcctactttttaatgggcttgttttttgcttgctagttggtttaagttcctcatagattctggtattagacctttgatggatgcatagtttgcaaaaattttctcacattctgtaggttgtttactctgtttcttttgctgtgcagaagctcattcatattctttttgtagcgggggaaaattacatatatatttaataatcctatattaatataatatgtatatttaaataatcctactgtgtggtatagcagcttaaataaagggtccatacctttccctgctaactgtctctggctctcacataatctttagctcactgattgcatcgctgttttctttgctgtcctcttttccctggtcttgttgcctgtatagtatctctacttggatgtcaaacttgccaagtgcaaagcagaattcttaaattttccacagaagcctgctgctccaagagtctccccatgtcagtgaggaactgaggacccctgttagaatcagtctgagagttttgatgtctttgattccaatctgtctctcacttcacattcaacccatcatcagctccagttaactgtgtcttagaaatgcctcccaatgtaggctgggtgccatggctcatgctggtaatcccaccactttaggaggctgaggtgggtggattacttgaagccaggagttcaagaccaacttgggcaacatggcaaaaccctgtctctactaaataaataaataaataaaattagctgggcgtggtggcgcatgcctgtaatcccagctattcaggaggctgaggcacaagaaccgcttgaacccaggaggcagagattgcagtgagccaagattgtgtcactgaactatagcctgggtgacagagtgagactctgtccttctcccctttcatagcctctgcctttgtgtttttatttagggatggtgcctactttgttttttgctgcatccctaacacccaacaccatatcttgtgtatactgctgaattgaagaaatcacaagggtctgaaagaggacttagagcaaagttggtatggataggaatcttctgctcctcagtgcctcaggggcagtggacacaatctgagggcagccactagggaagcatagatagcaaggagagagagagaagagcttatcacaaggcagtatgatgtggcttcaccagtgtatcaccagccagaacataatttggggaaagggattaaagaacatcttggtctcatctatttgtgatcacttgtacctacagacaaattgaatgtactgatcagccatgtcagccgagtggcttatagaacagaaagtttcctcattctaagcccttgaaaatctctcttctacttactaagtatataactaatagcatgcacgttttcctttgtttttcaatctgggatggataaagcagatttctccaaaaactattgagagtcatgggtattctgtaaggttttggggtctcaaaaagaaagaccccattaaagtctttttttttttttagtttactttgaggggctttggattccattttcagcttcatcaatgactcagagtcgttctttgaatcaatcactcaaccttttagccacaaaacttcctcatttgtaacaggagaataatgagagctgccacaggtaagctcccagagagtcgtggagatccctctttattcactgtgctctggatttcttcgaggaaaatccctgggggccggctgagtacagacctgcagaaagagagataagatgtcttagtgtctggagaagtcatgacaaagccaagccaggaggaaaagggaaagacaagtgtactcccttaggaaaccagagctaaggtaaaccatcccaagtattgtttctttttcttcttcttcctcatgttccaatatttttaagccaaagaggagaaattaggttaacatgaatagcagggggagttctgaaagtgaaaatgcacctccaattgtcagatgaagcccaaggttccagtggtaagtgtgggcaggaagacggagaagctatgagctggaaagtttcctataatcatctaggagaaggcccctttttcctgccccttaaactgcctcccaaattgcctgacctcagctttgctataggacttcttaaaggaattattttaaattatttaatagactttatatgacattggttttcaaagtacttgtataaacattagctcttttgatttttacaaatccttattttgagcaaaaccatcgtcatcatcattaatttaccaataaagaaactgagttttagagggattaaatgacttatttgagcccatatgaccaacaggtgatatagccaatagaaagctggatcttacaactatgagtcctatattctcttgatacaaaaaatgttgctaaacatgcagggagatggtgcttgaactcccgagtcaccttcatgatctcattccctttcttgacattttctgccagacttaagatctggtttcttctgcagttcacaattacaatcacagtgctttatcctttctcttacgagttccagagccctactgggctactctttcagtaaccagtacagaaccacttacattattaattttaatttttctttttctttctttctttctttctttttttttttttttttttgagacagagtcttgctctgtctccaggctggagtgcagtggcacagtctcggctcactgcaacctctgcctcccaggttcaagcaattctcctgcctcagcctcctaagtaactgggactacaggtgcgtgccactacacccagctaattttttgtatttttagtagagatggggtttcattgtgttagccaggatggtctcgatctcctgacctcgtgatccacccaccttgacctcccaaagtgctgggattacaggcgtgagccaccatgcccagcctattttttcttattcacccccaccaaagatccaatggagagaggctggaagcctcttcctggaacatttatcattcatcacaaggaacccagtttctaataatatttttagtttctttttcataggcatacaatactatataggctttctaaatagctgattcatccccaccaaagtgcattcatcctctgttctgtaatttagtttctgccatttgacattcatgcaagcatgtaattgcctctacctgcatcatagctcagcattagcagacgtgtaagccaagtctgaaagtcagattgcattacacacagcttgtacctccatgtttctcagtcagtgataaatattttatcatatatcaaaacaatacgtaacactagtagtgtttatacagggccttgtgtttataaatggcccttctacttctcaaagtactcatatattcactctgcttcatttatcttcagaggttttctaactttttttttgcatgtttcatagggccacatgaatgtaaataatgtaaatattcttatataagcagatttatgtttcagcatattttcaaacttaatattctttcatgtaagttaaactttttttttctgtatttctcggcttttccctgtctggggtctcctgcctgcaggctggagtctcagagtgtcccagggcaatgtgacatcccgtagacttgtgacttgtttttttccttattctacttcactgtcatgtctcagtggagacataaagacgggccttctgggaccttgatttggcaaaggaagatggaatcctcaccatctatccttcgcagattcctttggcagaatttctctctctttctctctgtagtcaattcattaacaatttttgttgatctttaagtatggttcctaagtcatggttaaaacaggcaatatccctgctttcatgaagttcttattctggtcagatactgtttggctatagcaaaatgaagccctctcaaagcaacttaagcaaaaaaagatcattgttgaaaggggtatttcctgcaattcaaggacacgaatataaacagtactcatgaagagctaaaacctgaaattgggaagtcactggagacaaagcaatgactctctcgccctctgctccttttgctggagccacctggggtttatgtcttctcttttggagggtgtttagcaacatcagtctcctttctgtagacgctttatctactcaagttacaaggtcaatatagttgcctaggctcaacttcatgtgacctcctagtcgaatctgaattgccagttctcatgatcgaccctgtccacccaatgggttgactcccttttcatcaggagttcatccctgggccaagtgcatggtgctgcttacatgctttatggatttacggtttcaaattgtcattcaagttttaagctttggaaactttctagtaatagattatgttctttccagttgtttggcagctccatcaaatgcagcatcagttgaagatgcaccaaaaaatattcacaaagacctatgtaaaggtcaattagaaagattttgttttcaataagccaatgaggtagccatactcaaatttagagtcttatttaggattgtctagtattctgtggaattaatgtgtcaactcttgtcattcttacttcacatccatattgactactttcatttatatagagaattacacagtgttaaatagcaccatttgatttgcggtactctaatgtataagaatgtgagtaggaaactgaaacttcagtaaccaggaaactacttacttatttttttttagtgccctgtgaagcacagaaattatctgaaaaattaagtgtacatcttttttcctagcattaggaagttgtgtcagccttttcttatccactaaaatcttaatggaatttaagctaatatacattgttcaaagtcatttgtaagttttataattctttcaggaaaaggatcttaggttcctgatggtttcactagaaagttgctatggcttcctaagaagtgaacttccgagacagctaaaggatagctttaagtgaatctaagaacacattttcttttcaaaagggctgcagcaggtcagtttccaaatataaagtcaaaattatcaaattatctctcttctgacaataacataatagaatgaagcacatttattgtaaagaagcccatagatcctcagaaatatctaaaaaagcaggtcatacagtgctcctttgatttatttacttattttttacattctagctctggctgccctgattctggacctttggatgtctaatttagggcttcataagaggcttttctctaagggagctggctgtgttccctaactcctacaaggacatttggaatcaccttgtgtggtcctgacccatgcttctcatttcagctcatcctgtacatcctacctggcctaactggctgtgaactctcctgaattaataagatatttaatagaggcaattttgccatttgcactttctaatatctaagacattctttggctgctcatcatcttatttgaaatggaaaaaaatgtactagcaactgtgaatgtcaattttagaatgttcaattaaaatagaagtgaagacaacacttaaaatatactaggaaatttactcatactttttgaataattcaaataatcaatgattctttaccttaaaaccatggaaaaccctgttgttaggcacttagacagcaaattggtgttagaccattttcagtggtcaacataattcatccttatctatgggagaaccatgtattcacagaatacacacaatttataaagcacactttgagagtgctaggaatccaacagggacgaagtacaccctcaagaagctgtaggtataggtgtacgtatagatatatgtgtggtataggtatagtataggcataggcgtagacgtaagtacagttacaggtgtagtgtagatataggtgtatgtgtaggtatagatatgcgtgtaggtgtatatttaagtatcggtgtaggtgtaggtataatagaggtaaggtatagacattggcataggtaagaatacagtccttttctgtaacctgtttttaccaatgttattacttttcaggtgtcatccagaactatgaaaatcgcccacattcatttaaggtcaagattaacggagtcagagacagctttcagctgctgaattttagaggagttgctgaatttcaaattgcatataagtggcagttggctcttttgcaggtttatataaaattttgtctgctgccactgcctgcctattaactttttttaaacataaagaccattgaaagataattagttatgtgactgggatagaatgggtcctatagatccatatagctttggaaaatagtaagtagctatttcctatgaaagatttggaagcttaatgaataaaaatatccagaattttttttaagtcaaaactctaaatctctaaaccatgaaggaagttcatttccttttaagacagtaggtgtggaggatcataatgaacatgaagttgtgattctaataccgttgtcgcttatgcctcttttgaaatacagtaatgagatagcattcattttgctttatgactccgcaaatgtttggcttgagccaccagtgaaacactatgccaacataatttatcggtctctaaaacaaatacattaaccttttcattctcaagcctgccttactctaatatctggtaactttttatcatgcatttgttttatttgtcattattggccaagatagcaattgtttcacagcatattatactgactggccaatcccatgagtaccagagcatttgtatttctacagaagtatcagtttcttctcaaatggaaaatgcttatttgtcccaccttggattagaatggataaagctttgtaaaaatgttattcaccctccaatggatttaaattatgtgcatttgtagaaaacttctctaaccagattcagtgtgtcccaatggtttaagaaagagggtttttcagggtggcagcaactgtatactaagcataagaaaagcaaaatttgtctatgatgtcttcatttcagttagattcttgccatcaagttgggcaagtctgctgaaacctcctatttaaaaaatgcagatgtgaaactgtataaaccattgccttttatctcctaaaattgaaggatctcaaacatgtacactgagaggcaaggactatttttgttttattgtgtattttgactgcctgctcttggaacaaagcagacacttaaatgtctgctgaatacacgggtagctggctggggaggagggcaaccaacacaagacgccgcccgaccttgattcatttgccatagatgggaaattaggagttggtgcaaataataatctgaaatgcataaaatttgtcagtccacattcttatgcataaactgactcaggttttgctttgacagaactgggccatccccaggatacactgcctcgatggccatatgtaaatgaggacatgcattgtttatgccagaaggtgtgtagtttactgctttctgatgtgtcagtccatgggaaagcctcaaaagaaagagaccctgctcaaagtctgtgaggagctgggacttagcttgattctttgtccagtgggagaggcagaggcagaaggaatggcagagaatgaaggttgatcaaaatcagaaagagtacagaccaaatgagatatgcatgggctatttctggggctcgttgccttcagcttgtcctgccttatgctatattcaggcaggggatggaacatagggaagaaaagtcatcttggcctccagctttccaaaaaccagggagagtaggatatgataccggaaagcacagggagtggaaagaacacaaatcaaatgcatttgcttgattttacctgctttgttgaagagttttgtatgtagaaacagaaactgttttgaaaatggagcatttgggtgatctgaaaattttacttactatgctatgccttttccttccgacgtaaatattctcttccttcctcagctccatggtagtaaaaaaaaaaatatgactaaaacttttcaccaccatggaagccaaatgcaattaaatggcgacatgcctctgtgttgctttcctgatatgcttctttacaaagacgatggatttaataccatttatctacatagatggcagggaagccacacttttttttgtaatcttcatctataatttctactgggtttatttttatagctacaattaaagtggcaatagaataatatccaaccccataatttttccaacgaaccattgtgaaaaatgaaaggctagcagttctgtaatatttcttttccagcactgcatagattgtgtcttgttccaagattcttaccttaaggatttatgatgaactttaatgcaggcagcaagtcacattttatttagagaagatcaaagccaaggaggcaaaggggttattgtttttgtgacagtgttgtggggttcagagctggtctctcacagattatttcatattttcttttcttttttttttttttttttttgagacagggtctcactctgttgcccaggttgggatgcagtggcatgatcatggcttactgcagcctccacctcccatgctcaagcaatcctccctagtagctgggactgtaagtgcacgtcaccatgcctcaggaatttctgtgtttcttgtggaggcagagtttcaccacattgcccagtctggtctcaaactcctgagtgtaagcgcttcacctgcctggccccccaaagtgctggaattataggcgcgagccactgtgcctggcctgtcgcctattttcttgtacaccttgcctctcctctctgtcttgtgcttggtcgtatttttctcttcaacaaatgagagcgcttgctgtagtgaagttgttacattcacatagattaattctttaatcgagcctttcttcttatgttgtgtcaaaaagaaagagagagatatatatagagagagagataaggtatgctctttctgttctcacagcccttctcttccattccaaataagaaaaatgattattcacttgtacggtgctgtgagaatggacctgaacacattttaaacacactgtaactgtttgttccaagcaaataatcactgtatgtaatcctgtcacaattggtgctctcttatccatggcccacggttgtcatggattgggcgtgtggcagttcagagagtacaggataaagcacaaacttcaagtgcttttctttttctaggcaaaatctataaatgacctttttcagtgtcttgctaaacaatctcatggaactcgtgatcctttttttgactagaaaggaatgttcacggtttgataaaggaagcgtcgatctcagaactgcacctagacagtctcgttcctgatgctagaaaggcactgagcagagggtcaggttgtgcctggaggctggggaacgatatgccaaactgttcggggaaccctagaaccgcatgctctctagagtcagcctgtcatttcacctccccacatgcagtggcctctgcctcagggaatgaagcccaggctcaacctgatttcccacaggttcgaactgacttatttgtgggttaaaaacttcctgactaccaaagactcctctttctatttctccccactggcccccaatattgaaagattttgtctactcatgaattatattctgaaatcatgatacactttccctgttagcggatgtcatgcacgacaaccaagctgatgctttccggatgctatgaaagaatcagcattgccacacccagtgcaccgaatttaagctaaagccaagcaaaacaaataggcttttaattattctgcacaacttccttgagtatcagtgcaaaatttccagtaaatacctgtatgtctccacaattacattcatgagctttttagagaaaactcttatctatgaacatgttctcttttctggctctggatggtagagtgcctggggtttggaaatctgtcagacctgacttagaattttactagcggtgtggccttagataagttattttacttctcagagcctacagtcagaaataaagaaaaaacatagaaagtgcctacaacagtatacaatgaggagtcaatgaatgcagtattttaaaaattaggtacttactgtctgctagctatcatcataatttcccacacaatttccagcatttatcccaataactttttattttcatccaattaccaaattaatataataaataatttattgtgaatttcatgaaggcgaagactgggtcttttgtctttggattctcagcacttagagtgatgcttaggcataaagaaagtgatcagggtatgcttagtgtataaatgaacaaccaaatctaaaaactgatgttaaataataataattatatttatatatctgcacacatacaaatgtacaagaattgtaattaaacataaaagtaagcccctcgagaaaaactacacaaataggagacagttaaccttaagagattagcaaggagctctttgtttaagtttgtgaagtcataaattacatgagctgtgatagacaaattgcctgtggtcagagctggtgcgatacaaatgagtgtccgttgtctgccaggcagagttgtaggtgctgaagatggtagacaaagggtatgtttcctgcccataatgagcttacagaagaatagtacaagagacacatcgtccaatcattccaacagagggagatttgtgcaatgatagaggtgtgtctaggatgccggggtgcgtcaagccctggagtagaaaagggatgccccttttctaggggttgtatctaggcagagttaaaaggattaatagctcaggggagctgaaggatgagctgaggctgaggaaggcagggtaaaagtattccaggaaaaggatacttcacaaaattaggtggagacttcatagagtcttatgttgctagaaggtaaagtgtgaggctgagaatgaaggaagttgagactgaggacttgggtcttatggatcttattgaagaacttgaactttattctgaactttcactggtaccttgaaaaaatttaaaccaaagaatggcatggccagattgcattttgtatgaatccccttggtggctgtatggagaatggatttgagaaagatgagactgggttctgggaaactattcagtggctgcatttgcaattagtccaggaaactggaaaccaaggcattgaagttgggatggaaaggagatagtaatttgggaaacatttaggaaacaatatcagcagaagttggtaattaatgggatgttagagttgagctgagggaagagtctaagttcttcatttgcatgactagatgtaagggtattttctccattgagagagagaatgctgatggaggaatgggatttcagaggtagggggatgaggcaagtctgagatgcctactaaatgctaaaggtggtggagctgaaacctcaaaggtaagatttaaaatagagtctcagtcaggtcatctgcacctggaagatgagaagttttacttctgagatggttctgtggcataaaccacgcctgggttgacatggtgtcttagtccatttggctgtataacaaaatttcttaggctgggtaacgcataaataacagaaatatattgctcacacttctggaggctgggaagttcaaaatcaagggtccagcagatgtggtgtctggtgagggcccattcttcataaatggcacctacttgctgcatcctttccacctcttttgtaagggtactgatcccattcatgagggtggagccctcctgacttaatcactcccaaagccttcatctcttaataccatcacattgcgtattaggttccaacataggaattttgggggaacaccaacattcagaccatgcacacagcttcataatgtaaggaggaagctgatccaaacaggagcagattaaagcccatatatagcttcattacatattctaaggcttccttaagaattagacagagtcaactcacgaagtctgaaataaaggacagggcatcaagtgagttcatataataaatatatatccacagttgaaaatttaaaaatagatatttctaaagagaaagatggaggcagaaatgaaaaaagagagcagagtggaggagaaagagaagaaagagcaattcagagagaggaagggacgaggggagaaaatgagagagagagagagagaaagagagagaaagggcatgtacttaagagaagaaaaagagttcctgctcctgggaatttcaaagcaatcctggccactcatctgcaatctggaatgaaaaccctatagcagtatgtttcctttctgctttaagttcaaaaacttaaacttttatgcaaatatatgcagaatcaatattatatgtgtatactaaatactcatgggtttgcattttaaactttcaggagtatgtttagttatgtgacactttattaatattgaactgatactgtggcttttcactctcaaataaaggaaacacatttccagggtttgaaaagaggaaaacgattgatttttgcattccggtgttttctatgagcccctccaacatctaaaatgtatctcaggtcatatttgttttcttcatacacaaattctgttctctcctctgaggttgcctttctgttggcttcttcctgcccccagtgggaatccagcaggagccacacaagatgaaacagtcagtgaaatagctcagaccgtgggctctggactggattccagccccagtgctgagtcctgagctggtgaccccaggcacctcatctaacagctgtgtctcagttatgttactgaaaaaaacagggtacctatgactggtgagcaacaaacaactctccatgagaatgcaggttttgctcagtggttttattacttggcacaaggaagggggacactgggtatatcctccaaagcagtgtcttcccgagggaaagcgacagacaggttttacagagcaatggggagggaagagaggtttgggtgcatcctcacgtgtagaggaggagcccagttgctcagatgcagtgagtgattaggcctgcacatggatcacagggaggctttagcaaggtaaagaggaacgttcacttgggttcatctataaattgctggggtctgtcagaagctgtttctaaaaccactgcatgacagaaggctgtaaaacaggctgattgctcaagtcaattaaattcctataatccctggagaccctccctgccttcctacagttatgagaaacctaaagcgggaatgacatcaatgtccacctcacagagctgtccggtgaaatgggaaaaatttcagcaaagcacttagtctgatgtctggtaatgggtcaacactccatactgagcaatcattattattatttaaacagatttgattattttttaattaaaagcatcatcatttaatagcttgctaatgatcatttgtattgttattcttatttaaggattaaatctgcactcccgtggggcataggcctctagcattgctgtcacttccttgctgtcccctccaagccccaaactcaaaagttcaggacctgtggccccagaaagagaatgtgcagccaccggggagttggaaaagctgggcaaaaccaagattggttttaggatcttctcagatttaagaatactccttcttttggatggatggtggcttgaatgtcttcatcacaagagactgaatttcaggacacagaagaaagacaggctcaaggcaggggaagctcaggcattcgtgtccctgcctgcagggaaaatgcctgggactctttaagccaccatgttctacaacacagtgcatgaggtaagagaaggtgaacttcatactggccaagcactgctgcactgcagatcatagcaccggcatccactgcgcggggacgcacctggggtgggcctcgcagctttagatccatgattctgggttcaggttgttcttgagaatttagccattgtaacccttggcttccgtgtttgtgaaatggtggtgaaattacctagtttgatcatgaagattaaattagataatgtatgtaaaggacttaatatcgggcattaacaaacatgataggaatggcagctactagtgcgatatgagttgatttcgttctcctaccctatgatggatcagttgctgaggtacagagaatgacggagagtgcccaaggttacagcgattgaagaagtggtgaggttggggtttgcccttcgttgtaactgactccagagcccacactccacagctctgagaggctggagtgcatggggaccctcgcttgatgtggggaccctggcttgatgtgcgtgagggtgaagcacattcctggagcagagggaagtgattcatctctcccgaggctcttgcactgtaatgatgtaaattattagccctattgatctacctatctggtcattttatggcacttttcagtggagaaccgaaaggcttatgctaattaatagtcctgaatcctaacagactttattacatttagaaatgggaaattctaattaaacttaatgaatctaatttccttctggcctttattcaaattcactgagacctgccctagccgtcctatctaaaatttccacaccacacactcacccacccacccactgcccctccccaccccttgtgtataaaacttcctgtggctcttctcttctttctgtgttcaccttaacacttatcactatccaggattctctgcaattactcctctatctcacttgctgtctatctcccctactaggtgtacttcatgagggcttgcattttggattttttcactggctgtatcatcaacacctaaagcagtaccaggcacagtgggcgcttaaagaatacttgcagaatatatggacaaatgaatccctattctttcccctacagctgttcactctttaacctgactctctcagagatccaaaattctccagctagttgaactacctccccttttttataatttgcttctaaaatccctcatggtgtttcatttctgttccatcacctattgtgacctcaattaaacaagtaaatagacaaaatggatctgtttgccctagaggtattgaattgatttctatgaaaggtatggaaaaggctatttagtatttccaccaccctactgaagcagtattgttgtctggtgtaaatatccgaggttcgttgcctcacgccaaggaaatcaaggacatggacacacatggagtgaggtttagagtgcaggtttactaggcaaaagaaaaagaaaaaaagagaatagctcactctcttgtgagagagaggggcctgcaagtgggtcttccagctggtggcggagtgcacagggttttatagacaggcttgaggaggtggtgtctgatttacacagggcccaaagattggttggaccaggtgtcacatttgcatagtgcatagggaagctggccaccccaccctaattttattatgcaaatgaaatctttgcctgactggtgccatgtagtctgctccagactgcacatgtggttggcaaggaaaagggaagatggagccgccattttgaacatgcctggtcccaggtagccttttcctattggcacagctgccagcattcacctgtgcaagcttctagcttgtctatgtctgcagcttgattttacaggctgctccttgttagaaaagaaaatgatttgggggctgcttttcattaaaagcaaaactttatcaaggacttccttaccctcacaatctgtctaaataatttcttcttaactcctatatcactacctgggaaggtgagatgttaggggaaccatattttattaaagggaagaaaaggagaggaaagaagacacacagaagaaaaattagtagactaggaatcagggtgcctgggttctaatgctggcagttgctaatcacgtgaccttgggaaagcattgaacctttccagaactaagcttcctcttctggaaaagaaatgggtcagacaagatacccccaaattcttcaaagacctaatatcctagacctagccatatatagatctaactagctctaacattctgtgactcaagataacttaaaatatgttttctaacatcagaaacactttcagatcttagtttatgctatggtttttaaaaatattattttcttttcttgggtgtaagcattgatccaacaaggtttaggtcaaagatctttcattttgaattcctttgcgcccaagccaacccatcattttttgaagagtaatagaaacaaaactgtcaggattttcaaaattgatggaaggtggcctttggcagtcttttgaatttgctctctaggctcatgcaaaacatgcaaaataaagcttcaagctttctttgaaaatgaaattggtttgaaactaatagggatttggaaacagacagctgagcagatttccttctgtaaatatcacgtgagttctccatggggcatggaaattcgaggaatttaaaaatagtctttggtcattaatagatcgaagtgttacttctggaatatgagaaggtgatattaagttctcatctaagaaagaaaagggaagatttggcttttttttttaaaaaaaagtatattcatataaagtatctttttgtagactgtaagcagtatctttatccacgtcctggaagagagatggttattaatcttaataaaatgagaggtcatgagagcattaagttgagaaatttcaatgaataaggttgagacgaacttttcccagatatcatctgaaaactgccttagataagttttaaaatgagtctgactttgcataataatggagaatatagatgtaaatattttatggacattaacaaataggtaggatattgataaattaattctttaatgaaacatgttaagtataatggctctgacatttattaagtaccttctgtgaactagttatttatataaattgccagaattaatccacgtaacaaacgtgtgagggagatatgatttttccattaatcttagaggaaacaggctcagaaagatctgaacatttgcttaagacaaaatatctaataagtggttattatggactgaatgtttgtgtccctgaaaaaattcacatgttgaagccttacccccattgtgatggaattaggaggtgggagacttttggaagtgatgaggtttagttaagggcaggaaggtagagccccagtgatgggattagtgtccttaaagaagataacggaaagatcagagctttctctcacatgcactgaggaaaggccatgtagggacatagtgagaagacaaccgtctgtaaaccagcaagagaggcctctccaggaatcaagtcaaccaggaccttggtcttgaacttcccggcttccagagctgagagaggtaaacgtctcttgtttaagccacacaccctgtggtgctttattattgcagcccaagctgactatgacagtggtagagctggcattagatgcccactcttagatttcaaagtccatgccaacgaggatgtgagatcaagaaactgtcatgggctggaggcgtcccgtaggctagatggatgcaccaaaggattgtggatcactgtggtccacggggcaagagcataatgtggtgaaatcttttcctacaagaatagaaaccctgaaggcagggagataccttcccaagtctctcacttccccacacgccctgcacagcattggcctctgagtcctgcagctttttctctgtccctctgaccaccctgctctttctgcctcagttcagttcagccccctctctccactgggcttcctgccttcagtcttgcccctttagtccatcataacccaggagtgatctccttaaaactcttaaaactagaaatgacttatgttactttcctgctttaaacctttctatggcacatggagtgtcactaccccatgtggggagcattagtgtcccactctaaggagaacgtatggatgtgtgacaccaccgtggccgttgttgccatcacaaggtggtgccaagggctgtaatctgtgccctggtcatggcccatgaggtgaggtcctaagtgcaccccatgttgtcttctttgtgtgatctgatgccattcttctcattctcttccctgcacttttccttagggtcagccagatctggtaagtaggtatgctcttctagggataaaggcagaaataaatacaaaactagagcactcagattttgaagctgaaatagcatgcgtatgtaaataatgcatatttgaagtaatcactgtaatgctatttatagcacaccttttcacccaaggatggcaaaacagtttacaaatattctctttctagtccttactgtattccaatatattgtgctatatgtgcaattttgagctatgaatttctttctttcaccttacaaacaatatctgggtaatttgttgagtcatttaacatagggtcaacacttgggaatcaacgtctttttgaatgcagactaaaacacagcacttggctgaaacaaacgtctgagtactgcagtcatcaagccacactcagggttgcagaaatgcattgaagaacttttagggccacttctcattctcttgattgaaattaggaaaatggtcattgcaggtgtattgaaggccaagggagcctccatacgtgagttgttttaaaggcacatttcttcaccatccagaacaggacccatggctgaggcacagtactccaaagcactacataatgtctcccaaatctcccttgctcatcttactgctgctatgctggcctccttccattactagaatatgctgggcatggtctggactcagggccttggcacctgctgttctcactggctggaggctcttcccctgcatgtcatcccagctccctcctcactccactttggtctaaagcagaatccttaattatccttgcctcccatcaccctgctttctatttctcctttgcctttatcagtatgtggcagattttatgtttattggtttattgtttttctttcttttccataatacacactccatgagaacagaaattttgcctattttgttcactgttgtatctactagtgcctagaacagtgcctgaaacatagaagtccttaggaaatatttgatgtaagcaaatagatgaacaagctgtccctggctaacatctgtagggttactagaacaatcagtatgattattcacaactgtgtttcactggctcttctccagataaactggtaaagtcaatgtctaagccacatttcgtaccttagtatgtgaaactatgaatttccatgaggtttgtaattttaactaagaaatcatgtaaagggaagatactttcatggtttgcaagttgtccttaaggcagaaaccctcacacaaagcaattaattagcatgcagaatagaaaaccctgaattgagaattgcaatgcatcaatatggtcattatacatcattcctcttaatatgatttgtttctgtctacacaaaacatagacagaatgtatattcctatatataacacacatgctttgtatttgcttttgaagacagattgcttttaagacttggggatatatgggaagaatctcagtctttccaaattccaaaccaaaaaagtctcttctagctgctagatgccagatagttctgtctgctacagccaggtttccacaggccatatgcatcatcttaaattatgactttgaagcatttcttttgaccactgtgttcgcaatcatcctaagatgtctgcttgtgtatttttctgcaagccatcttccacccttatcctgtcaaggagaagctattgaagctagtagggtatcactacaagcagatggattttattccagaatcccattcctggtgaagatgcaccatcatcaggaccactagcagtgtcctctctgcagagtgttttccaactggtcaggaaataaagactaggaaatatgtgtctacaactgcttcaaaatgtgcatttgacacatgtctgtttcagggctgaagtcagttttggcttcatgccagctgaaggcaactatgaattattccagaaggttaagatccccatgtggctccaaggctggcctgaaaacgaacccattccaaacttggtccctcagcagtgggatcccgaaggccagagctgggtttggcagatggggtgagtttctcagagacagaagtagggaagataagtagggtgtaaaaaccatgttcaacctaagagtaagaaagggagggggctgggcatagtggctcattcctgtaatcccagcaatttgggaggccaaggcaggaggattgcttgagcctaggagcctaggagcctgggaaaaatagcaagaccctgtctctataaaaattcctggctgggcacgatggctcttgcctgtaatcccagcattttgggggggtcaaggcgggcagatcatgaggtcaagagatcaagaccatcctggtcaacatggtgaaaccatgtctctactaaaaaaaaaaatacaaaaattagctgggtgtggtggcatgcacctgtagtcccagctacttgggaggctgaggcaggagaatcgcttgaacctgggaggcagaggttgcagtgagctgagatcatgccactgcactccagcctggctggagtgaaactccatctcaaaaaataaataaatatataataaaaaatttaaaaattcttaaatataggcatgtagtcccagctacttgagggcctgaggtgggaggattgcttgagcctgggaggttgaggttgcagtgagctatgattgtgtcactgcactccagcctcagtgacagagtgagatcctatctcaagaaaagaaatggaaactttcaagtctgatgattcggtgtgatggggcaacatgggagcaggtatgaggcaaagctgacaaggagtgatgtgagcgcagtacagtggggctttctaggggtatggagcaacccctgtgtttccatggctgcgtcctccagttgcctctgtcttagtgcattgcatggcaccatcctccagctgtctctgtcttagtgcattgcatggcaccccatgggtttgacttaaaggtccacagtcagaatggacacagatttaatctgcgaagagggtaatagagcagaaagagtgcccgtgacatttgctaatgacagcacacagagaaggagaggcatccagcccttttgaaagaagatagaaactcaatatactcgtggaaaagttgaagactagtcagttgcaaccagaatggaatacaagatgtacatggagagggagggaaaagcaacctgttcaagtatgagatcaaaaatgagaggttttgtgattttctggacggcatggctgtgttttgctgttaaagaattaagaaggaagctgagattctgtcttggggcaagaaccagaacagccctctattcctcaccctgagtgtcctgggtggatctgatcctcttaaagagacccctcctctgagtttgtctaatagaaagcagagacaaaaagtgtatatcctgtataaatatcattagcatcgcatgcctgtgggatagagtgcatgttatgtggtggtagtggccaagaggcattacaggacttgtgtcccctaatgatggccaaaatgaattcacgacctctcctcccattatgcaatgacaagatcaaagatcaggtaatattttaataattactggaacaagaaagatggagaaatctgatggggttggtgcaggaagcattttggaagttttagtataaccagagcatgaggatggtgaggatatcaagtaggtgtgggaggtgaaggggagctagcagaaaatcaatggagctaattcagaggcttagacaaaagtgaaatataataaggaatatccaaactagagaaaaaaaaacctatgggttactatatggtgggcatctggtgaccatccagtgttacaaataaactaaattccagtctagtaagtaacatttatgtgacactgttgaggctgtaaagaatgtctgcatataatgtaaactgctttttccagcaaccctgtggagtaagtgtagtgttattatcctcacttcacaggcgaggaagtgagacccagaaaacttaaatgactgtctcaaggccacagaacaggtcttagttggcataatgcacacctagctgctgaaacagacaattcccaaagcaaagggacttattaatagagttgtatgcttgcaatccaccagtaaaattaagtacagcataaggaagaggtttcaggcattaaattgtaaccaaagtgttaagggttgtgatagtttggtgggtttagggttttattcctattatcttttttttcatttttgcaatagagttgcattatttttataatgactataataattttacaattgacaaaagatttataatttgatagaagatcctctgattactctctgaacttaaggatagactcatctaagagcttcttccatcctgcacctcacgtccaattatttcttagacagtagaagtgctctgtaggaagaagagaaatctcataagatgtttgctgacctgctgaatagtttgtggtgatgtataaactgagccaaccctatttctcttttaaatggtgttaatttagaaaaacaagttctggctaagggataaaagaggacatatggaaatgaaagattaagcgattaattgaggagaaaaagctgtgcagttgggctctgtcctatattggatgttcattacgccaactaatggataatatataattatgaaaagacattgtcggaacagcacccaagtctattgattttgccatcatgagtacattatgctctatcttcacgagattaaaacgaatggagagggtaacaagattctctatgaattagagtcattcattttcatttcgagaaagggaagtttgctatattttcagcattttaattgagatctagcagatgagaactttacaaggcaataattttaaacagaatttatttctatcttaacagtaaattggtataatgataccaatgttagtctcaaggtaaaatgttgaagagatttagcaccatagaggaaagacagcttgcaactgatgttgatactgctaattgtgctagccagtctcgtgtattttaatacatggtaggtaaaaatgccgcattacataattaggtttttaaaattcagcagatatttactacatatctaccaaaagcaaggccctattttataggtaataaaaagaattttagtatatgttccttcccttcaaaaaagatagttaggaagacaattaataataataatagcaacagcatcaacgtttgttgggcacttaaaatgaacctagctttgagtgcattgtttttactggcattaaatcacttaatccccgcaagatccctgtaagtgccatatttctattcctattttattagatgaggagatggaggtggagagtgtttatctagctttgtcagataagcagtggttctacataaatgaatttccaggtaactgaagaaatattcaaagcccctacatctatatgttctaaatagacttctacatgttttaatcattttggatgaacttgtgctaaagtgtgtgcaaaagttccaccttaaacaggattctggaaatctttccttaatgacttaggccacttatggagtacctcagatgtttccttttaacttggtgatttgggggctacagcttctactgtgcgtggtgcacagtaggattgacaggaaccaaaatagttagaattttatgtaaaataagagtaaattatctctaaataaagcccagatgaattttctttagacaatgtaatacatttttttaaataaacttcctgtattttgggcattagggcttttagtcatttgtttattttgtggtctctctttctcactctctcttttttttttgttctaagctgtgttttgaggagttagcttgtggaataagagagttgataccattgcatatgttgcaagaaagaaacaatactttttttttgtataattggtgtaggatcactaaatccataccatagtttataaattgtttaatctgaaattgttaatatggttcagaaagacttcaatttttggttccatgataaaaatatacatttatatgcatgtggtattatcagagttgttgaaggtgtgtgaacactcctttcccagaatactgcatattttagtgagtggagaaagaatgaagggaggagggattataaagagttgtcatgcatacactatgtcatggtaaataacagctcagagccaagtgttgagaaactggccttccttaaaaagttagcacccgatcagagctaccattagtctttaagaatcaattccgctgcccaaaagctcagactgagttgacaaaacctcaaaggaatcctggaatatggaacctgtatgttctgtccactggggagatttgtatcttttttcatgttaataatggcattgagggaccctatatatgttggtaaattagtaagcatggaaacttcagttatagaaatgccagtaaataagttcagaatagatcagggaagaggttaactatggtaggttgatgatgcaactgtgccatgcttttggaagtgttattttggagtcattggcattgctgtcaaaatccttacatgtcatttaacagtaggccaaatgtgaattaagcatcctcactacgtcacaggccatttaggtgtattccacagaggatggaacccttcttgtggggtgtgttccctgcactctggttattccttgagaaggatgaatgccacatgcctagggggtggtaaagggagtttgtgcatcagatacatattggagtgaatcacctctgaagtccaccttgcttctctgcaggtccttgctgtgtgcctggcactgctatgactcactgtcttcccctttatcattgtccccacctcccacatttacctctactgaggtcttggctgctagtgacctcctagtcatccttcaagtgtcatctcaaatgcttccagtcttggcatcctccccactctcccaggaagggttaggagtttccttcacgaactgcctcagtgtgtcagacccagctctggagtgttgatcacctcgtgttgttgtctatctgatgattcccattgtgaacatctcacaaagggcaccatgtgttaacagacttatatttctggggtgtaacatagtgtttagaacattacaggtacttatgcaatactgttggagtttgattctactcctctgagagtgtatgtcccaaacatacctacattgggtaatgtaagctaaactgctttaacaagaagctcccaaatcattcagtgctgaagagtatgaaaacttatcctcacaggtagcagaggtgctccattttggtgatagctctctttgcaaagtcattcatttcttcttccacgcatgactttcaggttactctgcacatggctatctcagccaggaaagaggggtgaaaggcatataaaatagaatccatgctcagccttaagacccctgcctgcagggctctggttaagagtgagctgcaatacttcaactcatttccattggccagaacatcaacctctgaccatacctaagagctagggaggctgagcatgggctctgcttgtgctcaagaagaacgaagaacatgcatgttggtggacagttgccatcttctcctcctccagacttcccctttttttttaaatcatgaccatcttccccatcatttggcttcaaaacattacaattatgtttgccttctaactcttctttctcacctcccacctagaaagtctgaaggtcctctttcaacgtgtggaatctcttttcctctccgtggcttcctttatagttcaacagaacataataccttaaagtgaatcattaattaatagtaagctaaaaagaatgagaaaggcagaaagcagagtggctattactaaataaatttgaccctaggggaaataaaatcatggaaggcaaggttaagtgcacatatctttaactacttgttttgttttgaggatttcgaaaagtagtaattaagagagaaggcagagaaggaaaaaactggaaataaaggaagaccaaccaaatagaaaagaagcaaagaatatgcagagcctgctgtagcaagggagtcagtcaccatcccctgagtttggcagagactcacttatcacaggcagagggctggaaagctttatagcggagaaacaaatggctccaggtgtgccctgatggcggctgatggccaggggcagctggaggcagctaactagaaacaggacatcctgtgtgagtggttggggtgtgtatttggctttctttggttggtcttaagtgggaactgtggacaaaactcagggacacagtcagttattaatcaattcccagccatttggggctgattgtttcagcagtttttgtttagcttcctggactgtctctagagagcaatctgacctcctgcaagtctcacttacagcaggctggcttcctgggttgcttattgtatataaagggacagtttcctggcaagatgctacagattgtgggtcaaaattctgttttttatatggtctagccttgtccatttgtatcttcagtctctcaagacaataatgtgaatgaagaattttctgttttatacataaaggtggtggtggcagtggatggtggagagttgggtgcacaagtgtttagggagagtttgatcctaacaggtacaatgaaaagaacaaagaataagaaatgattctatgcatgacaagcaactactgaagtggctagggcttcttcatacaggcatagatcaagctccattgctatcagagcaagaacacaatggaaggcttttgatctttattaaaaaataaaattcagagtaagctggtaactcaacattaacaagcaattggataataagtaaagtttagaatggtgtgagcagcaccttaaagatgttgctgggtaaagccaccgtgtcatgagatagccccataaaaacagccatggcaaaagaaaggtgttcaacagaatgtgtgggccctccatttgtcacagagcaaatggcagtccccaattttcagtctaagcctgctcctcaggatacaggcttagaacctctttgacacggcctcagcacttcataccatatttctgtttattgcctgtctgccagcctgcccccagatctgccttggagatctctgactgaatgtcttccctgccagtatgttcagtgcctgcatgcctctctcacagagtaactaaccccaaagtgtgttaaatcagcatacacagcaagtgtgactttctacataaacattctcagacccttaaaacttgctaccaatgacatctctgtttagctaccattgtggcaaatagttaattaatttattctgtcctttaaagaagaattccaagaattatgttttagagtaaattttaattagctgtagaatgacttcctttcctctaataaattattcatgtctggagatatttcaactattgggtataaacttctcggataaacaccactgcctacattggaacaattaactgaattttcaacaaaagtgtctagaatgcctcagcctgtctctaagggtgtgatgtggtgatgtaattccattcaatggaagaaaacattacaagatctgttagcttcatttttccctctagtaaaataggaatagcatagaatggagataatgtagtttggagaaaagaggactgtgtgtgtgtgtgtgtgtgtgtgtgtgtgtgtgtgtgtgtatgttgctgcaccctcactgactaaatgtgctcttgttagatttgtcacgagtcactactgaaaccatctttgcaaaattatgactgacacactgaaagagatctaacttaactgactccatcttgcttctaacctccaagctgtccttattcattcctaggcgtaggctgaactaactttgggagaagtttagtttatagtttaaacaaagatggtaacagctctttcccaaagcagacctccttcttgcctggggactagattgcctttgtaagactaacattagccacaagattagaaattatggtttaggagtcatgtagcttgagtgtacaagattctgaccctccctaaacttctcctgagatcagtgcttgagatattttgcagaccctgcacttgatggatcagctggctccactcagatcaataaactggctcatccaatcttgtggcccccaccctggaactgactgagcacaagaagacagctccgactccctatgatttcatccctgaccaatcagcactcctggctcactggcctccccccactcgccaagttatccttaaaaacgctgcccctcaaatactctgggagactgatttgagtaataataaaactctggtctcccacacagccagctctgcttaaattactctttctctatagcaattcctgtcttgatgaatcggttctgtctaggcagcaggcaaggtgaaccccttgggtggttacactaccatctagtggggctaaaaggagagggtagatatgaagccttctgattctgaacttttgcttttaaatggaagaatacaggaatgaggcttatttgtccagagtcatttcattcactgtcttcatgcataagatcttcagcaaactgaaatcagggcattgagcaagttcaggacctgaagcaagataaagatgattaccaaaatcaataatccagaaatgtgaaaaaccaagttatgtcagtgtctctatcactaataatatatgactagtgctatattacttactagggctgccataacaaataccacaggtgaggagtcttcaacaacagaaatttcttttctcacagttctgcaggccaaagcccaagatcaaggggccagcaagattggtttctcttgaggcctctctccttagcttgcagacagcagccttctccctatatcctcatatggtcatctctgtgtgtgcatatttgttgaatatatctgtgggtccaaatttcccttttttttttttttgagactgagtctcgctctgtcacccagcctggagtgcagtggcatgatcttggcttactgcagcctccgcctcccgggttcaagcaattctcctgccccaggctcctgagtagctgggactacaggctcgcaccaccacacccagctaatgtttgtattttcagtagagacggggtctcaccatgttgactaggctggtctcgaactcctggcctcaagtgatctgcctgcctcgtcctttcaaagtactaggattacaggcatgagccaccgtgcctggccaaatttcttctttttctaaggactccgtcattcatactggggaccttattttaacttaatcacctcttcagaggccctgtctccaaatacagtgacattctcaggtactgttggttagaacttaaacatggggaagtggggcggataggcaacagttcagtccatgacagtgccaactgcagtcaagcaggctcctttatcatgtgcttgagtggaaaacaggactcctgtattgaaactaatctgggattacatcttatttcctaggaaaatattagaaaactggaatttgaaaatcttattttaaatttaatgagaagtttatgtattttgcagaagattattcctaaaaaatgaaacatctgtacaaaatatttagaaagtagatacggtatttttgttctaaagaaaatatttccatttcaaaagtaaaatattcatcatttcaaatttctattttaatagataattaataggagcaaaatgtctaataatggtttttaaagcatgtgattaaaatataatattcttataagtctatcttatatcctattgttacagaaaaaagtgtaaatggattttatagtaatagatataaggaataatttagctaatatagttgaaacaaaagggaatacaagagtgaaatttgcttttcagttacatagggaaaagaattaaatcacatggatatctttgactcctccaagatactgtataataaatatattcatttttggctgaacaggataaatagcattgttggtttgggtgtaattaagctagagaatatcagggaagggtctcagtgatgttcaaccccacgacctttcttcataactggatcatcctaagaataaatacatcccccattgcagaatctagatctgcaacattgatattttgccataaaatactttttgttatttcaagaagatattgcctatactcctcattaatttcttcttgaacaatttactcagccaagaaaaaatttccaaagggtccactggtttataaagttcttaccacatttatctagcttatactaattagtccaggtcacctggaataagtgttgatcctaagtataaggcttttcctctgtcagattcccctcagaacaccttgtcctcactagaggaccatgagccgggactgtcccacctgggccagccttgctaagatctcctccaaatagaacttctgcttttcttctccgccctgttgtgatgctaaaggttattcatgttaacattttgatgccttgtttacatattaactcttccaaatctttcttaacagcgcttcaaatagtgtgattgttaaggctccgggtaaattagtaaaaacaatttcttcttactagagagactgaaatcgttatacacagtgcatccctagtaatagaactacacttcacacagcatttaaaatgtcattcttttcctgggtctcttagattgtatttaacacaacaccctcgatgactcgtttatttaaagacattggtttggggatgaacagtagaaagctgaagggactttcacccagagaaacaaagctgctcagcaataaactctactccctctgaaacagcagattttggacaaaattattccaatgatctgacaaatgcataagaaagttgaatgcctttctaactccctttgctcaagtagtcgctgtcaatacaacaatagcgataaccactgaaggaatgagagctttgtgaagaaattaataatcacccctccatctctacatttttgagaaggtagcttgaatgctaggaaaccacaatgcaattcttcacattaatttgtagatagagatgcaagggtaaaatctgaagtaatttctgtttcctatcattccttagaaccccacaatttctgagaatcctgctatgaaacagacaacaatttttcttactgttttccaaataagtgattacagagaaatttgatttatactatttcagtaaatattgggcacattaattactgtttttgaaatgtcaagacagaaagaaatcatcgactattattctattttgcaataattcaaaaaaagggcaatttcattttttttgcaaattccagagaggcatcaacatatgaagtggaaagagaaagaacaaaataaatccagtcagacaaacgaaaagataaattcaattttaggtaaagccatgcaaactgtggttgtgtcatggaatatttgtttatgtggaactattggagggattaaacctataaggactgggtttcatcagctgtgtttgtgtatagctgagtctgacagcacttaggagaagagagttaaaagccaagttggatcattgagcaatgagtgacagaatgactgcttcccaggatttatgtaccagctcctgcccttaagaggactgtaggctcccactgaggtcaatatgaactatggacatgagaccctgttcaattatgtgcatctctcagctatcatgatatgttcaccatccatcatttataaatccatgatgctaaggtgctactaacaaaggtgctgaataaataataaatggaatacaatagcatattcactgatatactgtttgataacaggcagagctattttatatgtatatacacatacaagttgagtatctcttatctaaaatgcttgggaccaaaagtgtttccatttttgaattttttcagattttgggatatttccataaacataatgagatatcttggggatgggactcaagtctaagcatgaaattcatttctactttatgtacaccttatacacatagcctgaagttaattttatataatatttttaataattttgtgtatgaaataaagttttgactgcaacccaccatattaggtcaggtgtggaattttctactttctaggtgtgtcgatgctcaaaaactcagatgttggagcattttgcattctcgatttttgaatgagagatgctcaacctgtacttacatacacatatctcctcaaacacttctgggttgtggaataagactacagagggaggcccatgtgccatgtctaaacacttaaaagtcaaaaatgaatcttacaaattgctaaatgaaatatattctattgtgtttattctcctactttgataaatataccttcaaaatgtcaaaataaaaaaatatgtgaatatttatcattattgcttatataggtctgaaagtgagtgaaatatcaattgtgactggacttaattattaatgcaggagtcctaagcattgggctatggatcagcagcacctgctaagtaataaaacaaagcatacatccagtcaggtgcaatggcttacatctataatcccagcactttgggagggtgaggtgggtgcatcacttgagtccaggagttcaagaccagcctggccaacgtggcaaaaccctgtccctactaaaaatcgaaaaaaattagccaggcatggtgatgcacacctgtaatcccagcttctcgggaagctggggcacaagaatcgttccaaccctggagacggaggttgcagtgagccaagatcctgccactgcacttcagtctgggtaacagagcaagatcctgtctaaaaaaaaaaaaaaaaaagcatacatcattcacaaattattatctatttattgtaaatatttgtctttatttccaaaaacctctaatatgttgctataatcaatatcttcacacaatttttgtcctaaagatagtaatgttaaattaggaagttttcttgggtgtcgttgtaatttttaaattgttttttactaatttcagtttataaaaacttcacttgactgaggaagtaccaactggaattgtcactgacatttttaaagcaatacttagattcagaactcaagttcatatttgaatattacaatagattacatataataagttgtcataattttataaaatattacaaaatattttaatttcattatataactcaacatcacaaagtacaattttcaccacctctagaggcaatagccaaaatcatatgtaaaaattggcctgcacttctttcctgttatagctacaactgcatatataacaatttaattgtgtaatgaactgtttagtatttcaaagtcttctccagcttctgtgggcaactcttgagatactatgctaactcatgcgcacctcagggaaccacagattgcaacatgaagagaagcaaaaaaacaaaaacaaaaacaaaaacccagacattcactagcttttgggaaataattattatttgagaacctattgtgtccaaaaagatgaattcatttttcttttctcttacctaagtgattccacagcttatataatcactgtacatcaaagaagttcaactctgatgacaaagtatcacaaaactgcaaggcatttggctgtgatctcagacaggagatcccatcgctggtaaccagtgacgtaggttggggaagtgtcctcacttcaagctttcaagtgaagcttgaaaagtgttaaccgtgagtgtgtttgtgaactgtggggctcagctccagcttctctttgcaatgtctagggtgctgtaagagacactgactctacaccatggttctccacccacagtgtatctgtaaattcccaaatgatgctgaggtgggagcactttcagtggctccactctcggcttggcagagggcacttgcattgctccaactgcgatgtgctcttttgctcactttttaaattgccagctgttgtttaggtgaatctgtgatcctctcctctattttgttatacatcagaagtggaaaagggtagcaaattatatagtttagtagagcaaatatagtttcaactcaactgtcatgctttgctggtttgaaagcttcctctgaatcaagagcctttactttccatgtggaccacctcttccaatgctcgtagagtgagccagtatggtgctctggggacagctgttcgcctcagcccgtcagccagggcacacagtcttcatcatgaagtcgtgctcatttcctccagaatggggccatgtcttggagtgttgttcccagaaagacatatctcttagagaccagcagagatgactaggtatgagtgcaatagatgtgaacagctgtgcttttttgcagaataaagccatacatttgctcttctcttaaatgtaaaccaatgatcatgcgaggctgagatgaataagggttgacaaagctttctacattgttctcgaagagatacaccaaatttctaaaggtaacaacatcattaatgatgaccaaataatctccctttggccttgtaatgtgtttgtgtttcattcaaatgcaagctatctgatattaaaagattgcccacttttcaaattaaaatgaagccattttatgaaggtctgtgtcaggagagcacagaaaagcgttccaatatccctgaccaaacgttgtgttgcaagcctgggtaagaatgagccaaattgtttttatgtttgtcagagccattgtttctctttcctttggctcaaaagggagtttgtttgttaggcgcccactgagccatcagatctgcaactgagaatgctgtcaagattcagtaaatgtgcaaatgggaaaacccactaggtaaactaggttaactcaggttgtgctgttacttaaacacaaaagtgtagtagcaaacaccctgctgtcaatcatcttgtaaataactacattattacaagactaggaaaggtgcttctgcagccctctagtcctatgtgcatctatccccctcatctttccatgatgatgagaccatataaataagaagcacagcttaagcctacagtttgcttgactatttctaattgttttcaatgagtggacagataaatatactcactctttactttggcataaccatttataatccttaaggagttaaattcattttaaactaataggatatatggatttttaaaaaatacttgattttagatgtgaaaacataaattattcagagaccatttaatgataatatgaggtatcaatggccttactgaaatcaataagagtttagaaaacaagactaaatgcccattctatacgttaaaatactctaatatatataggtatgaagactgtaaaattttatcctaaaaatccatccacttcctgttaaacaacaaaattaaatcttccaatgaacagttctaggttgttcgaagaagactttattctgtatctgaactaacagttttgttaaaatgtactatacaacgaactacttgttctaccaagttcttttctctgggaagaaagacaggtctttcacagtggttcaggtttcaaatgacaatagacactaatggaaaagtaacatccttatttgcccctagaaaaaaatcagggaacttccttgggttttagtctttccctctgcaggagctgggcattgacttttctgagataatttcaatattaattattcacgtattttaaataaattactagtgatatttcatagcaatactggtgcaccttaaataatgatcctctgacctcaactgagttgggttgccacaattaagtagttcatcaaatagtcacacatatctttaagagaggttggttttgttattctgcaaaattattggttgatcagcaccacacacctcatgtatcttatcctgaaggaattcatgtgcatagggagagggaagaggagggactcaaggtcaaaatgggaaatgggaagtccctacagttaaataagaaaaaatactgatttcagatgaaaaacgtagaaacatgcatgccactcacattgacctatgacctcacagtcaatgtcaagttcatcaacctgtaagaaaggagggaaatacagactgcatggagaaaacttcttgttgtaactcattccacatttgagagtgctggggaaccctgagggaagtatcttttcattgaaatgctttaagtaatttctctcgctgtttatattctggggtcttgacatgttctgtcaaaaaatccccaaatgaaatccttagtatgattttttcccccatataccaggaaagactgcttcacaactttacatccccaaacaccaagcacagctttcagactgtgtattaacaattctgaattgctctttcttggctaaacctgcattattcccaatgaaaattggcaaagtaactgtaggactcacctaacatcttccttggcttatgtgcttcctgctggagctcggtcagtggaagcaacaaagtaaccctgatgtcagctctgtgaagtgattaggcagtcaagtgggtgttccgatgagatgggacagagagattctggtccaaaactcacttgagggaaagaactctagccatagttcttcaatagagcagggtattatcctggttcctttaatgataatacagtcatgtactgcaaaatggcatctcatttgactacggacctcatatacaacagcagtcccatagcttataatggagccaaaaattcctattgccttgtgacatcatggccatcatatggtcacagcacaatgcataattcctgtgtttgtggtgtatcttagtcaattttctgttgctataaaggaatacctgagactgggtgatttatgaagaaaagaggttcatttggctcatgaactgcaggctatataagaagcatgggtgccagcatctgcttctgatgatcatctcagcaagttttaaaccatggtcaaagtggaagaggggagcaggcatcacatggtgctagatggagcaatagatagagaggagagggatgccacactctttgaatcaaccagttctcctgtgaaccaatagagcaagaactcattcattactctgaggatggcaccaagccattcatgagggatctgcccccatgacccagccacctcccacttgtcctacctccaacattggggatcaaattttgacacgagatttggagggaatgaatatccaaactatattgagtgacattggtataaacaaacctactgctctgccagttatacaaaactgtatagtaatggcctaggctttcacattcactcaccactcactcactgactcttccagagcagtttccagtccttcaagttccattcattgtaaaattactattgtcatggtactatgaatgtatgatatataagcataccattttttaatcttttatatcatatttttactctacctttcttatattgagacatattcagatacacaaatacttaccatggtgttacaattccctaaagtattgagttcagtcacatgctgtacaggtgtgtagcctaggagcaataggccataccatatagcctaggtgtgtagtaggctctactatctagttttgcataagtacactctatgatgttcacataatgatgaaattgcctaatgatgcaattctcagaacatatcatcatcgttaagtgatgcatgactgtaataatttattgtgttattatcatatgcctggcatggtgctaagtgctttattttttcatgacagctggatgacttgaagaagtagctatggaatagtggacatagactgagaaggcccaattttaaataccagctccgtcaccagctgctctgtggcccaaggcaattccagacttctctgaaactcaggatcttgtctgtcaactttgtacattaacacttccctcacaagactgtgatgtagatgacaaattccttagtttatgtgaaagtgatttataaactgtaaagtagtagccaaatgtcagcagtgactttgattaaaattatgcagcaaatgagcactcgaatagaaaccaccattctgacagccagggctatttttgtggaggagaatgctactgatctttttctgaagctgaaaaagcattccagaatcttcttcttgagaaataaactccaataaaattataattaacaaaatatttgtttttgcacatccaaatgcacatatatttctctattcagaataaagaaaactgtagtttcatcagatgctctcctggaagcctgtgaataactcacagttattttccttgggtctgatgtgaggccagctcatttcacaatgatgctactgggacattaccaagaaagagcaagtggacaaaggaagcaattgccctttggtaagtttttaaactagataaccaaattgtgattctgtgacgtgatccctccttccttccagctctgccatgactacacattgaaggatggatcacagaagtctaatataattgactcatgggtgcaacatgccttctcttctcctctttggtactatgcctagaaacctatttatcatttgtttttctaataataaagagagacacagaggcttgatttatgacgagatgatggccaaggtgttaggtttctttgtaggtaatatcttcttatttcttatgtgagaaaatacagaaattatatcaataaatttactaggttatataatgtgaactctcattaatatttgtaaatgttattttattaaattttaatgattcattagtttgtttctaaacaacaaatatttattttctcacaatttccatgggcccgaaattcaggagcaacttagttgggtgattctggctcagaatctcccatgagatgggtgaaatcatctggggctgcagtcacctgaaggcttgactggggttggaggatacccttccaagatggcccaactcgtatggctactgacaaaaagcctgggttccatgctggctgttggcaagaggcctcagttgcccaccacatgagcatctccataggtctacttgagtgtccttgtgacatggcagctggctttctccagaacaggtgattgagagagagagagcccaataaggaaaccacaatgccttttatgtcctagtcatgggacatagtgatgtgtcctatgatgtgacacacaccctgagcctgtccctcccaccacattccattcattagaagcaagtcacgagtcccacctacactaaagggaaggggaattagtctccaccttctgagggaggattgccaaagaatatgtagacatatgtttattgcatcagcctcaactccttttcactcacaatctacatctgatccatgagggaggcctgttggttataccctcagaaaaaaacctagaaccctaccctctgccagtaattcaaatgctactcctaagtcactgcaatctctcgctttgctgccccaaacgctcaggctcttttaaatacagcagtcagattgatcctgttaaaaaccagctcagatcatatcacactgctgttcacaacccatctccctcagagtagaagcccaagatcttacaatggtttgtaagggctttactacttgctatgtctttaaacaaatctactttttctcaattctctaatttttttaatgtcagctgattggatctccacacttaagtagtacatcaagtaggcacacatacccattatgtaaagtggggtatgattctacaaaatgatcagttgtcagggacttgaatatcatggaatggatgtgagtagggaggtgcaagaggagggactcaaggtctatgatgggaagtgggaaattcctaaagttaagagatgaatgggaaaaataaatctttatttcaggtgaaaacttagcaacagacagtatagagtgaatgaatgaagaattgaattaatgaaatggtagatatgcatgacagaggagagaaggagggaaggagggaggaaaggaggagggaaagcacagagaataggtggaaacaatttaaaaaatgatatatttagagcaaggcttgctaataccttttaattgaattgaaacaggaagagaactcctcgaagagttttcgcgccccttcttccagtacttccatactgtacacattgcttccacctctctgttaggggtgttcaggatctccaagttgtctgagtttatctggtcttggggatgcatggagatggctttgtctggctcagtcagtctatagccaagttctatgggcccataggggcaactgtttctgaacgtgtttatcaacccctatacccctcccccaaaacagccatccttgatgtcaacctattacacctctcttacctattcacagcagtttgatggtgacattgcctcattcaggacactaagaagcaaatctgagtttattttctaatgcagttgaaagcaggctcacaggaattctacagacatcaatttctcacctactgtgtgtataagtctatctgccgagctgcacagaatcggctgtacctggcttgggaacagcagtcacatttgttgccaagtaaaagaaagaattctcatcaatgttgtcaaagagccccagtgcaaaacaaagagggtctcctccctcaaaatgacaattgtgaaatgagtggctctgaaaatacagagaaaaagaatggagatcttctcagacataatgagatcatctgagaaggtcagaagatggtgagatgggagttgggctgtgaagagaaatgtggagtttatgaaaatgggaagagagaagaggcaacccagagaatgcacttagccttcagggctactgttggacaccgcagggtccgttcttccccttcctcatgtgaatgtcaagaacagacacccttcgaaggcattgtaccaaggggcagcctctttggtctggagtactgggtgggagggctcaatgtctggcttcctaggggatacgggggcatgcatattgttttttgaggagctagcccacagtgaggcagcagtgagcgtccctggagagggagcgccctccagcagcagggctgttggaggtcccagggcaggcagctgtcagccagtgttgttctggaaacagatttacatgcctttctcacagcatgccttcagccaaaagctgctgacagcagggaggctgtgcccttttcctctttttatgggatctcatagcttttaagttcattcctttagtgcacacaccttattgggaaacccttgaatgtgatgggcactcacctcccatcaaatggggaatgtgtctttaaaataccaagaattaaaaatatttagagctagatgttaaaaggtctactttctaatgaaagatacataaagtgatcagctacagatttttgctcaggattgaattaaagccttttttaagtatattaattctagttattccatacctgtaaaatgtgaaaattaggcaaaccagatctggttggttagaagctctctgtttggttttctgtagaccattgaaactatagaagagaaagttatactttgaggttggaaatttaaatgtcaaaatgagttatatcaaataattattgggtggggggggggaaccttcaataatacaggaagaaatttaaattaaaaaaaatacaaaaacaaatcaccaaacactttcaaccaccgacaaatcaaaataaagattagaagtgccaaaagttggagcacaagctatatatttagtaatgtgttactggttgctggagaatttgaaaaaagcaacctcatatgggagctattacactcaagatcatatttagaaaatcaatttaaatctaagcacatttgcatattagaggcttcacatgtgtctattaacactatgactgacatgctatgctggtgagcgtacccattaggaatcccaatatccaagatgtttcagcttctcctaagaggccttaggatcccagccagggaacccagagcaaaacagaatcttgaacctaatgagagatggaatcttggaaatgagtgctgcattgcaccattgtgccatcagaccctgctgtcctgacaaagccggcagcacatcactccagaggctttctttgcagatttgcaggtaactcaccctttgtggggaggggatcagcctctcagccctccttttccttcctgtcttcgccatccccgttctccctaaggggcttacacaaaatgccattcctttggggctttgctctggggaactaggtgtgctgttgaagataagtatgttgtttgctaacaatctgcaagcaaaaattttaaaaagaaggtttccttgagtgctgcctaccctagttagcaggaataaaggaactctgactattagaacctgacagaatttactttgcacaagacatatccccatcttcctttcctcctctaaatctaatatggcaagcttgtccaacccatggcctgacacaaatttgtaaactgtcttaaaacattattttttgtgtgatttttttgtttttgttagctcatcagctatcattagtgttagtgtattttatatgtggcccaagacaattcttcttccaatgtggcccagggaagccaaaagattggatacccctagagtatggggaagcgtatcagttttcagaggcaatgtgtctccaccaaggggacattcagtattcagtcacatacaaagattgcaattcggctttcaagggcttggggaaagagctctgttgtttgtgaagattacaatgcctagtgacttaattttaggctttgctgttttgcagtaattttaaaaagttgctaaagatgttgccagaaaagtaaggggtgtaaaattcatttaattcacttaagaactttatgcttaaaattttttaaacagtagcttctacaatggctcctgaaagtactttctggaatgaaaccagatattttaattcacttgtaaatgtaatttcaggttcatcctactagtatgccagataataatgaatcttatacttggagaatatttaagctcagtacagagcaaagtgtttttaaagcaaatattcattgctttctccaactgccatatttatctattgtatttttaatactttttttaatttggagaaaattagagatcggcatgcatttgtaagaaataatacagagagatcattgtatgctttacccagtttccccaaaggtaacatcttgcaaaacttgaggacaataatccaacacaagggtccctcatgttattccttgatagccacactcaattccctccattcttacccccagtttgaaccatggcaataacaaatctgttctctttgcaagaatgttgtatcaatggaatcatgtagcacataaccttttggaattggctgtttttatttttttcattgagcatggttatctggacatcccaccaggacgttgcatggatcggcagtttgctctattattgccaagtagtgcaccatggtatagatgtacccatcagttttttgtcatttacctgttcaaagacacaagggtagtttccagttttttactattatgaataaagctgtcataaacatttatgtatattagtatgaacataaatttttatttctctgggacaccttcctaagagtgctatggctaggttaaatggaagttgcaggtttagttttataggaaattgccaggccagttgaggtggctcacgcctgcaatccccagcactttgggagaccaaggagggtggatcacttgaggtcaggagtttgagaccaggctgcccaatgtggtgaaactccatctctacaaaatacaaaaattagctggtcgtggtggtgggttcctgtaatcctagctacttgggaggctgaggcagtagaactgcttgaacccaggaggcagaggttgcagtgagccgagatagtgccattgccttccagcctgggaggcagagtgagattctgtctcaaaaaaaaaaaaagaaaagaaagaaagaaggaaggaaggaaggaaggaaggaaggagagagaaaggaagaaagaaagagaaagaaagaaagaaagaaagaaagaaagaaagaaagaaagaaagaaagaaagaaaggaaggaaggaaaagaaaagaaaagaaagagaaagaaagaaagaaagagaaagaaagaaagaaagagagagaaagagaaagaaagaaagaaagaaaaagaaagaaagaaagagagaaagaaagagaaagagagggagggggagagagagagagaaagaaaggaaagaaagaaaggaaggaaggaaggaagagaaagaaagaaggaaagaaagaaagaaagaaagaaagaaagaaagaaagaaagaaagaaagaaagaaactgccaaattattgtccagaatagctgtgccattttttattcccgcttataatgtatgactggttaaattttttgcatcctcactggtatttggcattgtcattgttttttaattttagtcattttggtaagtgtttagtgatacctcattgtggttttaattcattttcctagtgaccaataatattgaatttttgtgtgtgatgttaattctttaatttaatttttttttttttttttgagatggagtctcaccctgtcacccgggctagagtgcagtggtgcgatcttggctcactgcaacctctgcttcccgggttcaattgattctcttgcctcagcctccggagtagctgggactataggcgccagccaccacgactggctaatttttgtatttttagtaggaatggggtttcaccatgctgcccaagctggtctcgaactcctgagctcaagtgatttgcccagcttggcctcccaaagtgctgggattacaggcacgagccactttattttattttattttaagttctgggatacatgtgcaggatatgcaggtttgttacataggtaaatgtgttccatggtggtttgttgcacctatcgacctgtcacctaggtattaagcccaacatgcattagctatttttcccagtgctctccctccccctgcaccacccccaacaggccccagtgtgtggtgttcccctccctgtatccatgaatattgaacattttaaaaatgtacttatttgtcatctgtatatcctccttggtgaaaattctcttcatgtttttgcccaagtactaatggtaatgtctattttatttttttaccattgagtaagaaaatttatatattctagatactattcctttgtaaaatatgtggttttaaatattttttcccagactgtgggaaaaacagactttgtctctttaatggggtcttttgcagagcaaaagtttttaatttttatgtcacctaatttgttaatatcctttatgaattatgcttttggtgtcaaatctaagaactttgctctagatctcaaagattttctcccatttttttcctaaaagtttaatcatttcatgttttactgggatccattgtaaattaacttgtatataaaatgtgagatttaggttaaggttcctgcttttgcctataggtgtctgattgttccaagcactatttattgaaaatgctatttttcctctgttggatttcttttatatctttgtcaaaaatcagttggtgatatatgtgtaggtccatttctagattccatattcttttccattatctctgtgtctactcttggccgataccacccagtcttgattactatagatgtataataagtcttgaaattgtgtggactgattcttctcatgttattcttcatcgaaactgttttggctattctagttcctttgcctgtccttataaattttagaacaatcttgtctatgtctacaaacaatcttgctggaacttttacagaaattttgttaaaactgtatgtcaatctggaaataactgccatctttactatgctgactctcccaatccaccaatgtggtatatctttcagtttatttagatctttgatttctttcaccagcatcttgtagttttcagcatatagttttgtacattgtattaggtttacacataactatttcattgatttgagtgactgtaagaggtaataatgttagtctcagctccctggtgttcattacatgtatgtagaaatacaactgagttttttatgttatcatacatcttgcaattttgctgaattggcttactagttctaggagggttgttgttatttgtagattctttgggattttctatgtagacaatcatgtcatctgcaaatagggacaaagttttttgtagatactccttatcaagctgaggaagtacttctttattcttacttttctgaggtattttttaaaatcataaatgaatgtagaattttgtcaaatgctttttatgaataatttgatatgatcatgtgattcttccttcatggcctattaaggtggattacattgattttcaaatattgaaacaaacttgcatctctgacataaaccccatttgttatggtatataatttttatatgtattgcttaattctatttgtgaatattttgttaaagattctttagtctatattcatgagggatgttggcctatagtttttccttttgtgctgtgtctgtctagttttgacattagggtaatactagctttataaaatgaactgggaagggttctcttctatattttggaagagtgtatagagtttatgttaattattcaaaccaagccaataaaaccatttagacctggagatttttgcggggagagtctttaaattatgaattcaatttttcttaaagttataggggtattcaagttatctatttcatatgggtgagttatagtggtttgtgtttttttaagtagtttgtttcatcttagttgtcagatttatatgtacagaattgttcataccattctcttttatggatttgatgtctgtggggtctgtagtcatgtcacctgtttcattctggatactggtaatgtgtgttctctctttttttacccaaacttgataaagattggccaattttattaatcttttcaaaaaacaagcaattggttgctctattttactgttttttaatttcattgatttctgctctaatctttattatttccttccttctacttgctttgaattcatttacctctttctttctaggttctagaggtaggggcatgaattgttaatttgagactcttcttttctaatgtgagtgtttagttctactaattttcctctcagtactgtgttaactatgtgtcataaatttggaaatattgtattttcattttcattcagttttgtatatattttttaatttcttttgaaacttcctctttggtccatgggttacttagcagtgtgttgtttggtgtccatgtgtttggaggtttccctgtctttctgttatagggttctagctgattctattacattcagaggacatactcattagtgttgccaactgccattttttccattgtattttaaaatccatatagtttggccaggtgcggtggctcacacctctaatcccagcattgtaggaagccgaggcaggcagatcacctgaggtcaggagtttgagaccagcctgctcaacatggtgaaacaccatctctactaaaaatacaaaaattagctgggagtgatggtgggtgcctgtaattccagctacttgggaggctgaggcaggagaatcacttgaacccaagaggcaaaggttgcagtgagccgagattgcagctccagcctgggtgacaagagtgaaactccatctcaaaaaataaaataaagtaaaataaaatccatatagtttaatataagctcttttataagaagaaggaacaagtgcgaaattataaatgttcagttgtaatcatttaaaaaatatttcttataaaattagtgtaagaagttcttttttgaacatgattagctacattatggggaaataattctaaatgacatcacatacattttatcatttatatctgcttaagttttgagaaacactttatatattattaaaataaatgctttttatgatttgattttagtaaaatcatgatgtaattttagtaaaattgcagatattctatcaggaagaaactgtaaaagctttacccatttttaaggaaaatattctattctaagccattttcctaaagaaaatgtttatacgctaattttgtttctttgcatagatgggtacttataggattcaaagataaatttgagcttacaatattgatttgactcattctgtcataattaatttgatatagtgaatctagactcatagttaggaaataaaatacttagaaaaaataaccatccagtcttgatttatttatatctgcatttaagctgtttattccagttaccatcaaagtaacttttcaaataggtcattaacatctacgttttgatatcttgaaacattaacccattgaaatacttcacgcccaagacactggaaaacgggaatataaacatttggatccactggaatattttcaaagccttctatcaacttaccttgctacatcttcaactttgtttcttattatccaccattatgattttacaattctgataattgtctcctacctcacgatttgttcatttctgttagtttgcttctcattcttagaattccctcccaagccctctctatcatcctcataaagacttaatttaaattttatcttctctaagaagctcttgaacagggacaggtattctttacaaggccacttgattgggtaaatatacaccaactactcccatcttgatcaagtgtgttttccttcatgacattatcacttctcaaggtatccgtgttcctaccaccttttcagcacacacgctaatctcctccaccttacctcagtagtgatggtgtcttccctgggctaaagggatgtagtcgaggtgggagacactgagaaaagccttggtgcacaggttatcatatctccaactggaacgttaatagacaacatctcgtgattggcaatcctcaatggatggcatcaagaggggcaattaactgctgactctttgttcacacaacatcctgatatgctttattcttgcttccttactccctcactgtctccagacctgttccatctttttatccagtatcttaagatttggcaaatttatttgtctaatattcctttagcatacttctatcagttagacacctgctttggttacttaataggtgagtgtttgcagcctttgtttctggctgtgcaatcgatgactcaagtctgtcttaataccatgggggaaagacgaagacctcaggatatgagtagggaaattcatgcaaaacctgttgaaaatattacccaatgaatccagtgtccctttgcacattaagttgtcaatacaaaagtattgaactcatatatttctctcattttctttctccttattgttctttctccatgccaaatcaacaagaccagttgagataattcatgataaaaataatctacaaaaatacgcattttattatcattattcacatattaatactgctaacactcagtgtaagacacgaggctagctgtaaagggaaggaatcgagaggtgattctgccacgagttctcttcctccattgctttcaagctccacataggagggaagaggagatgaaaataaatttctgtgacagaaggtagtaatgaatgacatgagaaagacggaaaagtattatgagaaggcacagaaaaaggggatcatttccagctgaggacatcagagaatatttcttctaggagatagattctgatgcttgtactttagtattattaataagactgagacatttagagatagggaagaggtattccacagtgaagaaagattgaattgttcttttgatacatagtaactgggcacttactatgtgctggtagcagggacaaagaaataacaacaatatgttaaatgattattgcatgaaactgtaaataattcaatttagctagaacaatggtttgaacaaaggcatggtgggaaatatggaataaaagttgtatgtgtgtaaaataagattattgagataagaataaggcacttactgatctgaccctttgcagggtgtgtttccttggcacttactgaatttcaagcttctttttggctaggactgtgtctcctaagcgtatttttcaaaaaggataataaaattgctcaatagagcataaatactaattatctgtctactcttgacgagcttataaatggggggtagatttactgaccacatgtattcactttatgtttgagtgttttagttaatgttttattccatttttattattttgtactccacaaatctattaatactgattgaatagcataaaatgaagatagtatttcatagactaacagttcacctgttgtagcagagaaattcaaaataatgatgacatagataaacagaagtttatttttctcatgcagaagttgggatcaatggtctaaagctggtatggggctgggctgtcctcaggggtccaggttccttacattttgttgctctaacatcctggtcacacctccaccatgtgatgttgaaggtgactgctctgtccaacagcaacataccaggaatccagcatgaggggaaggagggagaggtgggggcatattctttccttttaaggaaatgctgttgcacgtatcacttccattttcattccctggtttagaagttagtcacacagccaccctcagctactgctagtgaggctgcaaaatggagtctttgactgaacgtccatatggccagctaaaatgtggcatcccactattaaaagaaaagggtagactggagattgggcaggagctaatggtttccttcataattacctgttaagattctgaacaagtaatttaattaattaccttttcaaaagccttttgcacctttttccatcctccaatttgccaatactattttttttcttatggagaaaacaaatacagataccacacagaaaccaagctttgcaatccaattccagtgcaaatttagagaattaatgaacaacaaggaaccaattatgcataagtaaaaaggtcatagttgagctcctgttgagattagaagaaggaagtaacagttttagatggaaagaaactgcccaagactatgcaggaccagaggagaccctaagattggagaagtcaagcaggactgctgagataaagttggcaattttcatactcaccacaactgttgttttgtaccaaaacatgtatgtgtttatgaatgtaggtagatgttcaaaagaaataacaaaattgtatattatacaagaaagaataagggccatcagttaatacatttgggttcttatttctatttttaatatttagttgtgtgaccctgaacaaaatgcttaacgattgagggtctctatttcttcatccataaaatagagatgttgacttagatttataagcaatagaaaacacatttcaaaagcctattctgtgctagactacattccagacatgtaagtaaatgcttcaaggagctcacagtgtcttgggctggaggattggtgtctactcataaacagacaattccaacatgctgatcaacacagcatcaggaaatgatacccaagagcttggggagcacatttaaaagaggcttcagactagaaacgtgagatttgatgaatgagtaatactggattaaaatttcattagctcaaggtccaatacgaggttaaatttggcgatcaaattagaaagtgcataaaatgttcagttaaggcaagatgggttagaatggagctgtttctgcataaaatatttgttaaaaatcaatatataccaggtactcaatggaggttgaaacaggcaagattcctgcctttgaaaacctacaacatataatctagaatttaggatttttgagatttggcacagggtggcatataatctggccatgacctactgagataaaaaagctcatccttacaggggaaaggttacagtttctgctttattgggaaagttatacaaataaagaaaagagactgggaatgttgtcataactttttaacacataagtttttaaaaaatatttctctaatgaagacatatgactacttaggtacatagataatcaagtagttcaagatacgcccaaagggggctctctctaaaggtactttactcccagatcctatcaactgaagctttggggaagatggacctattggctttcttttctttatatattcattgttaaagcacctaaaatttatttgcaatcttattaaccaacttacacatatttactatagtaaattagaagaaaacaagcaataagaacaaggaaaatgaaatcatgtaaagttccatcagcaatttcatcatccaattataatattactttgtatatactcagaatttttctaaacattgcatatgattagttacatttacagtcgatttttctggcctttacccagcaagtttttaaataaaatattttatactggaagaatttctacaacaccttttaattttagctcttacgtaccaaaaataatgatgacagaatctctcacatttgctcaacagttacaaaactggaaatcaaagaatcctagaacttcctttttaactttcttttgtaaaataatgtaaaaacttacagaaaaattccaggaataacacacagatcacctataacctttactcaaaattcagcaaattgaatacattgcctgtgttagtccgtttgcattgctataaaggaatatctgagactggataattataaagaaaagaattttatctggcttacagctctgcaggctctacaagcatggcaccagcattacttctgatgaggacctcaggaagcttccagtcatggcagaaggcaaaaaggaggcggcatatcacatggagaaagaaggagcaagagaaggagaggagggggaggtcctagatctcctgtgaactcattactggagggagggcagcaagccattaatgtgggatcggcccccatgattcagcacttcccaccaggccccatctccaacattagggatcacatttcaacatgatatttggaggggacaaacgtccaacctatatcattgccacatttgctctaccattttctcttctgtctgtccctctgtgtgcatgcacacacatgtatatgtatgtacatatataaacatatatatgtcatgcaaatataaacacatatatgtgtgtaaaattttttctgagctattcgagaataggttgaatacaccatgcccatttaccctttaataattcagtgtgtatttctaaggaacaaggttattctctattggaacagtcgtgtagttatcaaactcagggcattcgcactgacacaagacctttatctgatttacagtccacattctatgttgtcaattgtctggcccttccttacaacatcttttgcctttcaaacagggtccagcccaggaccatgtgttgcatttcatcttcatgtctctttcgttttcgtcagtctggaataggtttatttctctttcattacattgacattttggagaacaccagccagtcgttttatagagtgactctcaagatggatttgtctggccctgctaattttaataagtaggtgataataagcaccctccaggacaaagtggagatatttctggcagcctgaggagcacaaggctgagagaacaagagggagcttgtcacagatgaggaaatgaacaaggctccgtgtgacctcctcaccacttgtggaattgaagggctgagggagaagccaacagtgagaccaggcaggccagccagggtcaggtgctgaagggtttagaccgtgaacttgattctgaaagcattggggatcactggggaatttcagtcaaggacataataatgtttgtttctgagaaagacaatgtcttaaagataatttagtgacgatctgagagcacagcagagtgagtaagaattctgttaaaattattgtgatgtggactgcaggaagacttggggtgaaaagatgcaacatattgggataaatgttgtagaaaatagaacgacttggtgacttggtatacagagtgaagaacaggaagggccagggtgacagctggaattctgttgtgtgcgctgaatgtcaggtgcctgatcctctaaggctggaggtgggatatagggaaagcagctctgagtcagaagaggctgaacactgttttggacatggtacattcgaggtctctgtgggacatccaagggttgctgtgttccaggacctgaggagggagatttgtaccggagatacagatttagatgtcaccaactcacactcactgaaaccatgggctggaggagctccccaggagagggaggccttctgggaggggagggagcatgactaaggacacaagactgtctggaggtgtcaaagcccccgctgtaggtggagaaccacgaattcatggataccaagagctgataggacaactcttccagcagcacattattgttcaggcatgtgaaaggtgaagcaggtggttcagtcgaaccaggggtgcaggaaaggcattgacattattgataagggagtcgctgaaatgatggatgacagactctatgctgtgtgttgaaggagggaaagatagatgagcctgaaagatgagtgttgggacctggaagtctccatgggttaaatgacagatgcaggagctgaatctgagtgaaaatgaaggcattataaacagcaggtggaaatcagaaatgggaatgtttgcggcttcagaatttcttaagtttatttctgggtgatgactagttcagggacaggtgacagacaggagctgaggtggagtgaaggtgggagtcctcgagggcaaggagatagagtgggcaggcatctaagcctcagatgcattgtcctcatgggcatgaaagcatctggatggagatgggtcgtggaatagaaagtgagtctatgggcactgaggctgcagtggaggatggaaatgagggtagacagagggcttacacaagggggaggagcaagcatgcggaaatagccctaaagggagagagtctgctggccaccttcagggcagctttactaaatgtgggggaataaggtgcttccatcgtggggatgcaagacaagagtcaggcaggatgatcgccccaacaaaggtgaagccatcattggagaagaacatctggagaactgggttttcagaaggcagcttttggtctggaaaggaaggaacaatgaaggctctacactataaggctaagagtaaaggaggattatattttaatttaagaataatagtgatgaaatgaggtccaaactggtgtttctcactgttctcatcagacactttatttttttatttattttttattattatgatactttaagttttagggtacatgtgcacaatgtgcaggtttgttacatatgtatacatgtaccatgctggtgtgctgcacccattaactggtcatttagcattaggtgtatctcctaatgctatccctcccccctccccccaccccacaacagaccccggagtgtgatgttccccttcctgtgtccatgtgttctcattgttcaattcccacccaggagtgagaacatgcggtgtttggttttttgtccttgggatagtttgctgagaatgatggtttccagcttcatccatgtccctacaaaggacatgaactcttcattttttatggctgcatagtattccctggtgtatatgtgccacattttcttaatccagtatatcgttgttggacatttgggttggttccaagtctttgctattgtgaatagtgccgcaataaacatacatgtgcatgtgtctttatagcagcatgatttataatcctttgggtatatacccagtaatgagatggctgggtcaaatggtatttctagttcaagatccctgaggaatcgccacactgacttccacaatggtggaactagtttacagtcccagcagcagtgtaaaagtgttcctatttctccacatcctctccagcacctgttgtttcctgactttttaatgatcaccattctaactggtgtgagatggtatctcattgtggttttgatttgcatttctctgatggccagtgatgatgaacattttttcatgtgtcttttggctgcataaatgtcttcttttgagaagtgtctgttcatatcctttgcccactttttgatggggttgtttgtttttttcttgtaaattgtttgagttcatcgtagattctggatattagccctttgtcagataagcagtttgcaaaaattttctcccattttgtaggttgcctgttcactctgatggtagtttcttttgctgtgcagaagatctttagtttaattagatcccatttgtcaattatggcttttgttgccattgcttttggtgttttagacatgaagtccttgcccatgcctatgtcctgaatggtattgcctaggttttcttctagggtttttatggttttaggtctaacatttaagtctttaatccatcttgaattaatttttgtataaggtgtaaggaagggatccagtttcagctttctacatatggccagccagttttcccagcaccatttattaaatagggaatcctttccccatttcttgtttttgtcaggtttgtcaaagatcagatggttgtagatatgtggcattatttctgagggctctgttctgttccattgatctatatctctgttttggtaccagtaccatgctgttttggttactgtagccttgtagtatagtttgaagtcaggtagcatgatgcctccagctttgttcttttggcttaggattgacttgacaatgtgggctcttttttgattccatatgaactttcaagtagttttttccaattctgtgaagaaagtcattggtagcttgatggggatggcattgaatctataaattaccttgggcagtatggccattttcatgatattgattcttcctacccatgagcatggaatgttcttccatttgtttgtatcctcttttatttccttgagcagtggtttgtagttgtccttgaagaggtccttcacatcccttgtaagttggattcctaggtattttattctctttgaagcaattgtgaatgggagttcactcatgatttggctctctgtttgtctgttagtggtgtataagaatgcttgtgatttttgtacaatgattttgtatcctgagactttgctgaagttgcttatcagcttaaggagattttgggctgagatgatgggattttctaaatatacaatcatgccatctgcaaacagggacaatttgacttcctcttttcctaattgaataccctttatttccttctcctgcctgattgccctggccagcacttccaacactatgttgaataggagtggtgagagaaggcatccatgtcttgtgcccgttttcaaagggaatgcttccagtttttgcccattcagtatgatattggctgtgggtttgtcatagatagatcttattattttgagataggtcccatgaatacctaatttattgagagtttttagcatgaagcgttgttgaattttgtcaaaggacttttctgcatctattgatataatcctgtggtttttgtctttggttctgtttttatgctggattacatttattgatttgtgtatgttgaaacaggcttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgccaggctttggtatcaggatgatgctggcctcataaaatgagttaaggaggattccctctttttctattgattggaatagtttcagaaggaatggtaccagctcctcgttgtacctctggtagaatttggctatgaatccatctggtcctggactttttttggttggtaagctattgattattgccacaatttcagagcctgttattggtctattcagagattcaacttcttcctggtttagtcttgggagggtgtatgtgtcgaggaatttatccatttcttctagattttctagtttatttgcgtagacgtgtttgtagtattctctgatggtagtttgtatttctgtgggatcggtggtgatatcccctttatcattttttattgcatctatttgattcttctctcttttcttctttcttagtcttgctagtggtctatcaattttgttgatcttttcaaaaaaccagctcctggattcattgattttttgaagggttttttgtgtctctatttccttcagttcttctctgatcttagttatttcttgccttctgctagcttttgaatgtgtttgcttcttgcttttctagttcttttaattgtgacgttagggtgtcgattttggatctttcctgctttctcttgtgggcatttagtgctataaatttccctctacacactgctttgaatgtgtcccagagattctggtatgttgtgtctttgttctcattggtttcaaagaacatcgttatttctgccttcatttcgttatgtacccagtagtcattcaggagcaggtttcagtttccatgtagttgagcggttttgagtgagtttcttaatcctgagttctagtttgattgcgctgtggtctgagagacagtttgttataatttgtgttcttttacatttgctgaggagtgctttacttccaactatgtggtcaattttggaataggtgtggtgtggtgctgagaagaatgtatattctgttgatttggggtggagagttctgtagatgtcttttaggtccacttggtgcagagctgagttcaattcctgggtatccttgttaattttctgtttagtagatctgtctaatgttgacagtggggtgttaaagtctcccattattattgtgtgggagtctaagtctctttgtaggtcactaaggacttgctttatgaatcttggtgcttctgtattgggtgcatatatatttaggatagatagctcttcttgttgaattgatcctttaccattatgtaatggccttctttgtctcttttgatctttgttggtttaaggtctgttttatcagagactaggattgcaacccctgcctttttttgttttctatttgcttggtagctcttcctccatccctttattttgagcctatgtgcagacactttattaccagaggcagaaatgataagcttcatcataacagaaaagagataataacaataagattattaaacacttgaagaaaataactgaattcaaaaatacttatttatattaatgtaagactatgaaacagattacaatcagaaatgatgggagagagaggcacccagattgggctcagccagtggcgatgggactacaggggaaaggtctagaacccactgttctgtatagcagccactggccttacatagctatacaaacttacattttaattaatgatcattaaaattcaattccttgcaacactacatgccaaagattcaatagccacaggtggatgtggctactatattgggcaggtccaataccagacatctctgtcattacagaaagtgctgatggcgttgtgccagcaggggaatctcatatgtggcagggtgggccccagttctcctggagtgagtattcctggacacctgattgctctagggacccagagaaaggagggggtcaccggaaggctacagagagacttctcatctcttactcccaaattagcctaaaaaggtcaagcttttctgcttgttagagtgaagcaaatactggactggaaggcagaagattcagtcaagttcatacgtgccttgagtatgtcacttagcatgtctgatttttagactttatctatgtaaattgggcataataatattaatacttcacaatggcaatgaggattaaatttgacatattttataaaattactgattagcttaacaaacacagcactgtataaatattaggactgatgctggtgatgttggggaaattagcctaatgaggttctagcagttctcattcccaacccaccaagctcaatgcccttccaatcactgaaggaaaaatatatgacttgtatattgatccatgaaatgatcttaccattgcccctcaataaaaataaaactctttcctacccccaattagatatcaaaagctttaaattcttaattttaatggtagatgtaccatgtaagtaaaagttagtttcagtgtattcaaccaagaaatgtaggtaaattgtttagttttctctcttctgattaagagaaactaacaaaaggggctgaagggatcaggtgaaagataagatttagatgatgcttggagaaggcaaattttacaaaccacaattttgtttaaagtggggtgtatttacctgctcctaaacagagatgaaaaaaactgtgcatttttgtccaaaagctgtgcatgtgggccgataaactgaacatggtttataaacattgaaatgggtggtaggctgttttcatttaaggaaatgcttattgaagcttcattgtactttgctatttagcatctcctgcaggtagctatccagctttcaagtacagagacacagcaaaaaaggtcaatgtaactaagactaagaaaagcagctcctaaaacagtacaaaaagggtccatatggaatcatgacatggtgatttgtccattttcatgctgctgataaagtatacctgagactggacaatgtacgaaagaaagagatttaattagacttacagttccatgtggctggggaagcctcactatcatggcggaaggcaaggaggaacaagtcacatcacatggatggcagcaggaaataaagagcttgtgcaagaaaactcccacttatagtagccatcagatctcatgagatttactcactatcatgagaacaacataaagacctgcccccattattcagttacctcccaccaggtccctcacacagcacgtgggaattcaagatgagatttgggtggggacgcagcctgaccttatcacatggtataaaaggtaatggattcatataagtgctcaactgatttttggcaaaggtacaaaggcaattcaatgacagaaagatagccttggagatggagcaattggtggtaagatggatttccatatgcaaaatccaaattctcttgaattactatttaaggtgtgagagcaattggacatccatatgcagaaaaaaaaaaaaagagcctcaacctaagcctcacacctatacacaaattagatcaatacagatcacagacttaaatgtacattttaaacctatacacttttagaaaaaaaaataggagaaaatatttgagacctaggactaggcaatgagttcttagatttgacaccaaaagcatgattcagaaaaggaaaattgataaattggactacatcaaaattaaaaacatttgctctgtggaagactctgctaaggggatgaaaagacatgctgcggactgcgagaaaatatttgcagaccagatacccaacaaaggactagttcctagaagttacaaagaactcccaaactcaacagtcaaaaaacaaacaacctaagtacaaattgggcaaaagacaagaagaaacattttactaaacagcatatacaggaggggtgcagtggctcacacctgtaataatctcccaatactttgggaggccaaggagtgaggatcacttgagcccaggagttcaagaccagcctgagcaatatagggagacactatctttacaaacaataattttaaaaattagccagacatggtggcacatgtctggtcccagctacttgggaggctgaggtggaaggatcgcttgagcctgggaggttgaggctgtagtgagctgtgattgtaccactgcattccagcctgggtgacaatgaggccttgtctccaaaagaaaaaagagaatctatagatgggtagtaagctcatgaaaaaatgtgcaacatcttcagaaattaggggagtacaaattaaaaccaaagtgagatatcaacatacacctatcaaaatggctaaaattaagaacagtgacagcagcagttgctggcaaggatgtgaagaatccagatcacttatacattgctggtgggaatggagaatggtagagccactctagcaaacagcttggtagtttgttataaaactaaactaaatacagttatcatatgtattagtccattctcacactgctataaagatactaccagagggccaggcatggtatctcatgcctgtaatcccagcactttgggaggctgaggcgggcagatcacgaggtcaggagttcaaggccagcctggccaacatggtgaaaccccgtctctactaaaaatacaaaaattagctgggcatggtggcatgtgcctgtagtcccagttactcgggaggctgaggcaggagaattgcttgaacccgggaggcataggttgcagtgagccgagatcgtgccattgtgatccagcctgggcaacgcagcaagactccatctcaaaaaacaaaaatgaaaataaataaataaagatactaccagagactgggtaatttataaaggaaagaggtttaattgactcacagttctgcctggctggggaggcctaaggaaacttacaatcatggtggaaggcaaaacagtcacctttttcacaaggcagcaggagagagagtgtgtgtgaaggaggaactgtcaaaaacttataaaaccatcagatgtcatgagaactcactatcacaagaacagcatgggggaaactgcccccaggatccaatcacctcccaccaggtccctcccttgacacgtggatattatggggattacaatttgctatgagatttgggtggggacacagagacaaaccatatcaccatacaatctaacaatctgaatcttgagtatttatatcagaaaaatgaaaatttgtgttcatataaaatcctgtacctgaatgttcatagtggctttatttgaaataatccagaaactggaatcagcccagacatccttcaacaggtgaataatgcccctctcaaagatgtccacatcatgatccctggaacgtgtgaatatgctatagtatatggcaatggcaaattaaagttgcatggaattaagattgcttatcagctgtcctggaaatggagagattctcctggattttctgagtggtaccagtggaagctgaagagaggaggttggaatgttgcaagttcagaaaaggcctaccctgtttttgctggttttaaagagggaggaagaggccataagccaaggaatgcagcagcctctggaagctggaaagggcaagggaatggattcctccctagagcctccaggaagaaacacagccctgccaactccttcattttcacccagtgacaccaacacaaaaagttgtaagtcacttagtgtgtggaaattcattacagcagcaatcaaaaactaatacacataccatggcacactacttagcaatagaaaaagcaccaacactcacaacagattggatgaatctccagagaattatactgggtgaaaaaacccagccctgaaagattacatactatttgattccacttaaatctcatatttaatatgacaacatttcagaaatggaggaaagatttaggggttgcaaagagtttagaatgggaatggaagagaaagtgtgagagggaatagatgtcattataaaagggcaatatggtatttgtagtaatggaacttttcagtatcttgactatagtggtgtatacgtgaacataaatgtgtgataaaattgtatagaatttaatacacacaagcacacaaataagtacaagtgaaatgagagaaatataagtaagattggtggagtgttatcatgtcaatactctagttgagatattatattatagttttgcaaaatgttaccattagggaaaataaggcaaagtgtacaagagatctctgtatcacttcttgcagctgcatgtgaatcaacaattatctcagtacaatttttaataaagaatattgtaggaaattgttatcttgctgcttattatagccacgactatggattgccttagttaaaacctagaatgtagggacaaagctatctaattcgcttggtacactagctcccttgccatcatttgctgctaatcatttagaggcttttcattaatgatgatgatatgtctgaatgtgccttatagcagagaatgttaacctatttatgaggatccttaattcagggggtccttcattcatctggaaactctagtcaatatttgtgtgtgcatgtgtgtctgtgtgtgtgtgtgcatgtttttgaagaaaacatgtataactttctaaagggctccattaccccctctaaaaaaagaagaaaaagaaaaacaccaagagccaaactccttagaaacacactaagtgtgaacttaaaaatatatttctttggagtgatttaaaataatgctatgcacaactgcgtcaatatttttaaatcggagaaaatatgcatggtctttggtagaatgggctccggggtcagacttccaagtgcgtgaccttcagcaaagtccttatcctttctaagccccagttttctcatctataaaatgggaaaaataatacttcctattttatagaacattgtgagtttcaaatgaaacaatgtatatgtcatttagcatagcacctgacacgtgataagcactccataaatattagcttatttctgtttactattgtgtttaaaatgggaagatctaaagattcaaattattcttttcaaagtatcttttcaatataatggaataaatggcatataattttgtagaaggggcactggtgttagtagacttattctgccattggttccctgagtaagtttggacaagtcacactctctctgagcctccaccataacataagagggctaaaagtttgggtgtaaaaagacgcttgaattaactcaacagacatttatgggagttctttatatggttttcaggttgagttcctcagaagccgaccctgagtgggagattcgtgagaaaaggtttattccggaatgctcaggaaaaacttggaggaataaagaagtgggacaggaaggggaagaaaggaaagcaaagacccacagagggtgttatagggtcaatccttcagaaagctctagagagaccactaagtcaccctcagcatcatctccacctgggaactagggtgcttatatccccactgcagctggttattatttaagggcagtccacactcgcatgaattcccaggcactacctgctccatgtgtgagccagctgagcaaattccagctgcctgagggcagccttctggcaaagatttgcaacagttggcattttgggagtgaaagcccacagggagctcatgtgcctcgaattggtaaagggacccaagggaaaaccagcagagcaatgacagcatatgcaagctctcagagccttcctctgccttcatggatgacactcacagtgtcatggggaaacacatgagcagccacacaattgctaaagaactcccaggagagggcctcagttcagcctggagtgtcagagaggggctcagagggcccccaggagcaaatgaagacagagaaataattagtcaagcaaaatagggaagtggtgagagggtccagccagctgaagagagcatgatactcaaggaattaaaataagcccagtgtaaccagatcaaaggagcggggcagctggagatgtggctagaaggtgaggggaacccagatcatgcagtgaatcaggtgagttaatttgtaggctcttagggtctaacacagtttgttacagacaagtatcatagctaagaaaagggtacaaatttcttaatatacaatggaaatgatagcctagtttcctattagcatccccaggttatagagaaaaaagtcattggggacatatcatcatttttaaagaattgaagttgggtagatttaaaattctttttatttcctttgcatgctggaaggtaaaagaaaagtcatatagaacctaaaataactgaaactgtctctgtaatttagcaaaaaaaaaaaaaaaaaaaaaagaaaagaaaaagaaaagaaaaaactaaacacaagaagagcttctgcagttgattatgtcaataaaaccctggcttctccttggtctgcagtccagagtcatctaccagctactgaattaaaaattaaatcagtagattctggttaaatttgctctgaaacagcctgttctagcaccatttaatttcatggtcaaatgaggataattattctaaaaagcttccagccatgaggttcttgtgattttttagttaaaaatgtggccactttgaaccctgttctgtgatttttagatgtggatacaatgaagtttttgcctttattcactctgactctgtttttttttttaatgagaaaaatcagcactttccatctgaaaataggagattagaccaggatatttctatcaatagaggttactaaaccatttcctcaagttaataaaatataataacaaaaattcatagttgccaacttataatgacacctttgtctttttcaaggttcatggaatgagaactttaagtaatgaatttgatatttgtttcctttatttatatagccaattacaaaggcagaataagaaggcatatttaagaagttgatacaaaccccacactatggttatttttgccacctcggagattcttatcctgggatcccaatttagcacttttggtgagatttaaacaataagtctctaaatagtcaaaactgcaggcactttagggaatgatcattggaatttagcatgaataccaaaattctttatgttggaatgtcggtagaacaatagtccatcattgatgtaattaacgcccatcaagatcttatttagaagtattctcttttcatgaattttatgagcatctattttatttgatggtattcttttcctcttttgggtttaatttaaatttttctcataaaactgtctctaatcactagaatccaaagacagctatataatctaagaccctttctatcatcttctattcatagatggcgtcaagacaaggagaaagagactggacccaggttgttgtggatcttagatgtggactctgtctcctccctaggatagttctgaactagattctttaaacaagacaaaacatttgattagttttttcttaaggaacttcatatgacacagttgtttggttacattattctgcttcctttctctggttttatagcattttaattgctgttttaatcctgtgttttatataaagcatctataattcccttggtggatagaaaccatagaagtaaaaagtgttattattatgcatttcccagtctgttagtgctttgatagattccctaattcactcttcaaaaaaaaattgctatatacattgtgttctttttacaacattactatcatgagtaggaggaatattttagggtaggataaacagtaattggcaaggagctataacattgatttgtacaagcttcatgtccaatccattctgaggatgctattagagtaatgggtgaaatgaagggagtgctgatttgctaaatttacttcgggaaaagatcaaagtggtgctagggctttggaggcactgcccctggcagtttcctgaggtgcactctggcccttgtggaagaaagagcacaagttacccagcggcagcatgcatggtctttggccaaaagaggcccaagatgctgagagagagagcagggtactctggaagccactagatgggggtgtctacttgttcagtctgggcaaataccccatcaaccagctggcatgaaagaaataaaggttaaaatgagggtaaattccatattcctcaatgccattcttttacagaaagtgaactgtgttgaatgtcaaaagcaacttcgagtcacctgctgcctccagtgatttggcctgggaggatagccactgagatcttctcatgctggggttttgggggctctcgtttgaaagcagcattcctctgggaaaccaatgaatacagaataacgaattagaatggaggtgaggtaattcaccaagtttttctgcagagttatgagtgtttctgacctagtcatttaaaccctggacacccacagtttcctaccttttcaacgaacagactaatctttgtccatcacagctaccaataataatgataacttatgattttataagcaatctccaaatgtgatcagtcctaaaataaatgtatctgagcaggaggaggggcagcagaagcagctacaatttcaggattcatccagcaccagatggaaattccatcctttggttaaaattcttctaagaccttggctggcttgtgaacttggcagacccaattattatagcaattaagattttaaaatgtgagtcaaattatgagccaaactcgtgccaaaagctggcagacagacaccctgaatttaggtcagggatgttgttccctgtaccagtggtaattcaattacatcccagccccaggcatgcaagttccaaccccaggagacctggtagtcataataggtcttctctgggctaaagaaaccctgggatgcccattctgcctgaggcccccccatcgctggggcaccgacctcaaggaacagcaggagaggccaccatttgtcccgacattcagctcccggggaaaccgccgtgctgagacaaacacctgtgagggccaaatctgctttgctatatttattacaaaaagactcctggaggactggctggtattctgataagaacttgaaggagaaatacttttctttaagagttagaattttttgaccacaatatttgatttttagcattaagtattctgaatttaaactactaaagagagaaagaatgcgtgtgcacattagggcaattggtaacaggctcccaaagtctgggagctaatcccacctccccgacctaactcttgtgagagtcatttcacactctgaacctcaattttcccatccgcaaaatggtgaggataaactacattcaagaagggaaggccatttcttctgcagtggcagctcagtgtggagaaggctctgtggttggagaggtccacatggaatgtgtatccagagggactgtgttggagccatgctgactgcaaggacaggagtggagagagggcaaaaacgctgtgcatttgccgttcctaaactaggtgatttcacggtgtcattttcattacaaatgatctttaaaactatacatgcatttcctgagtgttcaagtgagagagcaggtccaggttagagcaatgtgtcaacttgatacctgagtggaatgggacagggagacctattttaaatgacagatactaattttattagcaggtagctttagcactcattcatggaccagctgttgtgtacacagcactattctgagctgcaaggacacagagataagtaagccaggcactaaatgtcaggtgttcggagtccagcggttccaggggaatttttgtaaatgcaataagtggttgggttttccgcccagccttggtcagtgtccgtgaggagcatgttcttattaatattgcaaaataagtaaataagatgtgtggcagcgcctaacctgctctctggaggaccttctggagagggctgttgctggcactcccacgctgaggctgtgccattcccaggagagactcagcacccgtttgaatgggaataacttgcctgtagtcctagctaattgggatggtgagggagaaggattgcttgggtccaggagttcaaggccacagtgaactatgatcatgccattgtactccagcctgagtgacagagcaagaccctgtctctaaaaacataaaaccaaatggaaagaactttttatgctacaaaaccacctcattatgcccatgcctcgtcagtctagaaaacccccaaggtgtgtttaatcaatgttctgtgaaaaggagagagtggctacctattcaagaaacactggagtttttaatgcactttccatattttccatgctcttctccaagtaaaaaccttaacacaggaacatgatagcatctctctgaaaatcctaaaaattgtatggaccctcatgatttagtgtgatttgagctaaaggcaagaagactcactaatgaatctcacagagtccctgctactctgggacttagatcttagctggtggctagaagaagccaaaaacaatcacctacaccgtaaaaaatcattgcaacatgaattcaaaattcaaatgaatggagtcttagcaccataaaggatttttctaatttcagatgaacccattcaatgtggccccctccaaagtaacagtgacagctcacgctaataatttacagtctctaaagcacgttcacagccattttatcttattttgaaaatctgttgagggatgtttcctaccaaaacaccaaatcttccacatcttgtgaccagtagcaccgattctcaggctgtgaaaaataggacagtcacatccgatctccagcctcaccgtggtccatcccactctcctcattcatgattcctggtatgtagcgagaaagccaaggatgagacaaatagttttggttcaggattaaagtcatgagttgtctagatatactccttttgtcaaaggtgattatagcatagatctatttaggacagaatctttgttaagaatatttatgatttacagatgacattggaagaaaatcacacattgattttggtttagaaagatggtttacagaacacagtagtgttctgagactatgtgattgagctaacccatccaaatgtccagttcctcccttttcctctgccccttcctctggcctgccccaccacatccctagattgcagcaaacctatctgaaaacccagtttcccctttacctggttccttcctccgatccactccaccctttctctaccgcaacccccaagcatatttgagatgactcagaggcattatggtttggactgaattaaaatgatggaaacataaaggaattcttacactgcttgtatctaatgaatttccctggtgcaaattcaatattaaatgcagattgaagctaaaatggtccttaagggaataacagaagtatatcggatgttaaagggacttttaattaaaaggaatagctggctgggaagcttttaataaatatttattttcagtggctcaaaaaataagtctcccagaggagggcacctactacctctactaccctctaaaataagaattgttttttatgccaaagtgtacatagacatctgttctggaaacttaacagactaggaaaaaaaacaaaattatagtaatcattagcttgcttatttctgaaagattttataatcactcatgtgaaatatttacctaaattacttggcattctatcatagatgatgagtgaacaaaataattacttatatctaaagtagcattgaattagtctgagttttgcatctaatgtccccgaaatgattgatcacaggtaaacaaataaaaagcccctccccccattggttgttatttttctaacttcagatttattgtgtctttttgaggctggggttttagtctatgttttttggggtaaagctttgataaattaaaatacctcctcacatttcattttcattagaaaaaataactcatactgcatctgagaaagcaggattcataaaataaagagttttcatgctaaatattaacattggctctgatttatttatggataagagacagtactgtggcattttcagctcagccccagccttccagccagttgtcatgtcagacctcagtccatgctaggcccaggcagtgatggagggctcagtatctggaggtcaccccattactgtgagtgacagagaaccactgtggacaactcaggcaggacgtggtcaacaaaagcatgatgtcaagaaaatactgtggaaatcacccagcaatacagagagttgatgattggcataggggtcctcatgacataggaggtcctaacatcaggggctgagactcaggagcagaattctgagcccaaggaagatggcttcaatctaagtgtagttggagaatccagaaaaaataaaaataaaaaccactaagaaaacagataggaagccaggtcatgaaatggtagtaccacactgtaattcattcacaggaaccaagtaataatccagtttattagaaccaatgttcaaggttggactgaaaccagtagaaagttagcttaatgctaagttgcctcaattgttggcttgaatcaatgtcttctgacactagatcattttagggttactgggagacaggcaggatgatcatttatcttgcaagtatcttcctaaaaattaccctgactggcctgaatcattagcccatatcttccattttataaaaatcatgacaaataggtactataagagcagataatcctgagggaagtcaaaagtagcattataaatatctcaaacatcaataaatggttgttatggagtattataaaaatgcagtgaagtctttctgttcatgtcaatgagagtttgttgaacacctactatcaactagaagaagtacaggaggatttgatggcacaaaccaaacaattttgacctcagtgcctcttctctgttctcattagcagtttgtcccaaactcgaccaaaccaaagtatatctctccatggcatagacccaatccagggagaaagcaaaatgcaattttgctttgggcttgcatcacctttttgttaaatgagattaatgcttgctacctggaaacattcattgagaacctactaccctaacattacaatgaatttttggagtacaaagatgaatacagaatggttactgtattgaaacagctaacagttcaagtgggaaaacatacacgcagaacattagaaacaaacatacctgcccccatcaggcacgcaacctccagagcagtgtttcatataagacagtgcttccaactttgcaggaaaagagttgttataagtttctctattatcagatgtgacaaattaacaagtagggccatgtagatccacaacaagaaagagtatttgaagacctaaacaattaatttcaatattaaaattcaatagtacaggatagcaatgttctagtacagtacctattgtcaaagcaaaagagaggtgcctcccatgaaatcataagttgacttttgttcattttcttctctttgtggcagcttgttctctctgcaactaattttttccatggaaaactattaaggtcattgtgacatcctgtgaaaaagaaaagagagaaatacactgacaaaaattcataatcaagtcagatcaaaagaactcttatattacttttttttccctgtgatatttttctttaaaaaaatcaaaagaaaagtaaaacctagatctacaagttgtgacttgatacctacaagtaaggtatagtttgcgatttgtggttctttggtagattttaaatggtttactacagaaatgcaaaagcattattctttgaccattaacataacatgaaataaaaggatctaaattcatttcatgtatcaaatatgtcactcttttgatgcacataccattgaactccaaaaggttattgcagtgaagtcatttgcgatgtttctaaaggccattccattgtaaggataaaaaaatgaagcagttattttctaatttacattgattcatgggcaagaaactgtaacgtgctgctggccttcaaagatgaatatgttgcaatcttgtttctggaagagcttacagtcagaggacacaactatgaaattcaaggcacatcataaaaaatgctataaaatataatgcacatattaataatataacaaagtatgaaggacctacattaggcaaaagctattttcatctcctttagtctttacaattctaggaagtaagttatttttattttagacataaagaaaagttacttggtgagatgaaataatttttccttgttttctcagttaggcagtggtagaaatgaaattcatgtgcatctgattgcaggatccataatctgtactttttagcaaagagtgtggtcaagaggagggagcattaattgaagatgtagaataagggtgaaccttagcagtagccgttatgtctttctctcccagtttcttgctggaaaggtgaaacttacttctctgtcctctctcattttagcacttatttttcttgcaccatctcttgcagaacacaagggcttaataattcagcagccagtgcgttcaatgtgttatattacgttaggcaggctagaaagccttactctgtattgatctgaaaaacagtcattgaaaagcagtgctctaacagtgcaaaacaacagagctgacagttggttcaaacaatgagtacttttagtgagaggaaaaaagtcagaacttgcttgacttctgtacaacctcaagacctcacctgttaggctcagaacttgccctgataatatgtaggagttaaagtacttacctacccttaacttcctatctgaaggaaggaagagatttaagttcaatgtaaattaactcactcatcaccaacaaaagatacccaattgacgctgaaccaaccaagctctgagtagtagcttgttttggaaaagggtagaagggggagaaagtttctgctattagcataaatactatgaaagctcacggtatttggccttcttttcacaaaagtagaaatgttttatccagatgttaaattaggggcattatattaggtctgcctcagatcctaacatgatttgtggggagcatatccttcttttttcatctccactaaatattgcttgattccattatgcctgattctggcagtctgcatgtataacagataccaaatcatttgtcaaaccccaactcagtagtaaccctttctataaagtcagactcggttccttcactggcatgagacacacctttctttgtgttagaaacatcagaaactacgacagaaggcttctgtcgtagttttttatgtattggtgtgtctccctctaaatttaaggtagccacaaactccttgaatgaaaggaccattaatctgtcttctctttccttcacttaactctttacctcccccaaacatccttctttgcatagaagagaagagccagattggaatccctcagcctcccaccaccacacctgcatcttatctctgcttgcctctcttgtgccctgatagaaacgaggaggtaagcttccttgcatctaggtccaaacattctgcctggctttatttttggtcattgcctcctcctgccttcttataacacctaaaccactgactatccctcttctattttgcagattcgagttctctcttccaataaattctttgtcattagtttcaacccagttcctctctctgttattaaactaaacaaaacaaaatcttccctcagcaggctccttaatcaccagctcctcagccctgtctctctggtcttctttacaacatgaattactgaaagtgttgtctacacttattggtgccatttcttaaccttgactttctgctcagcctacccctcccatgaactacttcatcaaaacaaagctgttctcacggagggtgttactgagttccaggactcatctgcacctgagactatagaccctggccttgactctgggacagcatactctgtgctttctcctcttcatagtctgtcttccttgtagactcatccttccctacctactcattagaatttttaccttaaatggtggatattttaaaaatgtataaactagatgaagggcatctagcattcagcatatatttgtgaacccaccacctattaaaaacatatcttgggccgggcatggtggctcatgcctgtaatcccagcacttcgggaggccaaggcaggtggatcatgaggtcaagagatcaagaacatcctggccaacgtggtgaaaccccgtctctactaaaaatacaaaagttagctgggcgtggtggcacgcgcctgtagtcccagctacttgagaggctgaggcaggagaatctctcgaacacaggaggcggaggttgcagcgagccgagatcatgccactacactccagcctggtgacagagcgagactccatctcgaaaaacaaacaaacaaacaaacaaaaaataacttatctttacaatctttgacatccttcctgactttccccaattccaccttgcttgtctcctcagtgataaccactattctaaattttgtgttctttattcttacaccattctttataggtttaccacatgcttttatccctaagtaattgcttaatttagcatgtttttcaaattttgtataaatggattcacgttgcaagtagtctttcttaactcgctttttcactcgagtatgtttctaaatctcattcacgttcttatttatagctgtagtttctctatctttacctgtatatagtaattcttatgtccatatgtatttgaatgtgtcatcattatgatttatttattcattccgctgttgttgaaaattttcctgtttcaagtcatttgctagtaaaaacagcaactatgaacattatcatacatgccatctcttacaaatgttcaaacatttctgtggaacagacttttgcttgaaattgtgaaaccataaggcagaagcatttctaaatttgcctgatattttaaaattattttccaaagaattttaacaatttatactcctaccattagagaagacgagttctcttgctctataatcttaccaaacatgatatggccagatatttgtttaagttttaccagtcagatgagtatagagtagtatctcattaagatcttaatttatacttccctgctagagtacgtgatatgtctttacattatatttgcattttatttttgttcattgattttgctaacactgtcatttatcttctattctttttgttgtaatataggaacaatcatattatctttcaaaaatggcaactctgttttctattgtcaatatttacatcttgtttctttttcttgcattcttcccgtgaggacttcccgtatgttgttgaataaatgttgtaaaaatagtcatcttgtatttttttctcatattaaaaagaaatatttcaacgttttgccattcagtatgatgttttctgtaaggattttgcacttaccatatattagcttaagaaatttcttttatagttctagcttgctaaaatactttaaatcatgaatggatgttacattataactagtgatttttctgcatttattgagatgagtatataattttgctttttaacatatatgtggtaaatattactactattaatttatgtgtggtaaaattcactttttttggtgtagagttctatgagttttgacaaaggcacacagccctatactcatcattgcaatgaagatacagaacagttccatctcccaaatattcagtagtgctacccctttgcggtcaatcctaaccccaactcttgcccttggcaatcactgacctgtttttttctctctatagtttcaccttttccagaatgtcatataaatggaatcatacaatatgcagcttttgagacaggcttttttcactggaaacttgagatttgagatttagccatgttattgtgtttataagtcctctgttcctttttattgctaagtagtattctattgtgtggatgtaccatttgtctatccattcaccagttaaaggacatttgggttgtttccaggtttgggtaattttgaataaaaacctctgtaaatgtgtatgtgcaggtttgtatataattctgtttatttctcctgtgtaaataccaagaagtgggatttctcagtatgagactgtggaacattgttctatgtgtccttaatgctttgttcatttcagccccctctccaagtctttttttgtctttgttcttcacattggatcatttctattgatctgtcttcaagttcactgacttctctattatcactattccactattgtctagccattttttttaaatttgagatattgtgtttttaagtttaatatttccatttagttcactttttattcctctgctttcattcctctgctaggaatgtcaaccttttcatttacttaaatgtgtttgcctttatcttatatagtacagttataatagtcattttaatatttttgataattctaacatctgggttatcttagggttgacattttttattgtctttttttgagacaaggtcttgctctgtcacccaggccagagtgcagtggtgcaaatgctgctcactgcagcctcaacctcctgaactcaagcaatcctcccacctcagcctcatgagtagctgggcctacaggggcaagccatcatgcctggctacttttttaatgttttgtagagacagggtcttgctacattgtccagactggtctcaaaatcacaggctcaagcaatccacccaccttggcctcccaaagtgctgggattaagtgtgagccaccgcacccagcatttattttctttgcccttaagaagtggccacattttcctggttcttgaatgtcatgtaactttagatcatatcctagacactgtgtactggtcctgttattatcctctgaagtacacatgttctcattattatacaaacatgccattttcctctgaccacgaagttttgctcagtgctctattgacctaatgcctttccctttatctcttcatttctacttatggcttaactcactgtaggggaaaactatcatttattaagttcctgatatgcatttgattttgtgttagaatgcagtgttccaattaagggatatgtgtatgtctaatttctgtaggaagaggctgagactaggggacaggaaataacttttccaagatcacatagatattaagagtcagcaccaggtttcaaactcagcaaactctgattcaaaaatccattcctttaccactacctctcccaacttcatgaaaccttcccttcccatatcaaactttaaaataactttgcctcctatacaaatattttaccacctttctcatcacataattctacagggtcactgattgtttaatgtatatctaattcattcagtaagaattaaggatccttgacagtcaaaactgagtcttctatttcttttacatacctttcaaaagatggaccatgtattttatgtgccacaaaatttatgtgccacaaagtagatgttaagtaaatgcatatcaaagagattttaaaaaataaataaaaacctagttaaagggtaaaatatgaggcgtaattttagcacaaagaatagaccatttggaagatgttagtgttgctgtgctataatcagaaaacaaaaatggagaagaaactgttttaattaaccctcctatacatttgcctatagatgtattctgagcttaatggattgggcttaattatctatactgcactaacctttgaatgggcgtcagggctttctcacctcagggatttcttccactcatctcttgaatttccaagcaggggggcagaaagatgagttgtgaccccaaatcttccactgatttactgtattggcatgagcaaataatttaccctgcggggtcttcagttaattttaaaactaaaatgaggaaaacaactcttaaatgtctcctttgaatttgaatgtaaataaaatatgctaaacctaaagagctttgaagacttctaagaaaagctttacataagcttcctttatttctattttaaatattattttttctttcctaaataattttaagaagattcaagaagaggtgacaagatgtcaagatatggctcactcccccatcattgttagacataatttcctgtcttcctggccccaaatgttatcactgtgaggaacaattgtttaaaaattgtctatgtaagagacactatacaaatggattctatggggaaatttttacaaaagaataagacctggtaattcctctctaagaaattgatatatagttgaggagataaaacttgttcagacagaaaggaaactgttatataaggtggaatataaatttcaaatcagtagcataaatgtgccagggtttatgcaatagagataaggatgaagtatggattaagccaattgtttagcctgtgattttgaatgccaaaccgaagaatgtgggcttgatcctgtagacaacagaggcactgaggacttctgaattgcgaatgacctgataatgaggggtattttggaagataaatacagaggaaagaataccggagacaggcagacctgttagtatactgcaattgttcaggcaaaaaaatcatatacacctgggtggggatgttggcgattgtaataatcaccatttgtttaatgcctactatgccaggccctgtcatgagtgcttgacataaattctagttctcacaataaccaggcatgatcagtgttgttgttttatcttgcagatgaagagtttcaaagtgcttatgtgatttgtttaacgagattataaattaagtctctctggtttgtaagatatactacacaatattcccctcaactgattttttttcctttttttttttttttttttggaaacagagttttgctctgtcacccaggttggagtgcagtggcccaatctcggctcactgcaacctccacctcctggactcaagtgatcctcccacctcagcctcctgagtagctgggactacaggcgtgcaccactgtgcctggataatttttgtactttttatggagatgaggcttcaccatgttgcccaagctggtttcaaactccttggctcaagcgatctgctcacctcggcctcccaaagtgctgagattacaggtgtgagccaccacatccagcctacaactggtttaaaagttgtgaaagttaggcggatttgagttatgagcttaggcagcaagattatatttgagtttttatgcctaattaatttgacttttcaaggagaagacggcctaaagaagccagaaaataaatgtggccagtggtcaaatgtgggatcacaagatgattttgagggacaatgaggaaacctctctcccttgcttctttatgcttgaagtcatcttattcgagaaaaagacctcggaggctggtagcctcaagagcagaaacacaatcacttaagatcgttgcaaggcgtttatgaaacatgtcagatcattccaaatgcttttgtctagcttgtccagaaatcaaagcataaggtcagtaggcacctaaatgagaggaacagggaaatcattagcttcataatcattgtaaacaatttataatcattaacattacctcacaatttggttagaagtgaccttttaaagtcagggcacttttattgaagtcgctaggttttctcccccatttagaaaaataaaatgtttataatatatgctcaaaattcatctcttcctttgaagaaagccaaaaaaaaaaaaactttttgtttggatggcatcttttatgctatccccaaatcaagagtgtgaaggaaagtaggtgctcataaagtacacaaactactcaaataccctgtttaaggcagtttctctttcaatttctaaccatatcatttattcattgctggagatggcacagaggtcaaactagagttaaaataagcctaatgcataataattctaattattatagttctaaattgcttcaaggttgtattttgctggagccatacttgaatgagaccttgcaatcaaatagtatttgtgtcttttaatacatataagtatagcatgtcttttcagtgattgtcttaatgttaattaacattctttggtcataaagaaccatatttgacagaagaatttagcaaaatatctgggtaaaaagaaatgttctctagaatagctttgacttttgtgacattttacatggagaaaaataaagtctgtccaacctttcaaccagaacaaataagatgctagttgccaaattcacatggataactctagcagcaaaaaattagatacagctttgtgataaaaatgctagtatctagtggtgatgatgtcaaccaaatcttagaaaagttcacattcttatggttatttgtattagtcttttccaacactgctatgaaaaaatacccgagactgcataatttataaagaaagaggggaaatgccagatgcttataaaaccatcagatctcatgagactcactcactatcaagagaacagcatgggggaaaccaccctcatgatccgattacctccacctggtcctgcccttgacacgtggaggttacaattcaagatgagattttgggtggggactcagtcaaaccatatcactattgattgaatttttcatatgtgggcttcaagttaaaggcccatacataatattactgaaacagtacatggtgaataaggaagaggcagcccctgtcttcaggtagtccaccttcaccaaaacataacatcagtgtcccaaacatgagataccatgcaagtgctatataattattcctaatggatcattgtcttgagatgcatctcctcactccccacatcctgtcctttggaaagtgtggtcactttgaccttctgaaggccttcagcccatctaattcctttcaacctcactaccatgacctcttacttgaagagcacaacagcttcacctgtgtttcctgcaatccaatctcctcagagtagcaattagatgggttcacattgcacagagagcagagcccagcccctggctccctccagtttcaattgctgtcgctcatagtgatgccaccgcatgaccttttttctagtctttgaatgtgcctcactcaacccagatttagccccttgtgcttgcactgcctgcagctcccttccctgaatcttcacagggttggcagtgccatttctttcggatctcagctttactaccccctcctcagagaacctgtccttaactacccaatctaatttaccaccaacacccaccatgttttcttttcttcatagaaattatcaattatcttgttggtgtgtttgctcatggtctctcctccactacctcgcagacaccctggcacaagggtccctgattctcttgtccactgctctgtctccagtgcctagatcagttcctggaacaaggtggcccctcagtgaatatgcattgaatcttcataacaatcctgatttaatagtgttgtgttttcttttcaaccgtgaaacttgagttcctaaatctcatgcccctgcccctgccccaggatagtagaactcagagttgatatatttaaattttgtgaagaaaaatagaatgaggaaaaagttgagaaaaagggagactacagttccaaattagcctatagagtcttaagcttgtttaacccaatgcccacagctgcatgtagcccaggacggctctgcattgctgcccaacacaaattcgtaaactttcttcaaacatgagatttttttttttgcacttttttttttttagctcatcaggtatcgtcagtgttagtatatttcatgtaaggcccacaacaatttttcttcttccaatgtggcccagggaagccaaaagattgaacacccctggtctacataaatattctacatggactaagtttcagcaataaaagtaatacactaaataaaagggaacataatcacatttgacatgtcttaacttagtaattagagattctaaatacctagttcttgtttactggcgtgtacttcctaggctttctgtaggaactccttcccttgttccttctctaaaatgtattgaggtttccaagttccatatgttataaggctttgtttaatccactcatgcaaataaatcctattgttttatcatcaagaagtatacaagaacattgctgtgtgtttccctgtctatgcccactttcgactaccaaaagcacaatcaccccagtacatgaggcagcatgatgtaatggaagatactaggcatagaggtttggtttaaatatgagtctaccactctcttgttttcatttaatctctccaagcttcaggctccatatggaaaataagaataataactaattctcagggttaattctaggattatgtgaacaaatatatataaagggactttatgaattgggtgtggttataaatataaggagtgtcatcatcatcagtattatcgtcagcagcagcactatcaccatcaccatatttgagctggatcagacattactggtgatttttaattgacatataatatttatcttctaccagaaccagtctcaaaaaccaataaggcagtgtaggtaagcagttaaaagcatgggcatgataatcaaacctacttgagtctaaagcccagctgtgccacttactaggtaggggacttctctccagtgacccaatctcactaagactcagtttcctcacctgaaaaattagaaaaataaaattatctctaccccagtagcaagaaatgtggattaaatgaaaaaatgcccagaagggagtaatatatctgacacatggtaagcaatcaattatcacttgtgtaagtagtgaattcccacagagtaaaaaatggaaaaaacatgctgttttattaaaaaaaaatacattgttgtccagagtaaattaattacctttaaatcctcttaatgtcatggatttgaagggttgcttcttctacccaaaacaactgaattcagcagtaatgaagttatgctcacttgcagctttctactgaaatcctaaacttcctggaatcttcacctacatatccccaagtcatccacatccaagcaccttccatgagtctccatgataaggctcattcccttcctccccagaagtcgtgagtgttcatggcatgaagtacttcttccctcagaaactcaccaatcttgctgaccaggacaagatggcaagagtggggaaaggactgcagtattggctcacatgtgactggctacaatgatctgcattttgtacaagttgtgagtccatggaatcatttgcttgctgtacaatctttttttattgtggtatatatacataatataaaatttaattttatattttaatcattttaatcattttcaagtatacagttcagtgctattaagtatattcacactattgtgcaaatatcaccaccatccattgccagaacttttccatcaccccaaactgaaactgtacgcatgaaaccataactccccattgcctccagcccctggtgtgttgtttctatttttatttgcctgaagatactttctaattttccttgtgatttcttccttgggccattgattatttaacagtatgttgtttaatttctacatatttgtgaattttccagtttttctactgccattgatttctagttttattccattgtgattagaaaagatgctttgtataatttcagtccttttaaatttattgagacttgttttgtgtcctaacatatggtctgttctagagaatatctcatgtgcatttgaaaagaatgtgtattctaccgttgttgggtggagttcaatagatgtatttcagtctaattgggcatatattgttcaaatcttctatttccttgttcatcttttttttagtgctctatccattactgaaggtcaggtattgaagtctccaactattattgtaggaatgtcaacttctcctttacattctgtcaatgctgcagatatttaggaagtctgatgcttgaggcatatacgttgtaattgttaaatctgtttgataaattgaccctttatcattacataaggtccttttctgtaccttataacagttttatacttaaagtctataatattttgtatgatattagtttgccatccctaccctcttttggttactgtatgaatgaaatatcttctattctttcactttcaatctattcttagatataagatatgtgtcttacagacagcatgtaattgggtgctggtttctaaatccattctactaatctgtgtcttttgattgggagagtttaatctatttatattcaaaataattaccgataaggaaggacttactattatcattttgttgttttctgtatgtcttttagctatagcgtccattatttcctctattactgccctccttagtatttagttgattttttgtggtgacatgttttgatcaccttctcgtttccttttgtgtatagtctatagattttctttttttggttaccatagggattacatataacatcctaaagttataacaaaactttaatttcaatcacacacaaaaactactcttttacaactgtactcattcactttttattatggatgtcacaaattatatcttcatatagcatatacccactaacatacattcatgttatttttatggatctaccttttaaatcctgcagaaaaataaaagctggagttaccaaacaaattataatttttttatatttattcatgtatttacctttaccagaaaactttatgctttcatctggcatcaagttaccatcttgcatcctttcacctcaatttgaaggactcccttaaaatttcttgtaggacatatctagttgcaaggaacttcttcagcttttgtttacctagtagtgtcttaatttctcccacattttgaaaggacagtgttgccagatatggaattcttagttgacagttttttccccctttcagttctttaaatatatcatcccactgccatctgtctgcaaggtttcagctaagaaaagtgttaattatcttattgagtataatgtgtcttgctatgggtttaagtttatcatagttggagttcattcagctgtttgtatttgtatacacgtatctttcctgaaattcaggaagtttttggccattatttcctcaagtaatccctctattcctttctctctctttcatttttttttttactggaacttccataatatgtatgttagtttgcttgatgatgtctcataagtccctcaggctctatttactttttttcttctttttttttttcctcagacttgacaatttcaaatgacctgaattcaagtttgctgatttattctacctgttttgagtctgctgttgaaccctctggtgaatttttcaattcatttattatattttttagctccaggatttctctttttaaaaattttatttctttcttgatattctaattttgttgatacattgttttcctgagtttttctttttagttctttgtccatgttctcttttagctctttgagcatatataagatagttattttaaagtcttgtttagtaagtctgatgcctgtgtttcttcggggttggtttctggagatttattttgtgccattgaattggccatgtttgtccatgtctttgtatgccttctgattttgttgaaaattgggcatttgaacaaatagccacccctctatctttgcaaactggctctatggaggggaagaccttcattaatcagctcaaactgaagacttaaagtcttctcaggacttttctgggcatgcctctaccttgggcctatgagtgtgctttattctgattcccccatatacatggctgcttttaaaaatcttaatttccctaggagtttcaccccttttctttctcatgaccttagctgttctattgtatttctcaatcagtaatctctggcctcaggtatctgtgggtgtgtagtccccttgcgattttcttgagttataacaatagcctccaatggctttctctagcctgaaattcaagctgtgccacttttggaagtctgagtgctgagttaggtgacacagagaccattatctgaagatgtccccagacaaggtagaatgttacaaatttggtctgattcacactcctggtttgtagaaaggagctggggactggagcactgctttccccagactgtattgcaccacatcaaggaggggatggggcaaaggtgagtaaaaatgtcatgaaatgttgtagcattttaaatttagttttctcttaatgaggagattggttgctgtatatctttgactgatttacagtgctcctataaaattattttagccactctagttgtttacttaatgttcacctgagagaacaaggatctggagtttcctagtgtaccatgtttctgacatcactatacaattttaatagagaaaaatgaaagaaggaaatgaaagacctactaattaaacaaacctaagttataaacatagaggacattacctcatagatgtcagagaggactgaataacctagaatggtgaagctcaagtgtttggtaatcactatgaagtgattacatagaagaacagaagtgtctgctgctacatatggggtaaatgacttcacaaatacatttatggaagtccttagcatgtctggaggatataaattaaatcaggagaactggcataagtgcacatattaataagacataattggagcttagggctgggtcatgataacatctccatctataacagtttctcaatctgtggccctcagagcagcaggatcaccaaattcttgatttttatccctggtctactgtttcataaattctgggagaaggctcagcacttagtgttttaaccagccctccaggtgcctctgatgtatactcaaggttgatctgaacaaacttgcagcaatattcctggacccctctcttcactcccaacttcatgccgtcataaagaccaacctcatatacctgtgcatttcagaattttaaagtaattttaataaagcaactgatgacctgatggcctgagatgtgtatgggtgcaggtgtacacatacagataatgtgtgggccattgctagaattactgtcttccacaggaggaagtcacactaaaaaacaaaatttccctcagacacatgtctgaaggactggggttatgtgacctctagtcctgtgtgaaaatcaagcacttggagctaattttcctgggtcctttgctaatgtagatactgttcctggatgacttcatactgtttctgggtccttcatccataggctttggatcagctctttagagatggatagcagtgtacaagaaaagcctcagcctatgaaactgctccatgtatggcagggtcagttctactgctattaactctggaaaaattttagacaacatagggcctggattgtagacatgacctgggtctaaactcagatggctgctgtcagtacctgataatgttttcatctatgaataaaaccatgaagcaagcccagaggcaataaagttaacaactatattaaggaaacccaagaagcagaaatctaaattcactaaacaaattatttgtggggtgcatatatttccaaagaatcatttacttcacaaaatgacttattatagaattatttgaagtagagagcttctttgaagtactatgcagcagtttaaaaaaaaatctttatgtgaattagacatacacatggcaatatctatagatcttaaaaacatgacactgcgagaaaaaaataaaggaaaatatttttaacaaaatatcatttaataaaaaatgcatgccaatagaacaaatgcaaaaacaaatgccaataatgtcaatgtcttagagtgtgatgcatgcaattatcatgtaaagcagcaatcccacttatagttatttattccagtgaaaggaaacctatgttcacacaaaatcctgtatttgaatatttgtagcagtatattcataattgcaaaagcctggagacaatccaaatgtcctacaaagggtgagtggataaacaaacttgtacatttatgcaagaaaactacttggcaataaaaagaaatgaatgattgatacatgcaacagcttgggtagatctcaaagacattatgccgaatgaaaaaaatctaatctcaaaatgttatacaccatataattccatttatataacattcttgaactgtcaaagtgtagtgatggaaaacagatctgtggttgtcagggttagtgttggtggtggttagaaccataaatgggtagcataattgagttaattttggattatctgcatcctaactgcagtgttagttacatgaatccacatatgttataaaaaattttatgcaactctataccaaaaaaaaaaaaaaaaaagaaaagaaaaacagagtacttataaaagtgggtgatatggtttggctgtgtctccacccaaatctcatcttaaattgtaactcccacaattcccatgtgtcgtgggaggaacctggtgagaggtgattgaattatgggggcgggtcttttctgggctattcttgtgatagttaatgggtctcacaagatctgatgggtttatcacgggtttccacttttgcttcttcctcattttgtcttgccgtcaccatgtaagaagtgccttttgcctcccgccacaattctgaggcctccccagccatgtggaactttaagtccaattaaacctctttttcttcccagttttggatatgtctttatcagcaacatgaaaacagactaatacactgggcaaaagtcaaaataaggtctgtaacttagttaatagcattgttccaatgtcaatgtcaataccttggttttgatcattgtgctatggttatgtaggatgttatcactgggaaaagctgagtcacatgagaactctatatactatttttttcaatttctatgtaagcctaaaactacttctaaatgaaacgattttttaaagaacaaatgacaactaaaataatgcatattaaacacattttaatggttgcctgggggagaaagggaaggcagattagagggggagggagaaagatattccagagtatatttaaatatttgatttacaattttggggggtacactacaattctctattattaaaccatcagcaccatgaggtcaagaactggtttctcccagtgactagcctagtggtgtgcatgcatcaggcgcacacgaacctttattctattattaaacaaatgagctcctgaacatgtatttatttcatagctgaactccataaagcaaataatcctaaacttgcaagggtttttttggtggaaatcttgacattttaggaatacttactttaaatattacgctttatatttgggtctgaaacatttctgtgtgccgcagttacatcctggccagcctttacccaacagtggatgtgactgccatctatatattcagaaattcagtgggaaacagcagatggggagccaatttggtctcatcactaaaaagggccctagtgtctcctactaccaaaatttgccttttatcagaaaagaaattatagtccctagaaatatcaacatgggggtttctggaacccaagctggacccttgaagagagtgccccattaatcaagtcatggggttttgtttgtttgttttgctcaccagtttttatattttctttatcctcctttccaccttaagagggtctgcatgcaatttaatatttctttatgatattttatgaatcagggccatgtttctcaactagtaattgcagtcctttcatgtgtaatgaaggctgctcagaaatgcagcaagctgtattttctcttccttgttgccagtttatgcctgggaagggtgaaaacatctaggagggtatatcatattaacaactgaggtggaggaaagacagaggccagtgaaagagaaagaacgacaaagggaaacgatgaaagaattgtatgcagtggcaggggcaatggtaagataaacagctattttaataaattagtaaatatgaagggagtggctgtgaaaaaattacataatctgaaaacatcactgaaatacctagaataaaggctttttaaaggaataccctttgctagcttgtctcagctctgaatcctgtggtccttttgagaacaggataagtagttttcttattcttgacaggaaaggcagaatattttcctcactatgttatgagaaagtcataatatgtgacatttggttaccttgctgccatattcaatatgaagggtcttccttttgctatgaacagcatgtctcccatattgtctcttgcctaagctgactggaatcaaaaactgattacagaaataggccaatttggcctgccctgtacgacaaagctaattgaacaataagaaaaaaatgtaaaacttttgtcaggcattgtgaaaagggaaggtcacatggatattagagaaatcttctctttaaaaaagaatctgttttttaaaatgctaattgctttcccaaattgtgttttaaaatttgcatcttttatttgggcaactgttgttttcctagatccccctcccacacaatccttggtgagaaaaataaagttattgattcacttatggtaaacgtcttaccctgggtccctccaaagcccagcctgtgacaagagctagtgtgcatgtgctgtattttgggttgtggttccagggcaccagagtaggagccaagaaagcggcaatggctagcccagggtgcaatggcaagctggtcaccactgtggggcatgggagctggacacatggagacaggatagaggggggcatttatccaataactcctcccatccttcctggtcaaggggtgccccatcacatgttgacaccctcttatttacacattgtttctgacaagtcctgggacaaaaagtgggagcaaacactgcaactcaacaagatgtggtcaggttatacctgtgcaaagccaatgacattggcagtggctggagtacagctgaactgggaggctggccgcaatacagtaaagagaaccgagaggacacaatcatcagcacttgaagcctgaagctcctcaaccaaattaagctttaggggttgatttttggatattttggatttacatagacaatttaaaaatgctcaagaaaaatcatacttgattgtttggattccagacaaagctaacatttcttaggccagtaagattgctccagatgaagttgagcaataagtaaattgaactgtttaatgcagctgttgaccagtagatagtttggtgttaggactcacagcaggattccttctagaaaccagaactataaaggctgttcagaatgaaatagtatatcaagttcaactgcatattgagggaactagatagttctgactcaaataaaattttaatagaagaacagaaggcaatttaggcatgagtaactgacaaattttcctggactggaaacgcgaggctgtttgataacataggatgctgtggccatggggctggctgtgtctgaagggcatgaactttggaggccaacacaaatggcatctatgctcagctccacttctcattagctgtggaaactttacacgtgatctaacccccctacagtgaagactcctcatgggtcaaaaagagtaagtagcaccactttcataaggcttccgagaaggctaagaaaacatatataaagcattttaccaattaagcacatattttaggcagaaacactgttaatttcctttgcctgatcatgcgtgttcattccggaaagctgactggcagaagcaaaccttacagctgcccacatacacagtcatgcctcactttgatgcattccttcgactgcccctcagtcaccattcatagccaagtgggaagtttgaatctgggtgacatggcaccttctttttctttaatgttagcaagtttaaatttaatactaggctttcataaaacaggaggacgtaggcagtccttcgttatctgtgcagcatgctaaaaattgtgtgctagacagtaaattagaaaaaactgccctataaatttcaattaatcttactttagttttaatatttaatatgtcatcatgaatcacatttccacaaaccacactggaagttcagaaaaagaatataggaatgtgttagatttttactattatgttttttccaaaaaaaacaacaacaaaaatgctattccctaaataaagcatgaaatcggttggattttcctctatgacctgaaaaagaaaatcaagtcttattgtccactggtgttgctaaattgaatccaaagcatgacatataacttcagttcataaatgaacagaatggttcaaattatatcctaaaagaatacgtgtacatgcccattctgtattgatttattttgtgattaaaaacaattggctaggaggcactggttgatagtaaaatatgatatggcacaaaaggaaggtctgtatagcacaatgctcaaagacaagaacaaaagaaatggtttaaagtcctttatatttgaatgcatacatagttaactgtaagctcacagccaacagagatgcatttttagctgaggttgtgtggtgtttggtggtggcattggttcttgacacattgtgcatatgtgcatgtgtgtgtatgttagaacctcataattcaactttaagtttcaattaatgaatttacatttagaatgatgagttggataggcacaaaggagagataaactatgtacaacagaatcaccagcctaaggagcttgtaatcaagtgagacagttaagactaaatagcatatgaagtaatttgagcaaatacctgttgcactggcttctgctcaccaaagagcagatgtcactaactgacaccagtgatcccaaaggccagctcaggatccttcccagcgcagtcacctccagtgggtcacagttaggatgcacaacaaaatctatttctcattcatgaattagggatcactcctcggcatcaagacttttcattccgagtgagttcagtagaatctcaggggacaagagtcactgtggtaggaagagcagttagggaaagcttgagctaaacctgaaggaatggttcttggatttggtcatgccttttgtataaggggtagtctctaccaagggaggaagcagtagggacatgaaggaccagggagagcagcctgcatgggtcacacatgtgtcaccgcgcagagataacctgtgaagctggacctgataatcgacaacctgaagaactcaaaagaagaatcaagacacagtgggaaaattaggaaccattctggggtgtttgagcatggaactcatgtaataccaatggtacttttggaggatttatgtctagagaaagaagcacatcattgggggtgctgcggggaacctgtgatacaactgagatcaggatttgagtgcaagaggtttatttaaaggtggtcccaggaagtactagtcagagaatagggaaggggaacacacagagaaactagtgtgttcataagcaggtcacctttgtgggcagctgggacccaagcccactgggactcctctgtgaggcagtggtcagaacccttcagaattacattacctggcaggtgggcagcaggggtattgatgctcccattcccacttttcattggcagagggctgctcccagggcattggctctccagtccttttaggctgccctgcatgaggtctacaacaaaaccctcaggatgtaccagagtgtgagtgctacaggaccacaggcagagacatgtctcagggtacctgtgccaggaaggcgccctggattctctgtgtttccttctgtccctttccagtaaggatatttctgactactctgcaatgaagaactttctgaagacatctgtgtcatttccaccagcacacccaccaaaaaaagatgaccaaagagcatgtaggtttagacatcatggaaaccttatcttcaagttaatttcaaaccgatgccatttaatttcctcctaaccccataggtggacaacaggccggctttcaaactcttggccttgggaaggaagagacctcctgaacattcacacctccctgagagaagctggatccttggcccctggggccgcctgatgtatttaagcatggtgccttttgaagtaaaaccctctcggtgggcactgaacccactcatagtaaggatgcacaggaagacattaaggctggcactgtaagtgagggcagtctcatcttgtcttatggctttaaataccctaacatctcccaaataatcccttagactggacctgaattccaatgcatgcatccaactgtctactcaagatctctgcttgaatatttaaaaagcatgtcaaacttaaactgtccaaagctcatcatgatctgtggatctcgcatctaagttgccccatctctgtaaatggcaactctatctttccaggagctcagggcaaacatcttggagtcagcattgcctcctctttctctcacaccccatgtcttccatgagtattacaaataacgtgtaacatggtcacaaatcccactggctttaacttcaaaataaatacccagaatctacccagttcctcactgctattgtgcaggtcctaacaaccatcatcacttgccaggttattgcaacagcctgcctctgactctacactcgctccccttcatgccattctcagcacagctgctggaagtcctcatgagatgttggcctcactgtgctcctcccctttttaagccctctaattgcttcccatctcactcgcacagtccacacagtgcccaccatgccctatgtgatcagaccgtcccactgcctctctgctctgatctcccactgccccccaccgatctgctccaccactcatctccctgatgctcctggaatggaccacacacactgccacctcaacgcctcctgttcattctgcctggaatgttcttccagattttaaacgaagagggcttgcttcctcttcctcctttggactttgacccaggtttcacctctctagtatatttccctgccacacatctgaacttgcaagccccgtgaaactccttactttccttcctgtcttacttcattattggcacttagcataaacttgtatattttatcttgtacttgtttattgcttatcttccccatctaaaatgtaagtccctatttcatttgctgctgtattccctcgagaggagtgttgatctccaagtaggtgctcaacaaatacttgttgaatgaaagagtagaatgaatcaattgttttagtcaaaggagactttccttttggaaacactgaacttttgtctgtaggcacaatgcctaggtaaaattctttatagtacctagcttggaaagtgatctcagaaacttttctcgagaagggctctgcatgctgctagatgctttgtatggaggatcatccaactcctgccatggttagcacattgttttcaacagcccatttaccaaattcttacacccagttgtggtatgatgattttccctggggtgctaaaaacagttgagagcaaatattgctgaaccaataagataagaaaaattatggttcttatgatggtgaaagcttttcgccctttcctggactcatcttcatgagctgctctgtgctatattccacggaagccatttccagaaacattcccaccacaggcatgggcaggctgttggcacagggagctcagatgctttcctcctattgaattggtctcacagcctctgaaatgttggcccatgaagcctttcggcattccactctcagaaattagctgcccacatgaaacagtgataaactgtagaccaaacctgccaatgtacgctgggagcagacaaacattgtctgctctcctcccagaatcttgctgcagagggcacagttaatggcccctgcagactgggctcatgcagagaaggggcattgctgctttcaagaaagtcctcctattcacaaccactaaagtatttcagactcaatctagccagaccttgggttcttttattctccatctttgcacaacactgtattttatgttttctaattctgacaagattctggagagacacagcttgaatttcttcttcccctagaatggatgaatgaatgaataaataatacaattataatgagacaataatgtgcacaataacacactgccttaaaaagaacacaaaatgattgcatttggacctaaacctctgaaagcgttcagatgagatggggtgtggcaggtgaaggttgtgtggctgtagatgctgtaagcatcgaagctcttggaagttggcactttgctggtgaaatcaatccctgtgatgtgcactgcttctggacacttcagacaggacctcagggccaccagaaacacacaacaccccaagttgttatacccccactctctctctcccctccatacttggctgcccaatggatgtgacgggtcaggcaccctaggcctatggatttttcagttatcttttaaaactataaacatccataaatctgctaaagtgaagcagtaaaatgctataaggtagtgctgtgactttaaaaagaatgaaccactgcacaaacacatgcacacagacactcggtgctttccttatttatcataaaatcacttgaacagggcttaggacaaaggttctgattctatcacgatcactgcttcctgagttgtgagaacaaatattctgttaaccctgtctgttttttttttttttaatgtggctaataatttctgccagtagcctcttaatcatttgaagacttggatcacagtcaccatgtcaatattatgtcaaatagtaaccactgctctatttacttcaagccactcttctccatttgaatacacattttactgttaaaatatttgcatgtaggagctctacagaagaataatttggggagaaatgctgcttttgttaggtacagttgctatgaggcgatgcgagtgcatagagaaccttccttccaagttcagcaacttcctctcctatttcagccggactcaccaagttgcccaagaggccctggccatagtgcctactacaggagaaattatttaatagagaaaaaacttctattacttcctcctctaggtctaaggaaatgcctgaagagtaactactcatgtaaaaaatatcttcatgagagatatgtataaaatttaagcaaaacatatcccatagataaatcttgttttcacataataataaaaaggagaccaggtgcagtggcttatgcctataatcccagcactttgggaggccaaggtgggcagatcacagcaatttgggaggccatggcaggtggatcacttgaggtcaggagttcaagacaagcctcgccaacatggtgaaaccctgtctctactaaaaatacaaaagttagctgggtgtggtggtgcacaccacacctacttggtgtaatccccactacttgggaggctgaggcaggagaatcacttgaactcgggaggcagaggttgcagtgagccaagaccatgccactgcactccagcctgggtgacagagtgagactccatctcaaaaaaagaaaaaaaaaagaataaaagaataaaaaggaaataaataaaaataagcctttatgaaatacaagatgctgaataagtatgactgtactttgtgtaagcttacaatgccatacgccatgatgtgtagccactgaaatatgatcttctttgagggccaaaattaattctccttatttctatctaggaaggagatggaggcaatcaaagtgcagctcatgggtcaagtgtatgcagagaaacctaaagcctcattagtctgagagtcagtgttgcccttgggaagaaaaattaaagtgtgcttaaaaaggaaaaagtggtcaggttcaaggatttcttggaaggccctgtgcatattccccatctctcttttcctgctgtgaatgttcgtaacatcagcatgagcgggacattacatgcacactcattgctttgggagaagtttggtgcctctggtgagaggtggtgtgcttggggcactgagacaatgacaatgaagagtggagtgtgggtcacagcctgctctggtactctcagggtggaagacagccccaactgtcccctatgaccatgacccctaatgcctgtgtcaaatagaaggttatccaattcattcactttttttttgagacaaatactgcatcatttcacttatatccagagaagatatctagagtagtcaaatcccgagaagacaaagtagaatggtgtttgtcaggggctggggaaagaggaggaatggagaatcgttgtttagtgagtatagaatttacattttctttttctttttttttttttttcttttttgagacagagtcttgctctgtcacctaggctggagtgcagtggcacaatcttggctcactgcaacctccacctcctgggttcaagtgattctcctgcctcagccttccgagtagcagggattacaggcatgcactaccacactcggctaattttttatatttttagtagagactggcttcaccatgttggccaggatattctcaaactcctgacctcaagtgatccacctgccatggcctcccaaattgctgggattagaggcgtgagccaccacactcagccccgcttcattctttctccctcaattcacatagttttttcttcctttggatgattagtgggaaataaagtctaatcttgaaacaagagccactaggaaaatgttctaccatagaatgtaggccagaattttaagttattgttactattattcaccacagaatggagaaggcagaagcctaatatcctggtactaaaacaaggtggtgttgtgagtgtccttgttgcttagcttacccatcttaggatgacaagtcatacaattttcttaagagtaacaaaaacagaaacctgttgaggttatgtgtgtgtgtgtgtgtgtgtgtgtgtgtgtgtgtgtgtgtttagaaagctttgtagccaggcaacagaagaaaatatcacttgctggaatcactgtttagtaatgttgtttatttaaagatcttctgcacagatttcactctgtatttttcagacagtaaaaataacaactgataacagccaaactgtttaatgtacaaaagatagcaaaataaaattcaatattagaatatatttgcatagtatcatcataggtattaatgatttcttattcagctatggatatatcagcagttaatgtaacactcggtcaaatcttatttagggattgaaatatttatcttacatatgaactgtctgaaacatgactcacatacatcccatttccccacaagtaatgtaaggattatgtcaattatttcaattttagattaaatatgtactagctatgtgatctttgacataccagatgtttgagatttccctgccaagcttgtcacttaggccatattatgtttcagtctgaacttagtgacataggaggctgtggtttgagtccatggtgctgtttagcacttggaaaatactgatgaaaaggagctgagaatttaaatgcaatttacatgttcagaatctcactggacttgattttgtgcctgtgttgtggaggggatgggttacatataggtgtccgtgtgcatggtgtagtggggagttatgcatgtgtgttttcatgcacatcttcaaaaatgctaaggaaatcacaaagtcaagatgttgttggattgagattatgtggataaagtcagtgcagaattcttggtgacctttgtgatgtaaacaaaactatatcttcccttagcatgcttcccagggcaataaataataagactgaccatatgagaaaatgaatcagtcatatggtaaggaaagcaagtgtcttgtaaaatgtgtttacctctgaagaggaggcagaacacattgacatttcagagagggcttttatcgggaacatctcccattagcactaatgagagctgggtatttaatccactgttctctcatgctcatggcatatttcatccttgatggcaaggccttgaaacttttttctgcctttaatgatactctgtggtagttatgctaaatttttagctgtgtatatggctttctgtgacttctctctgccatctgtataaatatctaagtggaactgaagcttttcattactgtgaacttccctgaccaacctctttagagatattttcttacaaccatgcagaatcctcaaaaggaaaaccttagtgagccccaacctccaccctacctagcccccagcctggattccctggatttcaggaagcccagaaatcagcttgtttctcagtaggatggtgacatcttcgtcttctcctctggaaggtcagtcgaagcccagatactgattaacagactgatctaacccaatgtgacaaaacaccatgccggataacatgcctagagaaaatgacaaggaccgaagacgttaaatcacctcagttatgaggggggaaaagaccagcaatctagaggaatccagaacatcaagagccactgttcatggcagcgtgcttgtcatgagtgaggcatgtgtgtgccaggcacatcctcccatctaatccccacacagcctgtgagggagggacagccatccctgccttctcaaggggtaattctggctcacaggatatcgtctatgagaaccagaaggaaataatattttctagatacaatcagcacagtttccaaggagacaagactgcttggcttttctcttcaagtgtgcaaagggtcattttccagggactggctgtcagccatcctcctctccccagtgtcagaagtggacatggggttacaatataggacatgaggttacaatacaatccaggaaggacctggatagactggatgaatagagataatggataggtagatgatagagggagagagagacagacaaacatacacacacacacacacacacacacacacacagagagagagatgatagataaaagagacagaaagatacagaaataggtagagatctagatagagtaacagagacagacagacaagtagatagagatgtttacatagagatatagacagatatacagatagagagatagagatggatacagatagacatatagaactagataaatacagatagacagagagaaagagatgaaagagagagtggtttccacagactttgagttctctgatacaagctgacccacacaaatcagagtctcaagatgtcttggagcccaggtagctgaaaggaaaatccaaagattaaggtatcattgctactttgattttactcctgaaaaaaatcaacttatttttactgacatctaatatttacttattgcttactaggtaatttatgtacatcatctcatcttatttttaattagtcattttttaacaggatggaaacctaaagtttagaaattagaaagtaattccccagagttctggaactgacagagccatgattgttcagaactgaagtccttaacctctgcacctattgtctctcagcaaaaaagtacgtagaagactgggaaatgcagtaaataccatctgagcgtttttgctatggtgaattccagaataatgcaagctggacagatgtaatgtatgatcatggaacctggtattgggatatcggggaccttggcccagcttccatctctcagccatatcaccttggacatctgatccctacatccctccagcttctgcatcctctgattccaagctagaatattatagtataaaatatgtggtaggaatttgtcagtgattttgttaccacggtccgtgttaaataagccaaatttgaggatcagcgcctgaaaaataaacacattaaaattgaaaatgacgttcaggcaaatcacagaataataaatacaagaggctaatacacaccaacgaatgttaaaccttaataagaataaaagtcactaatcgaacatgcattttgtccacccatataattggcaattttaatgataatacataagggtttaagaaaataaggacacttatcactaccaattagtacagtctttctagagaacaattttacaatatatatcaaaagcttaaaaaatatgaaagctatttcagcactttagctacatgaaagtttattacagcattgtttatgaatttcaaaaataacaatgacacatgatcccaccactgagagatcatcactttaatattttggtgttaaatgtcctaaattttattctgtgtgtacacacacacacatacacacacacacttaaaattattaatgggatacattggctatactattttaacctgccttttgccttaacaatatacaatgaatggatgtgttataatttgtttaataccttatcattgggcatttgggttttaaccattttttgtactataaataacacaatgctgtatatcctcatagctaatcctgagtgaatttgtgcgtgctctttgcctatagttattttcaaagagcaagagcatgtgcaggacaccagcctggcacttcacatgacccacccgcccctacttcctaagggcaggacttccaggctggtagatggaaccttaatctagaatattttcctgtgtcattctttgtaagctggacccatcaaggagttgctatgttgtatggaggtctttcctccatcaaaaattcaggcattttaaaactccccatctaaaagtaaagtttgatacgagctatatagcacagatgaaccttgaggacattatgctaaattaaataagccagtcacaaaaagaccaatactgtatgattccacttatatccagagaagatatccagagtagttaaatccagagattcatccagagttaaatccagagaagagagaaagtagaatggtagttgccaggggctggggaaggaggggaatggagaattgtttagtggatatagagattatgttttcttttctttttcttttctttttttttttttttttttgagacagagtcttgctctgtcaccctggctggagtgcagtggcacgatctcggttcactgcaacctctgcctcccaggttcaagtgattctcctgcctcagcctcctgagtagctgggattacatgcgtgcgccaccacacctggctaattttttatgtttttggtagagatggggtttcaccatgttggcaaggctggtctcgaactcctgacctcaagtgatccacccaccttggcctcccaaagtgctgggattacaggcatgagccaccatgcccagccagtgtttccattttctaaggtgaacggacttctgaagatgggtggtggtgatgtttgcacagcaatgtgatggcacttcacactcctgaactgcacacttaaaataattaggacggtaaattttatgttatatatagtttaccaaaattaaaacaaaaaaactccccattcaggacctgaaaatagcttttatttttttttgtcatccttggtttatagatgtttgaactctgtatgtgcagtattagaaggtttgattttgtgtcttattatgtgaaactctgtgaaacctaatactggttgttttattctattggaagaaacctgtcaccaggatcagattaactgtgagctcaaggtgctataaaaacaaacgtctcattgtaccagaagagttcaagtccctggggagcatgtttgtagctttttagcctatagaaacaaacagctgggagtatacatagccttctcccagaaaaaaactggaaagaaagtagctcagggaggcatttgtgggagttctactgaccatggaggtcctgaatttaaaccttctgttagaattgcaaggaagtggagcatttattcattaatttgttcactccctgcaaacactgtctgtgctttcttcacaagatagccaactcttacatcttcacacagccaacatcactggcccccctgatcaaagccagcatcttttctcacctggattattgcactagtcttccggccaatgcccctacttttctcctggccctactatcctttattttccatacaataaccaactttgttaaaatgcaagtcagattccctacttttccattcaaatctctccagtgacttcctgtttcccttggacaaaaacataaaattgcaaatattgcatgtgttcaatacatactcattgaatccataaaaggatgcatgttaattgagtgcttattaatcatcagaaactgagccagatgtttctttataggggtacaaagacaaatgacattctttcctctctgggagtttatattctagaatatgagatgaactcacagatgaatacatacaaaaataatgttatttttccctagttaaagtctgagtaaagataatttgggctcaaacaatggaatggccagttttacccgggtggggagagaggccaagggagagggaattcttgagtattataaaatagtagagattccagcgtgataaggaatgtgtagaggcattccagggcaggagaaccacatgagcaaaggcacgaggtgtggattcatctccaaggagcagggagtgtttcaatgagtgtgggaacatagaatatgggatagggcatagaggccaaaggttaggaagaaaggttaaaactaaaagttttaaacttaaatgccttcatttgcattgattgactttactgttttgtcttctaggcagtggggagtcattgaggtttgggtgatggaaattggattcaatgtatgtcacagacaggtcacactagaagcaatgggaagaatccattagcgttttcaaagtcaatcaataaatagtaagaactagcatttactgaatgcttactatctattaataccaagctctgtgctgagtccttcacttttattacatttaattctcaggtcaacctatgtgattggtactgtgattttccccctttaaagatggacatattaaggcagagagattttaagcccaaagtcataccattagtagattaaagaaccaaaatagaaacccaaagaatctgactttagtaaagggagaggaaaagaaatatattaaagagataaaagctccagaatatagttaccagatgtaagtagtaaaggccgaaaatgccccctagatttagcttaatggatggacaacttaatggatggaagtgtctccccagtatagcaaatgggacaaatttagaaagaagtctaacaaggtgttttgaatatgtttgcttttatatgattgcaggaaatctggaaagtagatggggacatgggtttgaatctcaggtgagggttggagtttgagatgcagacttggaaatcattaaacaggggaggagaagtcatggagtgaacaagatcaaacactgatagaaaagtgttagggttgaatcgtgtcctcccttacagatactgaagtcctaacctcatacctgtgaatgtgaccttattttggaaatagaataagatctttgtcatgatcaagtgaagatgagatcattggggtgactcctaatcagtatgactgtgtagttatataaagaagaaatttagacacagaaacagacacacacacagggagaatgccctgtgaagaagacagaaattgggatgatgcctctacaagctgaggaatgccaaagattgccagcaaaccaccagaaactactgaagggtggcatgcaacagatgcttccttacagacttcaggaggaatgaactctgatgacaccctgatttcagacttccagtcttcagaaccgtgagataataaatttctgtgatttaaaccacagtctgtcacactctgttaaagcagctctaggaaactaatacaaacaggttgcatattcatggagtattcaaggatgattggtgatgatcgaatggagactatttattcaaaaatgtgcctggcagtcagagaatcaggaaaggctattccagggctattccaagcataagcatgtgaacagccatggaggtagaagaaaggaaacaccagcagttggcactgagctcatcacaagctgcagccgtgcagcggtgggagaaagagatctgcccatgaaagtccctgtaaagtgcacgatagcaagcttcaccttagagttcatacagagcagccaaaggttcaagggaatgattaaagccattttgtgttttaaaatggtatgttctgcaaatatggtgacaatggcaacatcattctttagtctaccaaaattatcgaattaaaataggcagagcaactaggttgataaaactgaagaattgtggatgataaaacagtgttgagatacccccataattacctagagacaaattagtgacaacatgtaagagccaatgtgatatcaaaaccatgcaggagaaagcagagggaagaccttgagaaccagatactccctgagaagtgccctgaaccaagctcagagtaggaggagagatatggagggagggtgttctcaatgatccaatgcaggggtgagtccaaggaggccacagtgcaaccaaatctgatgctactggagcaggctgggtcctttaatcccattaactaagaaactgaaggcctttcccaaacaagcctccatactgaggagaatctgctgggaatagattccaaactgagtaggacagggacaaccgcaaaagatgagagagaatgtccaaataaaaggggggaggagcagaggcagctgatagcagaaagtaacaagtgattctgtttaccacttcatgagaacaccagaagagtgtgttagagctgtaaaaccagctcagctatcctggcccactcatccctcctaaaagtataggaaactaaattaacttttaaaacttagcaacaagaaaattatcaattattacaatgaaaagaaagtaagaaaactaatgatgtttctatagacaatgaaacaaaaaaaaaacacacatgcacaaaatggataaaaatcataagcaaatacctctaaatgagctgaaagaaaattttaaaattgtaaaagctatgaagaacaatataaatcagaattagaaaaattcataaaagaaataagtagaaaaaagtaatatttgacacaaaggatgatggataggactcatcagtatagaattttttttttttttttgagatggagtttcattcttgttgcccaggatggagcgcaatgacatgatctcggctcactgcaacctccgcctcctgggttcaagtgattctcccgtctcagcctcccaagtagctgggattacaggcatgtgccaccacacccagctaatttttgtatttttagtagagagggggtttcatcatattggtcaggctggtcttgaactcctgacctcaggtggtccgcccacctcagcctcccaaagtgctgggattacaggtgtgagccaccatgcccagcctagaattttatatttaaaaaaaaaagcaggacagacatgaaaactcaactggaagggatatggcactatacacacaccacagtgagaagatgaatagaagacggagaggaggaaaaatcaagaagaaatttgagattagaaggattcaaaagaaactgttagacacagaataaagcagatatagcatatataatcaagaggaggcatccaagaagaaagacaaagcaatggattagaaaaaatactgaatgctatcattcaagaaaaattaaaactacacatggaaacctgaagctatataatgaagatacatatcacattcttcagaaaatggatgcagaacagccgatatcaaggtacattctaataaaaccatagatctctaaaaagaaacaaaatatgcttgggacttcaaagcaaaaagatcaagtagcttataagagaatgaatgtcagatttctatcagacttttccataagaacactaggctagtaaacaacgaaatgacagatttaaagggctcaaataaataaatggcagatcttgggccttgcatggaatatgcatgaattctatatccatccaacctaagctttcggtgaaaagcttgcctggattttctgcacctgcacttccttgctgtatctctgctatccttcgctcttggcatctgagaatctttgcactaggtaaatgcagttcattcacagactctaaaagtaggtaccaatctccaactaaaactgtgaaacttttgggtctgtgtaaccaaaagaacctatactcacccaaggcaagattgagaactacatactgttataaatatgcaagagctcaggaaatattatccctatgtacctttcttgagggatctaccagacagcaagctccagacaaccaaatactgtagagacattggcaagagagctggagaagtattctaacaagtaagtaaagaaggatgatggactctgaatatcaccattttgcaaccttgattgcaatatcatcagtatatggtaagatcataaaatagaacaactaattctgatgtgcttcctgatgaaagtacacaatatcacctgccaaaagcagtcgaacttgaagctgatcaaaattctaacactaattacccatttgcagaaaacacaaaggatagatatgttaaccacaccatgcaaatacaatcattaaaatcaagacaaagaaaatatgcaagaaatttaaaaggacatggaaggataatccatgttgtaaaaaagacttaagatacatatcaaataatcatcttatgtggatcctgtttggactgcatttcaaacaaacttaaaaaattgtgataatcaggaaaatatgaacattgagtatttgatactgttaagaaattactatatttgtaaatgtgatcacaatattggttttaaaattattttaaataaaatacttatagatgaaataatgtgatgcccggggtttgctttaaaataatttggtgacaggacgtaagtggaggtgcaaataaaaaagattggcaatatgttgataactccagttgacccttgaacaatacaagtttgaactgtgcaggtctacttacaggcaaattttattccatctctaccaaccctgagacagcaaaaccaacccctcctcttcctcctcagcctattcaatgtaaagatgatgacgatgaaggcatttatgatccacttcaacttaatagatagttaataattttcttttccttatgattttaatattttcttttctctttattataggaatacagtatataatgcatatagaaaatatgtgttgatagactgtttatgttatcagtaaggcttccaatcaactataggctattagtgaagtggagagtcaaaaattatatgcagattttcaactacattgatatcccaaccctcattgttcaaggatcaactgtacttacactgagtgaaagggtatagtggatgcattactttatttttttctccttttgtatatgttgggaatttgcaataataaaaagtgattttttaaggcataagaaggtttatatgcacatatattttggtatttcaggctttcattctgtcctaggagaaatcccctcatgaacaccgttaagcacataaagaaactgacaaaaaagaatgtatgtagatctttaaagtagcaaacccattctccacctgaatttccaccacattccacctcacgcttcttcatattgcaattgagcagaaggtctttatgaggactaaaattgcagtgacttctcaaagtgagcatttacaaatatgggtactcttaagcagttaactttggactttaactcataagcccccgaggtaattgtttcttgtgcttgcttgcatatggtggcttgcagaaaagaacaaccctggagtttgaattataaactatcatcactcatctctttcttattctccatgttttctttctagatatttccacacaatatacttaggtattcgaagccgacagagtggggagaatgacagatggaggttttactggaaaatggtatatgagtatgcggatgtgagtatgctgcatttgctagccacctttctggaaagtgctccacagctggtcctgcagctctgcattatcgtacagactcatagcttacaggccctccaaggtaagggcttgcaatttggtttctgaatttggggaaagattgactggctacttttgtcacaatccgaggaactgtcctaatgccctttgttgacacaggcctgtgatgtgtctgctgttttacatgtgtttcgtgaatgatgcatgatgttttcctaccattgcttctcatgactgattaattgaaagacagcgcatttttgctctccagctgtcctcttagtaggaaaaaaaaaatctttatgattttacacttggtcgatgtggggatagagtcagtcaactgaggctttctggtttttataatggtataatttccaaaagttgcaaagaaagcagtaactctctctctctgtctctaatatacatatgtgtgtatgcatgtatgtgtgtgtgtatatatggtattagagtaattcctactatttccttttgatgttgagagagagagagagacaatgagaaaaaggagattaaaaggaaatggtacagattaccctaatatttaaagaaagaaggtcataaaggaaaaaaaaaatttgtgaatgtttattaatatttatatactatgaagttttataaaacggatattattatcagattaatatctttgtgctttctcatatttgatgatctcatcagtaggactattccagttacagcagagctgccaggcatttctttaaagcctgctgctcaaatcctttctagaataaggcagcaagaagattagacagactggtgggtaagcaggtgaatacatgggcacatggatgatggataagagggcattttctaaggaaagcatttcctattaatttgtcaatcctgtaactaaatagatgctgttacacagttaacgtattgtaaggtgctcgttttgtttggatctcagcagggcctctgtgcgcccctctgggcacatgctgctcccttgtgctgggtcatgctccaatttgagttttgttctggttggtccggggaatctcctcactgtccttataactttttatggcatggagcatgctagtttaagctgagtgctttaatttgggggacagaatcagggtgcatgttacctgtataggaaaaggaagagaaaatgtgtattggtagctggtgacccatttattcatagattcctggcccaaccctagtttcacactagaatagctttggtccaagaagtttgagaagaaggtcaaagagatccacaatgtatgtttctcaattgctagacagcaaattggaggaagaggaaagtggagtctttgcacagaaaaagagaaaagcacggagaaggcagaaggccgtgtgaattagttgtggatgactgtttttcgttgcgtctggtggttgaagaccatgagctgggcatgcagaggcctgggctctggctgtctcactacctcactataaaacctctcacagccacttaatctctctgggccccaggttgctcaaatgtaaaggtcgcaagttaaactggatgatttccaaactccctgacagctctattctatctttgaatcaatgaattcccaataggcatataatgccaggtatatgttttaggaaatgatctgtaaaccagaatacaaatgaaattgaaaggcaacatcaaactaaatctctgtcatgaatttagtgctcatctccagaacaacttggcaactccttagtataattatacaattgggaactctctagagggagaaaatccaggagcacacgtggagggttgcaagtcaccttctggtggcctgaggtcactgagtatctctactagttttctaaaagatttggaaaattatggagagatttttcttccaaagatgatggagatagagaagggaaggtgagagagggatctgagaaaatgaggtcacattttcagtttaaggacgatacataaaattgtacagaaaaaaaaaatgaggaaaatgcaatccttagtcttcatcagattatttatcctaaacataggaaccaagagttaagttgcgttttttgagtctttggctctttcctcacatctagtgtccccagctaaccgattaagcttgacacatatacgtcaggtgtaccacaggcgttgaatgccagacctcgtccttagccaaggcaagccttgctgtcaagtttcagaatggcgtagggaaactaggttctgtttcactccaaaggtggccaaaagacaggttgatccaaatatcactaagaatcaatgcaagtcattgagtcaagaggaggaataagcccactatgttgatcttattgctactgattttttaacaaggcaggtgggtagatggttgtgttacaaaacaaagagtgaaaatatctgacagtaaaaaacgacagaccctccagccaacgaagaccagcccaggcaacactctgtgattccttttgcattttgaagagaaacctgaaacctgtcttcagagggacagcttctaaatacccctctgctgatagatgatcccacttacaaacaaaccagctgataaattaaattgatgtgagttctaagaacagagctgttcccctttaggaaaagaaaaataaatgtgataacctagtttgacatgtattttcatacatcttcaatggttaaataaaattattgggatttacatgtgaaaacacagccctctgctatgaatgtaaataatcaataggcatgaaatctgtaaaggatttgcagatagctgtgaatcaaaatatctaaaacattcttatttagcagggagagaatggtcactctgtatgtgactgtctaaaattactattttttaggatagaaggaaaattgatctttaaacccaatttcaaccatccaccactctctgcagtgcttttaaaaaataagaaaaatcagacaagaaatatgacattttataactgttattaggtattgtattctcttcgtggaagctgggtagccctagaacactgtcagctgcttctccttccttatgtagtcactcagtcagaggagcctcctcatgctggaggctgacaggcccagggagaactgttggagcataattgtttctccatttgcactggcccaagaggcacagtttggcatctgttcagagagcaggaatcagggcaaagctgagtctcaaacctgaatatgcagctcttcacgctccacagtcacattggacatattacagggcagcagctactctccacgggatctgggatgtcccagagccagctccccgcggagtataagatacacaccaggaggcccgactgcatgcacggctgtacctgcacaggtagtgctcactgtacttccagagagtttccagtttacaggtcgttatggttttccaatcccaatcccttatcctcactaggagagaggcggagaggggagagggacgttgagagggggagaggagggcaggcaggaaggaaagtgggatggggagaaggagggagggagaccccactcgaccgcggagatggaccatggcatttctgttagtgtccacatggagggtgctgctctctacctgtttagtgagggtgccaaagatgctgaggaagatgtggtccgaggcctgtcagttgtatcttccagcaaaatctcactcattcgtttcacctcatttctactgtgctaccctggccggaccatgtgcactcccacccagacccctgtggatagcccacagcttcatcctcacccgtgccctcttccttcccttctccttggagcagtcctagagccgcttagactctaatctaaactacttcagtgttccccttggcactcattaaaattaaacaagattcctgagcaagttccaaggcctttgtgtcacagccttctcctcattagtcactgctctgcaaccacgctgcgctcctctctgttctgaaaatgttcccatttctctcccacctccaggcctttgcacctgctattaacctctccagaatattctcgtcccctcactcttagcctgtctagttcttactcgtcctgcagaattcagtttaacctcctcagagtatccggtcctaactgctcgttcacatttttatttccacattagtatttcctcaaggtgtcctgaacttcagcccctgatctcaggcaattttcttatcgttgttaagcctcaatttgcccatgaatactgagggataataatagtgctaattcataggattgtagagattaaatgagagagtacacacaaaggattcggcagacccttggcccattgcatagggcttcttaggcttgatcttgcagaaatctaccagggaatcttatggaaaagcaaattctcactgagtaggtctcaggtggggcctgagttttagaacagggaaataacaggtgaagaatttgaggcatgtgaaaacgggaaaaatagttcaaatttgagctcatgaaccctgaattaaggggtgtgtgttagaaaggaagtgcaagaaacatcgtgaagagagaatggtcaggtcttttgacagacagagcatggaccaaaagagaccgaagcttgagtccatttgactgagagagaacctggtgacaataaaatcaagcaggtcagcaggagcagccacttagggggagagcattttagacattttaagcctgaaatggtggaggacaatcaagttaaaaagtcttgagactgcagaaacaaagacagcttaagataagtcacccagaatttcagacctccatgtctgtctaaatgacgccagcaaaggtagaaggttcatggtcagagttaccccatctggacttttcaatgaccccaagaacctgtaaaatgagcagtcagttttagttttgtgattgtcatattatgaatagtttattttggttgcacagacccagcctcccatgataggcagagaaaataccagttcatgtacagacaactgtccacagccttcctcagcaatacagccttgctgtatcagagctccctggggtcaaagggtgtgctccccagagcagcccagaacaccatgtagaatcacggcacatagcggatgctctcaatgagggtgtataaaccacagcccaggctaagtacagcacagtcacctggctgcacaggggaaacattgtgcggaaataatgcttccttgtagaggaaccatctaagtaaaacaaacaaacaaatatctggccttcactagatgaattgtttgagtgccaatccaccaacctaaatgtttccactttttccagaaggctttagttctttgtttcccattgctaccttatcactaatggaaaatctcatcctacaccctaagtgtatttagctggggtgtgctgagtgagttaccaacaaatgccgtcccacaggccatgtgcccaggaaagctttactgaacaaaaacgaaaaacaccgacttctcattccttcatattctagaagaatatgaaaaaaactccttttgccaacagtttatcctgaatacttcgtgaaaggaaaagggaaacagggagctggaaggggtttctaattattcctctcctgtcttgcatcctatgaggctccacaggaagtcagaagtaaagttgtcctcaaatatccggcaaacactgttacctgctaactagggtaaccaagaaatacctgaattgtgaaaaacacctcatttgtcctctcctgttgagcactcttgagacctaacactggcttgcaacttgccccacctcatcgcgaagcaggtggagacaggtcccagcctgtctccagccgcatttaaatgacctgggttagagaaaatcccagtcacccctgtgcccaacgccttcctcctttgccccgtaccactgtcttctaatgtgcttgcccctacctctggattctgcagagggggaagagtgcaggcgagagtgccagtctgtgaggggtctaggctccaggtccctctggatctgcctactctgcagttgctattatcgtagttaattaaaacatttattgaaagcttgtttgtgcatgatggtgtgtgaagctctgtgcaacatttgtactaaagaagttcactttttactaaaagtttataatgtgacgctataaacaacacgacagaacatatttagaaacacccatttatctgggtgcattccagactgagtggtgccattttgtagaaggatcaataatttggtttaattaggttaattagtttaaaatgagaggggggcttacagcacttccagctcacctgctccgggaaggggccaggcagcctctgcctgagcagccgtgtgtccattgtcagacagttctgatggactgaatcacacagttccgatcagacagttctgacgtccttaatggtactggaaggagcaggaaggcagcatcaaggacatctggtcccctcctctatctgacgcgcgagtctttgctcaaatccaactttgcccagcacattccacccccgggcccaccgcctcagctggaaggatgctcatcatcgcgagactcctacgggatgagccctcctctccagctctgctcaggccacgccctgctccttctgtagcgtgttctccccgatgcccctcaggacactgaatattcatgccaagcaggttgcttttagtccccaggcagggttgtctgaagttgagctatgcattctgccagagtcaagctggtgtctgaaactgtttttctcaatgtccttcttattgttcgtttggttggctgggtttttgttttgttttgttttgttttgttggggttttttttgttttctgagacagagtcttgctctgttgcttaggctggaatgcagtggtgcgatcttggctcactgcaacctctgcctcccgaattcaatcaattctcctgcctcagcctcctgagtagctggaattacaggcccccgccaccacgcccgactaattttgtatttttagtagagatgggatttctccatgttggccaggctggtctcctgacctctggtaatctgcccacctcggccacccaaagtgctgggattacaggcgtgagccaccacacccgaccaatttgtcctttttattgtaaacttaggtttgcattacataatttagttaggttaattagtttaacttagtttaattagtattattaatagataaactgatgaaatatagtgtgaaagagagttgtttctatgaaatttatgttgacagcttttgaaaacttgggtaggaccagggcaaagtggtgtgtttaatccagttgcatcacagcctcaggacccctgggaggaccttttggctgccctgggatgtggagcatgaggctgcagccggctccactcttccgcagcctgctgtgcgcgctggctgccgctggcccttcacgcacgacgttcactagggtggcacgcacagtcttccagtgggtccaaaccactgagctttgttgtagtatggcagatcattagctgctggattttgctttttgtgatgatgtatcaagtagcataccaccccagaccaggaaagtagaacatgttagataattttaaagaagggggctggacgcggtgactcacgcctgtaatcccagcactttgggaggccaaggcgggcggatcacctgaggttgggagttcgagaacaccctgaccaacgtggagaaaccccggctctactaaaattacaaaaaaattagccgggcatggtggcgcatgcctgtaatcccagctacttgggaggctgaggcaggagaatcgcttgaacccgggaggcggaggttgcggtgggccgagatcacaccattgcactccagcctgggcaacaagagtgaaacttcgtctcaaaaaaaaaaaaaaaaaaaagggatttagatcgaggaatgggcggcacaggtgctgggagggtgagaggatgaaaagtgatgctcatgaaatcaggagattcgtaactgaaggaagaagctcttatctgtagggctagaggactgaaggaagagggctcagacctctagggaagggtactgcctgaggagtgctgggtgacagaaggggtgcaacctcgcagctgtggggacagccatggagccagccaggcagcgagggagtggggcgcacctggaacattccggctgcggagggcacaggccggctgctgctgcctcccctgggctgggacgaggctggggccaggaatgccaaaagcagcggctggctggagacaggcgctgtggaggcccagtgataataggatgctgatatgcagaggaaaccagaaagtctcttctcctctcctcctaccttccaacctcccaccagtgccacctattggcagaacccaccgggcagccagccagtcagggagtccagaacagggtctgcagagtcccccctttcgggtggagggagctggcacacacttcccattctgttttgtgacttgcgtctgctcccagctgagaaacttgataacgaagcttgttaaagctatttctgagtaacagttggaggtgaaggcctgaaaggctatggtatgagacaaaagcaggcgctctagatcatggaggttgtgtcatgaaaacgcccaggcagccgagtctggcaactgacatgtccttccttaaatgcgtgaccacagacctcacgtggccactcaaccttgtccagcaagcctaccttatgtcccccttgaaattccgtttcctgctccaaaatgaactgcttcctactttctctggtggcctcatattccaatggtctgactccagtattcttaacctgatttcagtaagaaaatagaggcaataaaacaagagctattttattttctcacccatatgtcctgcctttcctctgagaatatgctggctcccagctaaagtccttctcttctaccctggagtccactaccacctgctcaatcaccctgttcttggaattaccctctctctccctattctgcattatcagtttttcctcactcctgcatcactgccatcatcacacaaacaaacatgctgtaatcaagaaaacatggacccacgccaccacccactaccacattactttcttgctcttcacaaactgcttgaaaaattcatcttatcctctgtctcctcttcctcacttcctatcctctgtttttgtttcctaatttttaaacattgttttcaagtgtaacatagatacagaaaagtacacagttgtgagaaactactcccaaggtcaaaggaagagcgttttcagcatcacagaagccctgctcttaccccctccttccctgtgtgcccaccgttctacatgtgatcactatttgaaaaaattagttttgcaagtttttgacctttatataaatagaaacatacattattgtgtgtgtgtgtgtgtgtgtttctggattctttcattcagtgttgtgcttgtgagatatgattccacgtaactgtaacccattcatttcattgctctacaataatttattgtaagaataaatctctgtccattttgtggttgttgatgtacactggtttgttttcagcttaggagtaatatggttaatgttactattgaatatttttaatgtgtctttaatacatgtgcacacctattacttctgggttcatacctaagagtgaaattgctgagtcatggggtacagacagacacactgaatgtgagtagatgatgccaaagagttttccaaagtgctgggaccaatttatattcctaccagcagtgtgtgtcttgagattgctccaaatccactccaaaacgtggcattttgagtcctctgaattttacccatgggttagtatctcaacgtgactttaatttgcatctcctgataataatcaaactgaaaagtatctttcattcttctttttcctcacccccgatccagtccatcagcaagtcctgtgtgctccacctccaaaacacatcccaaatccgaccaccctttgctgcctccgctgataacactctctccaaacaccagctcagttacccttctccagtgaactggtaccccccttcaccttttcccacagcctacttgccacacagcagccatagcgatgcgttttgttttgtttttgtttttgttttttgtttttttgagacagagtctcactttgtcacccaggctggagtgcagtggcacaatctcggctcactgcaacctctgcctcccaggttcaagcgattcccgtgcctcagcctcccaagtagctgagactacaggcacacaccaccacacccagctaatttttgtatttttagtaaagacggtgtttcaccatgttggccaggctggtcttgaactcccgacctcaggtgatccacccgcctcccaaagtgctgggattacaggtgtgagccatggtgcctggcccacaatgatctttctatcacttcactgctctcgttaaaactccctggggacttcttgctgcaattaaatgaagtacaaactggtgacaggcatgtgacaaggcccctgctgtggagcctccaagtctccccactctcccactggctcgtgtgagtcctgcagctctggctggccgtcctctgtctctgagacaggccctggctgctgccccatcaaggaccctgcatttgctggaccattgccctttcactctcccaggtcttcacatagctcatccctttccaatcaggatggggctccaacatcactcctaaaacacacagctctcccccttcccacagacgcccccatctacttactctgcgtgattttctctttggacttctgaaattctattcatccctatgttttattattattctcatcacctttactagagtgtgagcaccatgaagcaagaagtataggaaaaggcctataacatggaaggcactcaaaagtcctctgactgaagaatgctgacagatttttaccatcttcagaagctacttcagtttgtattggcttttcagttggactagccaatacagactgctcacaagttcctgtggaatgtcacagtgttattttacataaaggaaaggacacaatataagttcccctccttcaaatgctgtatttgtaaaacttttacatatttggaatttttaaaatatttacttttattccctattacacatattattaaagataaaatagaaaacccaagtatgcatgaaggagaaggtataaatcaccttcctgccactcagaaatgaaaatcttggctggttatggtggctcacacctataatcctagcactttgggagtccaaggcaggaggattgcttgaggccaggagtttgagaccagcctgagcaacacagcaagaccccatctctacaaaagagaaaagaaattagccaggtgtggtggtgcattcatgtagtcccagttacttgagaggctaaggtgggaggatcccttgaagctgcagtgagctgagagcatgccactgcactccagcctagggcacaagcatgatgctgagaaaggaaagggaagggaagggaaggggaggggaggggaggggaggggaggggaggggagggaaaggaagggaagggaaaggaagggaagggaagggaaaggaggaacgggagggaaagggagaggaggggaggacagagagagagaaagaaaagaaaagaaagaaaagggaaggagagggaaggaaggagaaagagagagagaaagaaagggaaggaagggagggagggagggagggagggaaagagaataaaaatcttgcccctaagaaataattaagaattatattttgttgcttatctgtgtaaacttatttaatgttttaatatatattacattaaaatagaatcaatattggataccagtttgtgtccttttttaataatacatcacaaacatatattcataataatatatatagttcttcatttttaatgaccacataacataccaatatatggattatccttttctttttgagtcattttctacttctgaaaccataagttattatatatatttgctataataaataatgctatgataaacactttaagaactaaatctcagctagcttcagtggcacacgtctgcagtcccagctactcaggaggctgaggcaggaggattacttgagccacagagttcaaggctacagtgagctatgattgtaccagtgtactccagtctgggtgaaagagcgagacccccatctgtaggaaaaacaacaacaacaacaacaacactaaatctttgcagcaagccttaattatttcttaaaaataaatagctaaaagtggaactgctggattcaaaggcaagcaggctttcaaagttttttattatataatgtcaaattggtcattttgatgactatgaagagctctgtaacatctcaagtttctgacacaaatgctcaggaagtcagtgaggtcaataaaggtgacaaaggctgagaatggggcaaatccgttgagatttaggaaagagctcttaatagtgccccatctgaatgtaaagggcataattctcagaagtgttctaatttcttcccttgttactttattgtatccaccttcataataagctttattaaatctattaagtagcagtagttcattagtaatgaaacaaaattgtaagagcagcttcatcttcatcagagacttgatttgaaccaaaattataaggagagtagacataagctcctcaaaacacttcccaaaagtctgaccaatgagaagttgtgaagagccaaacttataaaaattaggagcagcagcccctacataggagagttgtgatttttttctttgtctttctaaatatattacatttatccaatagcacttagtgctaagccctcagggtataaaagaaagatgacagctcctccctgccaggagctggaaaattccgtcgagatgcaaaaacaagcgtggcagcatgatgggggcagcactccagggcacttgcacattccttcccaacacagtggaaccaccatactcagcacagagcaggcgatcctgggtgtttgttgaatagaagcaagaatggacgcctggtatgtgacaaagccctatgctaggcaagacagatacaaagacacagccccctgctctccaaaatttcagtctaatggaaaagagagaccaaaaccttattagaagtcaatgtgctgtgtcctagtggtggtcactttgaggtcctttggtgacacagagcaatctcgtatgcaaaatggtacaagggaagtagcaatgccatgctattgatgtttgaaggaggaggacatcagggagtgtagaatcaggaaagtttttgtgaaaatagtggctttgagctgggccacaaattatgcccaatactttgtcaggaaaaatgatattctgtaaggaaaagatagcaatgtgaacaaaaccagactggggatgccatatgtgcccgtgtctgtgcagcaatgctggtgatcagtctccacaaagcaatggaattgctgatgttattggcagcacgtaattagatttattcccaacacttgaaagaggtgttgggtatcagagtaaatccttgcatatatacttttaaagtaccacaacctattttcctgtatttctgacttttgagtctgtctttgcattgttcaatacttgggatacttgggaatatcagtaaatagatcaataaaatagtaaaccactagtctgcttaatcaatacatttatggagttcaattttaaagactcatcaccaacaacttcataaggaaagaatcacaaaactcactggtgtgttggccatatggctccactttatttaaaagtactggcagaataaatgatggttgtcgtggaggtaatgatattattgatctctttatttcacattcagtagtctcttgagtcatggtaccaccccaagttatacttagaagaacagaaagaagtttcttctacttatcattgattcaagtgcttgaaatcagctctatggtatatcaacccccagcacagctgtgaatagctttgaagttgaatcattttgaacataatatgaaataaggggcctgactatttttaggttctacttaattatctccaataatcaagcacaaatcttggtatttttccactcagtatttctcctctctcctgcctctccttccctctgaggtgtggtgagcacacagacatgttcaggcacagggagaggagcggggtcatggatgtggtggacagtgtaattagtcacgtgctatggctatgggaagaggagagctggaggaaagatctagagcagtcagttcaatcctgtttggaacaaagaagcatcaataaggagctgtctgcaaggaatggtgccccaaacactggctgcttgttggcctttcctgtggtgtcttcatttgccaacctctaacctccccaaatttcagtaatgtgttagcacttcacaccttagaggaaacagaagcccacatttatctgccattcacctgacctttagccagtgtgggaacttagagctgacgtttgctttgactgaatatcaacacactgtaattattatttctaaacactaaaaataaccatgtgaatggtaatcagaatgcttgctgagcaaggacaaaaggaaagacgggtaaggtcaacttaataaaaaattcaaaagtgttttactatggtactttcccagatagcttttttttttttttttctagaaagccacagacagttataggatcaggattttgtggcccaatttggattgggtaggtgggtgggtaagggaagctcccacaacctcttaaatagttttcacatcatgatgtgtatattctagggtataaatatattttgcatttattcagcagattgctattagactgattttaaaagtattcctcagagaggtaagctaatattttcttgatgactcagcagaacttaaaaaccaggatcacttcctactgagggattttaaaacagcttttttccccccagggtactgctcatacacaggagggtatatgtgtggaatagagacagccctgcaaactgtcagagcagatgcaagggggttgggaaggagaagctgattcaattggtatgtaaacgtttgttaggataaaatcacatggagattcactcttcaaagctcacaatgagccctgattgcagaaggacagggcctgctgagctctgcctggctaaggttttgtcagcactttcattgtgatcttaaatttccacagctcataactcagctgtagaaaaagtctcagagactacaagactaacaagactcgaaaactacaaaaacttttggggttttttttagatggagactcaccctgtcgtctagtcgggagtacagtggcgcgatcttggctcactgcacccgccacctccggggttcaagggattctcctgcctcagcctcctgagtagctgggattacaggcatgcaccaccacacccagctaatgtttgtatttttagtagagatggggtttcaccatgttggccaggctggtctcaaactcctgacctcaagtgatctacccgccttggcctcccaaagtactaggattacaggcatgaaccaccgcacctggccaacactccaaaaatattttaaacatccatagtattaccggttcaaatgcttgggcaatttgatggggcatgaacttccctacactagggttgaaaagtgggagtttccagcatagagccttcaatgaaggggcacctccagatatttgttatctaaaacattgagttaaaattcatattttaaaaaatctaaaatatatcctctatgatgtcaatggaaaacaggtatttttaacaaagacttttggaataaatggtagaataagtaattgcaaaacactttgtcacatctttttaaagaaatcaacacagaaaagctgttacaaaaactatgtgaagtaagttttatttttttttttaatgttttgtgaacacaggagatctctctttcaaattcagtttggccaggaagtttgatagcaaagggagtgagtattgaacctttcagaatgagtgcagtgatttcaagtgtacaaatgcttggaggggagatcagataagagcaggtcaggaagtcggagaagtgcgaggtctcttactcaggccaagtgcggtagcacagccaaaccaggaacaggagggaatgatgtgaacttgatcctgaaacccaagggtcctgaaaaatcactccttgttctcatccagctacacacctcccaaagacaggctgcagtgtcttcatcaagacctgaaggaaatcttcattatttagtgtatattacaaaatataataatgtatcacattattacgataaacatgcagtgggcacctatccatggcaggcgctgacttgaatactagaaagtgagcatgactaacaccattcacccttgaagggcttacagcctcataagggggagcagcatatgaataagtgcttaagtggtcctgggtaggcccagaggtcagtggacacccaaagagagaagtgaccggttccacctggagagagtgagagaggatttgcacacactgtacctcaagctgagttgatagttgaagcagggaaaaatagaagagacaacctagggagagctcattggagaaggccaagcgcagaactggtaaagtgaaccaccatttaagggccatagtggagaaagagccagagaagaaaataagagagaggtgggtgtattggaatcatgtctattccttaacagtcctgcaacaggaagagcatggggatggggagtttccaaagaaatgcccttgagggacctgtggagatgagagctgaaaagagcctgatgggtctgacaattcagagaccacaggggcacacagcagaacacatcagtgcgaagtttaggaaataaatgaagaatgcaaattagaggagagggcatcgtggtagcaagggtagaatttctagactataaaggaaagaataaaactagtgaagtggcccagagcacacgttttaggacagagacataaaccgaatgtgactgtggtgatggagctgtgaaaagctggtcatgggagatgcagcaggagcacttttcctgcctcttccagcagtttgcagtaacaagggtgatgcccccagcaaccagcaatgggtggagctgcaaccagggcctgtgctccaagttccatcccaccgggaaaggacctcagtttggaggaattccattgccagtgatctttgctgtcttcacacagcgtgtggccttgagtgtgtgacttcacgacactgagccttggcttttctgattggaaaataattttaaagatctaaattgcagtgttgtgttagaacagaataaaataaacaatgtaaagcacctaagccatctgacaacggagcgtgcaccacctgcccatgtcctcctctggcctcctccttgcctgcctccaatggataaggggaagagcgccctcagcctctgtctaaatttatcagaaaagagttccctcattcacattctgtttctctcctaaatggatgtggaccaatttaaactcgtttcacctaaccttgaggtgaaatgttacctcttcctgcccaaggtcttggtctgggctgagctccttgccctctagagccagagctgactgcacctgctggctcctgtcctctcacccaggctgcccccaaggcctgaaacctcacgaatcttccagcaaacagcacttagactttgctctgtccactcacctatatttttagcacagaatacttttagccttgacatttttgaaaataatatttatgaggaaataagatacattttcttctttttctttttttttttaaatatattttttaagttccagggtacacgtgcaggatgtgcaggtttttatacaggtagcaatgtgtgccatggtggtttgctgcacctgtcaacccatcacctaggtattaagccccgcatgcgttagctcttttccctgatgcgatcccccacaccctcccctaacaggccccagtgtgtgttgttccctgccatgtgtccacgtgttctcattgttcagctcccacttataagtgagaacatgcggtgtttggttttctgttcctatattagtttgttgagaataatggcttccagcttcatccatgaccctacaaaggacacaatctctttcctttttatggctgcatagtattacatggtgtgtatgtaccacattttctctaaccgttctatcattaatgggcatttgggttgattccatgtctttgctattgtgaatagtcctgcagtgaacatacatgtgcatgtatctttgcaatataatgatttatattcctttgggtatatacctagtaatgggattgctgggtaaaatggtatttctggttctaggtctttgaggaatcaccacactgtcttccacatggttgaactaatttacattcccaccaacaacgtaaaagcattcctatttctctgcaacctcaccagtatctgctatttcttgactttttaatcatcatcattctgattggcatgagatagtatctcattgtggtattgatttgcctttctctaatgatcagtgatgttgagctttttttaagtttattggccacatgtatgtctttttttgagaagtgtctgttcatgttctttgcccactttttaatggggttgtttgtttttttcttgtaaatttgcttaagttctttgtagattctggatattagacttttgtcagatggatagacatcaacttcaatccattaaatgtgaaaactaatcttttttctcacaagctcatctgtatcatatgtgtggagatatttcctacagttctgggaaagtataggattcctaaaactggtggccatattttaatgatgttagaggcagtctgcactgagtgcatatcattaattctaataaatgagtcatcaaaagtcattatatttctttctattttctcatctctcaccctctctctctctctctctgtctctctgtctctacctctctctccatacccctctccatacacacacacaaacacacactcacacacacacacacacacacagagagagagagagagacggacccacaaatatacctggtgtaacaggcacagactttctcaagctgtaacacaatatttgcgagttataatgcctgatgacaatggcacttgtccccgccaccaccaccacctggaaaatgaaagaagtctgcaggttgcctcctccagtgagttttgaggctctcaatggaaacttgagtcaaaaaacccttgctggaaatcttgtctccaccacttagtaactttcacctgtggtgcactcctctacttctctgcatctgcttccttatcaaaggagtggggatagtaacccatacctcataggcaggcacctgggagaatttgctgagacaatgtgaagggtggatgctctgtctcatacctgatattggcaggtacccaagaagtatcttttcctctttgtcacatagggaatatttagctctgatgtgttagtacagatttcaaaggaacagaccatttacaatccacagtatctaccttacagccaaggcagcgctagcaaataatctcagaaaatgagtgaggaatacctcactgctttttcccttaaggagcaacaaaagaaagaggaaaagagggaaacaggggagagagaaagggaggaaggaagaaggaaaggaaaggagagaaggaggaaggaaaaaacctgaacaacttgaaataggaaaagtcagagaaaaaccccagaacaccgtgagttggttttgcctgcatgtcgtgaggccaccttgatgttccctcccttgctacttgtaaggacatctataggctgtgcctgcgccttgtgaatacaggagaaaatatgaacagtaatctgatataatcagaccccagaaaggcacttctggaaacactaattagattttcttcaaccttgtttaatttagtgagttctaggagaagatcacacctctcctaacactcataaagagaatttgtgaggaagattgtgtgcgcgtaatacctattcgatgctcgaggcaacctgttgccatagtaccaatcagatgctgtcttcatcgggggaatagaaattaaaagtaacagggcttgagtacaaatgtttttgtttgtccccatgaacagtgtgaatgttgggaaaaggagatctggtcttgttgttattttctggttttgaaacaagactacattaacatgtgtagaatatgaaatagtacaatgaatttagagaaacaaagaattcccaaagaagtgcattattcttataaatttacactatcaaaggatgtggaaatgccaaaaaagcaagttcttaatggtcagagtcagcagtgtcatctcagagccaaagagagctgtcagtggctaataacgtgcaaatgcaagattcgtctgaatgctaactggctatttttattgccttagaattctgatcttatattaagagctataaaatatccattgtgctttggggaacatctgtgcatctgggtctcataataaaagaaatattgaaaatcaagagaggtagcttgctatggagaaaaacaagagtacgattaacatgaaattcaggaaagtggttgcctgtgggaatgaggcggagggaggaagaagtttcatagacattggtaatatttaatttcttaagtggaagggcattttattctgttcaaaactgcacatagaaattgcctatactcacaataaaaacttacataaaaaggtggagagagagacagaaatggagaatgggaagtcaatggacagaaggcagtggattcaagccctgactctatgattctctagctaagggaatgagcgcatgtcttaccttggcagagactcagttttctcatcatctaatattttaatacaaatattaaatggtcccaacacccccttctagcttgaacactagccaactctatgtatatcacatggaatacaatattgccaaatgaatcatgttggggaaatactgtcttttcttcatgtaaaaacaaaaactcccacagtcaccatccagtcatccataacagcttactagctgtgtgtgagttactctcttattccaggtgaaccctcatgagtaaccctgctgttctttgagcagaattttggagcttctttttagaaggaagatatcattaagtcagtgatagggcttacagtctgggggtcagatatcctgctggtggccgggaagaagactccacactcttctctctgtcagctcatcatgtcagctcctctgaatgcaaaatatcaacataatgcactcaagaggcatgtcattatttcttgctcatcaattgtgcatcaaatgctgtcaggtgcttcatagtccatcccccaataccaaaaaattaccaaatttaccaaattacaaaaaaatacctctacttttcaggactaggatactcaccataccaattagaaatgtttcaaagaaatgctctttttagtttgcaacatcaggaagctagaaacatcctctttcctcatgcattcaacgcgtttttgcagaatgcctactgtgggcaagtcccatgctggctaccggtttctacttaatttctcagagcacagacatgagatgtgattacaacaaatgcgctctggggcattgcagcatttcccgggtgctggtgttcacttgttcttcagatttgtatgtccaaggagagcagatagaaccaggctgctgtcaccctgcttctggttttgttgcaggctggggtccagcggaatcaggatgcactttgtttggccccaaccagctcctcactccacccggagcatagggttccagggcatcttcgggtgggtcctggggcagaggccctcccctccagaggctgtgggagaaccgaccatccaggctggtgcaccaagctctgaaaactggaacagatttctcagcctttctgagacttcatttatttctctgaaatgggaaactacctcaagtgttatgagcactgtcaacacttcttatagcttattatgacatcatgcacgttaaggcattgagctcaaagccaggcacttaattctgactcaaaaacacatttgtgcttcctcttcctgttctaacataattaaacacacagtcccgtggcaaagggaaattgcctgtccctgctgtctgaatgctccattggttctgatgagagactgacttgagaaacattggcaacatctgtttctctcaaatatgtgctagcatccttgagaaatcataggttttaggcacacacttaaatgaaggggaataaggttgggcaccaaatgtgctgtggcatcctgggaaaaaaatcagaagaccgaagtcaacaggaagcaaatctgaaagcaattctgccatgtttcctatcataacccccttcaaaaagagtttagtgtaaggagtgcaagagtgcaagacactctcataataaccaaaattatccagcaaagacatgttcattttaaatgttgaaagagaaaggaaacccctcaggaaattaagtttgagttccatgacatctttcttcttatgcagacattgagacaacaacaagaacattcagtctgtttgagctttcagctactgtatttttccatttcattcattcttagttatttttaatgttttcaatttattcagagaactaataagtgatttattatgggaaactaagtagggtttacacccaaatgccaagagagaaactaaattctatccactaagtcaccaaaagaagtgcctcttatcaactcaccctgtgtgtttctaggacaggaacctgctactgatttcgcagatgtatctttgttgtctctagtaactgctctgtgcttagcacctactgttaattcacgcagttgacctataaccaaacactgaaaaggtgatgtatgcatttgataaaagagtcaaactaggtcatctctgaatctcagattgaaagtaagtaaaaccatgtttatttcagtttataaaatgttttattaatactctatcttctttggtggatctaatatttaggtaacagttttcctttaaaacaatttcacatctaagaataaattagatgctgatgcattaaatgtccgcttcaagagacttggcaatatatacattatatatagtcaaaaataaagtcaggaataaaaaatccagatttattggagatgatgaaaagtaattattttcatttcaagatgaaaaaattaaaattaaatatgatgtatttcagatcttagcttttatattttaccattctattgtcgattccaaattattttccttcgcctctttcttttaactgagaaaacttttatctttgttgccaaggcacataatttggaatcaacaaggtgtttaagtttctaaatatgagagatgggatttattagggaaattggctcacacaattatggaggctaaaaggtcccactctaggctgtctgcaagctgaagaaccaggaaagtggacagtgtagctcagccagggccaaaggcctgagaaccttgagggaccattggtgcaagtcctggagttgaaaggccatggaatctggacttttgatgtccgaggggaggagaagggtgtcccagcctcagaaaaggcagtgaattgacctttccactgcctttttgttctatctggacccccagccaattgggtggaagccacccacattgagagcagatctccaccactgagaccatggaccgacgtgctgttctcctccagaaacaccctcatagacataccaggaaataatgctttgccagctatccagatatcccttaattaagtcaagttgccacctaagattatgacatcgcactgtagcatcatttcatagaaacacttccccctctatcacatctctttctatacccacacatggaatgtgtattcttattctcatttcccaaattgagggtgcgggggcactgagatccaggaggttaaatgccaggactaaggggagaggccacatcaggatcagaaagagaccttatgttttgtcttccagttatgttgtgtttctattctaaagcttctcccaaaaaattaaatcttatgcaaattttaaatactacaattaaaggaaagagttatgtttgaaggctttataacattgtaattggagatgcctttgtcaaattttcccattttaaatggccaggaaaaacaataattatttttctgatgctgaggttttatatcttagtagaagaacttaaactatgacttgtattcaagtctaacaggaatagaggtaatgaatgaaagtagtcattgacctgggacaagatcactttgaacatgacactattatacaaagtgtaatatttatttttaaacaaccacttttcaaaagcagttgtgcatacattccaaagaataaaatgctagctactaggttttgagaagcagaataaaatatgatactgaattactgaagggtgataaatttgggccgatatggctgaggtggtttgttttagagtttatagcaataaaggtaatcaggtgattcttaatgttgccagagtactgcagtggaactactaaaggaaggagaaagggagggtatttaaaaagttcagatctttgattctggaaaatctcaactaggtattaattctattgataactgataagcatcttaagggggggaaattcgtctgttaaaaagtctgttacagaaggttgggtggatgcccaaataataccaagctttatcagcttatattctggagagtagttccatttatcaatacttgatttctttttagcatctggtttttttttaactattcaggattttaggtatacggtctcattaatttccaaaatattcttatggataggtgaattacagggagagtccaatgtgtagatatctatgtaccacagacccaggcacatttgggtgagtaaatgaatgaacacatgttcaaactaaaacagactgaggccgggcgtggtgtaatcccagcactttgggaggctgaggcgggtggatcatttgaagttaggagtttgagaccagcctggcccacagtgtgaaaccccgtttctactaaaaatacaaaaattagccgggtgtggtggtgcactcctgtaatcccagctactcagaaggctgaggcaggagaatcgcttgaacctgggaggcagaagttgcagtaagctgagatctcgccactgcactccagcctggatgacagagggagactccgtctcaaaaaataacaatgaaaaatgaataaataaataaaagagactgaaagcacagttgcatttgatgcggcctttgcaaagacctagcctttgatctacctaattacatctctgacctgaagaggtttcttatacatcccaagtctcatgtgcagtttctgattctcagtacatatagcaaagagcaacaggaactgctgggggcctagaagaaggacaaggagaaggagaggaaatcactcagctgagtatacggggaaccgttaagttaatcctggtttaggcattctgattatgtagaagagcaggaatttgggtgtttggcttttaattttttggaatttttaggcaaattcgcattataatttgaaatttgctaaaatgattgacagatattaaatggttaacatttctgaaatgatccaatttttctaataattagaacagtgttctaattgttcatgtattaatttcatttaatcctcccagtggcctttaaagttccattattatcccaatcttatatctgagtctgcttagaagattgggtagatcctttattatcccaatgtcacttataaggaaacagaggtgcagaaaaataacttgtctaaggttataggaagaaaaaggacagaaccaggattcatattcagacaatctggctcccgagacacagcatatgtacccttctacacaatacggcaaatcatgtttactcagaaatagtcccacgttctggcttatattttaatatattattagtaaggggaggcatcaagtgagaatttggaagcttaatctgcaagtctcccttttgagttgtcctaggtatcgtcgcatcatttttggacacacagaatgtgattgcagaaaagggagacactagaggtgaggacttttcgagagaaggaaacagcacatggcaaagcacaggacgtgtttcaggaaggacaatctgtcctgtgtgcctacaggtggtgaatgagggtcaagacaggagctcggaggctaagtttggaagaatgtgttggagtcgggtcttccttcaggcaggaaaaggcatgagcaaaaccaggaaaaacattttttcactttctgcaggaaaggaaaatgtgtgctgggaaaaatgtgtaagatagcaaatgtgttatttattttttattattttattgactgtgtttaacttgtcagattatggttagagtaagaatggctgcaggcttggaacaaaaatgtcctagaaatagtagcctactaacttaccatctgaactgctgaaatatttttaccaggggagaaaaaaaatagccaaacgttagattgagaaatggcagttccaagcaaggactctcctttttttgctgtgtttgtttttaaccgaatcattggctagaatcactcaaaaagctaagtttattctgactgggggagaaggtccctgaacacagtgaggtggagacattgacctacaaattaataaacagggaattaggaataatgatagtaaatgtaagctgtcaagaaaaccaacccaagccagtagctgagagcaaatccaatgtgcctctaaaagcatccatcagtctccaatgtgtgtttataaggcaatcattctgactctttagcaaatacactcaacttacaaatttcaaatatttttggcacccaaaacaggttccatggatgagctcagtgatttattctcatggctaaaaatacagcagggactcctctttgagaatggccatcgtaactagtgaccattcttttgaatggccttaatacaacaatagtgtagcctctttttttcaaagtaggtataatttttggaaaatgtcaagaaaatacagatttaagtcaggtaaagaaggatgctctacattggcaatatgctctaagggcagctaaaatttgtgattataaagaaagatataggagtcattgacaacatcatatgctggttctgaaggccttactattcctctcaggccctgcctactctccgcctcatctttcttgttttcccatcacaccccacttgacaaataccacctatgcaaaggctgcggacaggcttcagaactccagcctgtgtggacatctacttactgtttcctggggctcaccctgcgctcctcccattttcgtctggcacatcctccccttcaagaatttgcacatatatcacctcctttctgtgaagctgtctctgagcctccgcacataccttactcttcccttccccgctaagccatatgcttctgaaagtcaagcatcatgctttatttatcttcagctgtatctatagcttctacagagtacctagcccataagtattcaatatctactgaataagtgaatgaaataatttaattccagagacagctcagcaaagtaacatcatggaatagagtagatagagcaggcttccaagaaaattgctttgaaatatcggtcattagagatttcatgtgtacattttggtatatttgttttaaaaaattggatccatctttggagtctcaccttttagaaagtacatagcacattagaaatacattgcactcatatgcaaatattttgcttaacctgttagaaagaaccatgaggagagacattccattataccaacaaaaagaacaccaaacaaaaagaactggcaattaaagtgataggaataaaaatgtgttttatggctcctaattctttgtgttgtctttattttttttctgttaattgcttagatatttcatatgtataattttaaaaatccttttaaaatcattttatccaaagtgtatttaaaatgagtctgaaggcagaagacagagtctgaagccctgtgaaatggaatacacctgtgcctaatgaaatgtcaagacatcaaaatgcttatccattttgtaggacgaggagacagcaaataatcaccaccatgatctgaaacatccatgatgtttcatttagtaatattcacatcctcggggagcccttcctgggatcaggggagagtcttgcatcaccacctcgtgagttcctgggtccctcgcggagtcttccccagagtccactgcatgcatgatatccacacgggatgcagcaagcctgagagtccctgcaaagggagttctggccctgatcttttatcgtggctgcttgcttccagtagttatttagcacaccccacaaagtactgatgaaagccatttttataaaagtcttacctaatggtttggatatggctgagccagaaagacgttcattcaaataaccgccaggcagattgacacctgttgcaatgtgttcccgcgttcctaattgaggattcaataagaagtttctgtaggttaaagttctacccagtattgccaaaatggagattgggaaggtatttccacacctgctgccattgaaacaatttgcttttaatatatcatggaatgtagtagcgaagaggagataagtctgcagctggaaaaatgaagcctctggatccctgcattgtacaatgggaagtgggagtacaggccagtggacttaatgcacctcgttttaaattgacaggactagcttttctaacacatttattttcttttgtttttaaacagattttcatctaggaagaaacttcattataacatttattgtgtatcttagtccctcacttctaaaaaatccagatctgatacattgtatcatataacaaatgtctattgcttgtgcagttattaacaatactatatgttgcataaaatactatgcaagtcacagacactttatatcttagtcttaatgtggcagctttctagttattttagctgggctctctttgtctctttccctgatctccccagtaagcttccaggtccgcttctgtagtatcacacctggctgttagcctctgctaattaccagctgattgctgtactgtttttgacaacaccctgtgcataaagtaccctatggtctgatctgattaaagttgtaaggcattgcttgtctttgaggctgctctgactccaggagcactcttctcagccctctgggctgtccttggctctctgtaaaacctcctggggatctgccatttcactcttgctgtgactatcgtggatcaccttctttattgctcaccaccaagatctacattggttttgacagtgcccttaggcatgaacttccacattctctgttacagataaagtttgtcccctttggcagagatgctggagctctttcttcttatgccttgcctctttccctaggcagaatctgtgtactacttccctagggctagggctgtggtcagcaacctgcttctcccacaatgactcccctgctccattaactggggctctgggtaggaagggtagaccctagtcttctcagcttgctcctccccagaaggacatagaccttctgccctctgagtgagctggggctagggagaccagggcccagtattctcagccagctgccttgctactacaagtgggagactggtgggagaggggaaccacatcctcttggctgtacccacatgcaacccaaaactgggagtaatgagacaggccaatagcctgtccctctcagggtgaactgtagctctagactgagagccaagaggagatggagccccatctctgttcccactcagaatggaacttctgtcacactgagctgagagatgggagggtgatatgagcaggtcgtgacttaagtgtcactgtgtcttattgttctcacagagatttagtagattttcttgaatagatgcttcactacttggtgttgtaagttaggacaattatcagattttaacagtaattttttaaaaaataattttcagtagttaaatggttgtttcactagggagggggtctgctgggctcctaactctgccatttaggaagtcaatctctttctacttttaaatgtttgcaaccagggcagcctaaacatttaccttcttttcattgcaggttcagaacaatgtcatttaatattaaccaatttgttgttttctaaattataggtatcctggcatctcaacaagataatttccttttaaggccaaaaatgtcttattcataatgacatattctcaaaaggctgtttctggaataaaaaagagcaactttttactcttaaatttttactattgacagatgtcttgatccattcaggctactataaaaatataccatagactggatagcttataaatagcagaaatttatttttcacagttccagaggctgggaagttcaagatgaaagcacagcagtttcagtgtatggtgaggctggttcctcattcataagtggtgccttcttgctttgtcctcctgtggcagagagcagaaagaggggaagcaagctccctcatgtctctttgtataagggcactcatctcatttatgagggcgttacctccatgacctaatcacctcccaaaggccccacttcctaggaattaggacttccacgtatgagtttgagaggacacaaccattcagtccttagcaatggacttccttagctacatccaactcataggacaattaaaggatagtgagctctactaattccctattcagatctgttatcctcggcttacactcaagcatttaatgacacgtaattgatgatctctccactaagacttctgttatgggttgaattgtgacaccacaaaatatgcctgagtcttatgcctcagcacctcagaatgggaccttattcacaaataggttccttgcagatataattagctaagatgaggtgatcagggtgggggatcataatttaatataacaggtcttcttttaaaaaggggcaatttggacacatgaacacgaacatgcacacacagggagagagacacgtgaagactgttgtctcgctgccaccagctagggaaataccagaagctgggaaggaggcctgaaacagatccttctccagcacttccaaagagtgcgtggccctgcaggcaccttggtactggacttccagcctccagaactgtgagacaataaatttctgttgttgaagtcacacagtctgtggtatttggttacagtagccccagaaaactaatatattctcagcctgataggaaatgatttcttgctagctaatatgtcactccaagtttcctgtaacctatgcagaatttatataatgttcagaaggccccagattattataaaactaatattttacaataaagagcaatataagatgaagactacatactggctaatggattatatttgtctcgtggaatccatcagaaaatgattggaagaagtgcattttaatatgaaatttcaagggaagatggaataaatcaatggcaaatagtgaagaaggaatacagatataccatccacgtgagaaaaataaagtcagagctagattgttatctcctgtagcctctactccagagtctcgcaatcatttactcatttaacaaatatttattgagtacccccagtttgccagactcttgtagtctcagtgcttattaaacatctgtggaaatgaagtgaagttataagcctgtctttaagtccctggcaacacactcccttctctgcttagttactgctattttcaggtacttggaaacacatccgtgtcctcaggttcctagtgcctactggagcccacacagctaatatttctctttccccctctctgacccaagactcacgtcaatgttcctgcccagggctgattctaggttctaattgttatatggatgttgttcagaggcctctgaaatgcccctcagtcctaaggggaaatgctaacgggaaaaaacaaactttaacaaatggaaactggcccgtggttatctcaatttccagtaagtttgtctgtaaggccaaaagataaacttaacaacacatttgtgagcatgtggaggcttctggctaaggtttatttaaaaacaaaaagaaaatctatttctttctctagttaacttcttgaccttagatttctagtgatgttcctgtgaatctcatcaaaaaactgaggaagttaggttaatggtatcatttgccaatttcaatttaacatttatgattagcaatggaaagcctaataaatacaatttttatatcagaaaggaattacagtctttgtcctttatatttgctctttcattagaagactctgaaaagggttttttacaaagtaaatgctgcatttttgttccatcaacatacatcatagtttacatcaattgattgtttttctctaacatataggaaaccttaatgttgtaagtacctgtaaaaccgactcttagtaactttctccctccattagaagctgtatttgcctaagtttagactgtgggcagcagggctagaatctcattttgctaaagctcagtactgggcactttggtgttagtgtttgaatcactttctcacatactgattataaaacgaggttttgctttctccctgctgctgtttttcatgcaccatcttctggccctgaatcacctggcactggtttcttccctgtacctgggcagtggccttgacaatgactttgttcgctgtacattgccaagtgcactgggagatttacttacctgagagagacccagaatatagttttagaaaaaagagacttcaaagccattctcatctccttcttatcctgctaccaaattgttaaatgtaaaaataaatttcagttttataattggcaagttatatggtgagtttgattaaatgctttactctaaggaatcaaaaacttttacaacattctctgctgacatatgaaacacaaaaaaaatggtttgcattccttacaataagagaaactggatcaaaactacactaagatattcctgtaacattgacagaggtccgaatgtctcacaacattctctttctgggaggcagtgaagaaacaggagctcccatgtatggctgatgggatgccacatgaccccatggagtcatacctcagaaagttacaggtgcattcttccctggcccggaaacccttctcagagtctaccctaaagatacacctcccacaaatgaagtgatatttacacaagtttattcattgtagctttattataacaacaaaaattggaatcagcccaaatgtccaccactaaggaactagttgaataaattcttatatagctacacagtggagcataatgtacgtttaaaaagaaaagaaaaagagaaagaaatctgtgttccaattggagcaatttctaggatatattgttaaaaactgcaaaattcaaagaaaaatatgtatggtatatatcctttatgtgaagaaaaatacacatacacacacattcttatgtttgcaaaagcaaacactaaaagggtaaaccaaaataaagaatatacaaaagaataggaagtaggaatgaaaggatacttctctaaatatactttgttatataaatttgactttagaaatatatattttccatattcaaaacataaaaaacaaaatataactatacctaaaatattaaaataagcatatgaatttatctataggccaagttaatgacataactacaaagaaatgacttgtttcaaatgttttaaaccagtgttttggctatactaacttagtgagacatattctaaagaaaaatagagacgcaaagaagatcttacactttaatagtcaattttgtagttgtaatattactatcgatcattttgtaactctcctatatagggtgtaggatggtggaaataagtaattttgttaatgttgttaggaaccaaggctatcagtgtaaaatgaaggagttacaagcataagatgaaagaaggtaagtaaaaagctcattagtatagttcaagtttaacttgtcaggatgagctcatgatttttttcctgaagctttgtgttttgtatggatgtcctctaaaaaggcatggaaaaaatgacaacccaactgcaatgaacacaccaatagtcctgattgtcaaatgcaggcatcactcactactgagagagggctccttggaggaatggtgggttcccaggccaggggaggaaatacacaggctgagactggagcatcttactgtcccagaaagcaaagaggctaccaaagactcataggtcacattaaaagaaaaccaaagccaacacaaagggactttggccaaagatgagacaatgttttttaaaaagacaattaattaattgactggaacacattaaatatattttttaaaaagtacattcgagttactattaaaaattaaaagaggccgagcatggtggttcacgcctataatcccagcactttgggaggctgaggcgggtagattgcttgaggctaggagtttgagaccagcctggacaatatagccaaaccctatttctacaaaaagtacaaaaattagccaggtgtggtggcgcatgcctatagtcccagctattcaggaggctgaggtagaaggatcatttgagcctaagaagcagaggttacagtgagctgagattgaaccactgcactccagcctgggcaaaagagccagaccctttctcaaataaataaataaatatcaatgaataaacaaggaaaagttcaaaagaggggaagagtggaccttattcaacattttggaattaactagggtaccaactttttactccgaaagttggcaattaaaagttaagaagtaagcatttatcttgcctttcctgtaagcactgaatgcagggtaaccaaattcccctgttgatgaggggaagttcttattaaaaaaaaattcagccaataaatctggaaagaataatagaattagaagcatcatcattttaaaatgccaaataaaataatggatttagcaaggatcattaaatggatgaagccatttgatgaaagattgatgagaaacttcttgatgtgaagatcagactgtcttcgaatcataaaaagtgagacaaggtgtcatatgtctcctaaaataatgcactatgaaggagacatcaacatctcttcttcagaaaataacaaaaatataattgagttacatttcaccacaaagaatcaagcagaaaatcgtaaaatatgggatttctaaaggataattggtctcatttctcttctgaagtacataagaatagaatgacatatggctggaatatacttcttaagaaggaaggaaggaaggaaggaaggaaggaaggaaggaaggaaggaaggaaggaagaaaggaaggaaataagtgaaacaattgtggcaaaaatattcataatagttgaagctatatgatggctatatgggggcttattatactaacctttctgcttttgtttggtttgaaatcttagtaaaaagttaagaaaatgttttgttatatgaaatatagaaatctgggagcaatttggcctgctcaaccatccacaatacagttgtaggcagcatgataactggcaaggaagttagggccagaagtcatcaagctggctactagtttcagctgaaaatcctaaacatagaagttgagttggtaataataaacaaacgtcccttttaaagacattgagtcatcttaaagcactacccataaaacataaatgcctcctttttccaagtaaataaatgagatccagaattttctcttctttcaaaaagtcgagattgtgcccatgagcctgtctgagtaattcccttctgcccaagacagttcatcaccaagtggagctctagaatgatgcctttataggaacaatgaggattaacgatgaaagcagaccctgaccatgagaagtttaactggaaatgtagaacaaatgcaataaatcgatgtaagaaaacaaaaataatctctcaatttggtagccaaaatgataaaactcaactgcttttttgaagcccaagaaaacctaattctcaaaagaaaaccaaaccaatttttacattcactattaattttaactagctcaccttcattcagtctctcttggatattagttatgcgctatcgatataagaatgaagattggcatcttcattgatgattcaatgatgtctgcaaggagcttactgcctaattaggtatgtagtcatctgagtaactaactagaggaggtccttagtatttgaggaaaattaatgccaaagaagaacaagttacaatagctctcataggagccaaacctcatagagctaaaaaagttatctttattttgaaaaataaaactaagcattatgaaaatacatttgttttattatatttaataagacatggttttgacttacaccgtacactgattcatagaacaaataattacacattgatggagggtatgggcatcatcttatcaacagtttatatactggcatggcgaaatatctttcacttcctctttggctttcacagcatgctcataaagagagttatttaaacacacacacaagtttcaccagctattccataagcatttcttactcaattctcttcaaatcattctctctaggaggagctaccatgacattaattatcacttttagattttttcttcaattatctggccttcatacactgattttcacttttcttgcttgtgatttagagttccccagcatcaccagcatcggtttaatcaacttcatgaaattctccatcttttcatcttcattttgtaatcactttgcattgaaatgccatccaaaaatcagctaggctttccagcagatactaccaagatagtattagtcagggaggcatgattgagggagctaattgtgtaagtggtcaatttattgataatattttacttctctgtggagtgctataattataatgcctgggattatgaatattcaggtaatgagacctcttgaataatcaaagcaatagtgtgcaatctttccacctcagggaggtagcgaatcactgaggagctttatgaagtgattttgggagaaggaaaggaaagttaggaattgttcgaggaaactcctcaaataattgtgacaagcacctcttcccatgagaaccactgaggaagatggggcacatgctctgggagctcaagttgattggatcggggctcacgctgcattcccatggagaaagcagcacatgaatggacagtttgcaagcagagaatggaggcagagagagtccaggaaaggcatgaccatgaagtagaaaagtgaggaattgattgagaaatcataagtcatgtggcgtcatgagagcacaggatgtgtaccagggtgcagtcaaacagaaggctggggaagcagatggacccagcccacaggccatctagagagacagaataaggagtctggaattcatagataggtgatgggaaatcagtgagggtctttgagaggagaatggcctgtcattcacctgcagaaagatggtcattcaccagaatgtgtgggacaagtgggctggaaaagcaagtgatgaggacggagaacaagttgggaggcttttaggtagatggggcccatcttgcctacactaggtctaggtggaaagctggaagctgagccatcatccaggaggtatgacctaaggaacagtgaaaaaactgccttaaatcttagtctgttctggcggctacaacaaatcaccatggactgggtggcttcaacaacagacatttatttctcacagttctcaagactggacagtccatggtattgaaaaacccactgtctgctgagggcccactttctggtttacaggcagccttctcactatatcctcacatggaggagagcagagagagaggaagtgggttccctcctgtctctttttataaggagagtcatcccattcatgggggtccttcctcacgtcctgaccacctcctaataccatgggggtattagggttttaacacaggaatttcaaaaggacacattcagttcataacatgcccttccacaaaatgttttaccactgaccctgataatagtgctgctcatttttacacgactcaatctttctgggggctcaaggcctcttctgagatgcgtgtgctgtttggctggggaagagccccagtggcaaagctctgccttattttcacttctttatcacctggactgggtagatgccctgcaaacattttgttgggacagagggcaaggggaaggtttttttgtgttttttttttgtttggtttttttttttttttttttgcagaggatgaaatcaatgtcacggaaaacttggggtaattggggatcaatttgagagcttcagctggctaaagggaagagaggaatgtcaccagagtccccaagggatgggagagaaaaagaacagcccagaagaaaggacctgaagaaaagttccatctatttcacagtcatagttagagccggcatctctatcctctgtttcatttctcactcctggatattgactttaggacagggaggtaaagcggaactggaaatatttgtgtggtgatttcttcaaaggagaatggattctgaatgcaaatgttggtgttaatattggcattccagccttgtttgttttttaaaataaattagtgaggcttaacagtactttaaaaactaaaatcatgctttaaagactttacatgtatttacctttggattttccaactattgtaatgggctaaattgtattcagtataaaataaagcatgaaatctaccaggaaatctctttgaatatattttcccatgtctgacaataaccactgtcacactttcatttgcagggcagtagtttgcatagaacagtgtaagataaaacaaatttaggttaattttcaaagccagtctttttattcaaagatgagtatttctccacattttctctacgattgactggcctaattctatgtctgcacaaaaaagcagaaaacaaggcaatattccaggtaactcaaaagaaaattaactttttgcctcaattattctctttaatttcaagggaaaaatctttgagaggaagttttgtggacattcactgtacttctttggcagactctgtgtttgcgtaaataatatgagtagtatttaaactttctcttgccgcaattattctttcctctattgtgtaatctcagtggaaaagttttcaggaaacaatgcagggaaagccagagcccttctcactgctttattcaaaagattgccagctcctacctgggagcagcacaaccacattaaaacaagcatctgtctgctgtgggttaggttggggcttggaagcttgtgacctgaaagcaacaggtggccaagtggcacagtcaggaacaaccaggttgaatactgttagtgggctgtgaccttgcctccactggagctgtgcccttaacgaagttcaatgttttttttttttctaggaactacttcctgccactgcaccccaccacacatgcacacacacatgggtgcacacacaggaatgcaagcaagtgcacacgactcccaagcccgtgggtgcattctaagtcccattgtcacagtcagctcattttcagctaagcccttcatcaatggtcttccagcttcactgcaagtccttaaaaacctcggtgtcttggtccagtttcagatgctgattcagaccttagcagattctaggtaggactcacgggctactcagtgggagcctgcagccactcatcatccctgagggtgggaaccatccaagggctcctccagtcacacctctcaggggttaatctctttgacatcccccatgtatgtgtcacagcattatttgaaatcagcccaacccaaactgtcccctggctttagtgaaaatctatctagtctttttaaagaaatgtgataacagatacaaaatttgtttttatatacagaataaaaccctgatatccccaccagggatatgcgcactttcagaggatggaagggataaaactttcctctccttttcaaaacctccctctatctccaaaagggctgcctacagcaaaaagcgttcccagaagtagacctgaccccacacctgctcaccccagagcaactttagagagggaggtgaggaggactgccatgggccaccaagcaccctcgccatgcacctttgccccatccctacccacccaaatgagggagtcatcggaagttaaaggttcttgtttagatattggtccagggttgtcattctgcagatatcattttatatatttatgaatttctacagcagtctaaaatagcatgctatttaaaaatacatcagaatagctccgttctttgttggtaggattaaaaaataaggagagagcatccttcggtgaaaggaggatgagttcctccacacggtggaggagggcgtgttcatctttgcttgggcattaattggctctgcggctttagttcaatcacttcacctctctggaccttcacctttaaaataaagacactgagtaccaatcaagcatcagattaataacatccaggaggagacaagaaggaactggaaatgagtgaaaccagacagggttgtgaggaaacaggacttgatagcaaaactgaagacatttatatttaaaatgttaaagccaaataaaacatgttgacaaattcattgcaagggcagccaatgtgaccgtttccctggagagtttttaagattctcgttgctttcgaatattatcatctgaaaaaataatgttttagtgcatgtggagctctacagatatcatgtggttttctgcaaaagttttgatgtctgttgaatttcataatatttcaaattcaaaagtttagtattcatcatggcaatattttagtacaccacagcactgtatttctcattcctctgaatacctctaaggaagattttctggaagtagcgagtgttgttctttaggtttatcacaaagaaaaagatttatttctagtgggattggagcctctcttctgacactgacttccagtggggagtctggactttctacaatatttgtcccaacaggactgcatgccagagccaccccacactctccaggcttagcattttctgcgctcattatgtccacatgtacagaagatgaatgtctgctatggaaggaggcagaaagtaccaaaggaaaagataattcaccctaaagtactaccaacacttacagtcactctttctggaatgcgccagtagctaaacaataggtttgtgagctaacttcttcctgatgatagctcagcggttacaataactgtgtgagcagaatagtccccataatcttgatttctacctgattttattaaacctttcttgctgtttctctctgtcatttaaaatgcatgttcctattcccatccctaaccacatgtgtggaaatgcactagaaaccctgggttcttagaataagggcacagacaggaatccaagtctgtaatcccacttggcctcgacaaggaaactgttcacagctctgacatgggcgctcgtgccaatgcagccattgggagggcagcctggctggataatggcaaggaacagaccgaaggctttgtctgatctttcttctacataggagggctgggcaaggcgagttaacctaagaacagaagagaagaggggagtggtcagaagtaggcacgggagtccatcgtggagacttggtgaggctatgaggatgcaggcacaaaacctccaggacaggagcagcctgctcgctcacaccttggaagggagaatcagggagcttcagtatctccaggttctgcccctcgggtttctcccactgcccccaacatgctaagtgtatgctgctcttccttaaaaacttgcactcaagggcatctctgatgcatccatacctttgtctttctcagcacagttcagaaaggtggaaatctcaaaacacctataaaaactaaaggagaatgaagagaactttgtcttagagaacacaaccacacataagtccactttccaaatgacaggttttagatcctgaggaaactaacaggggtagcaacatctgttagacctaaaatcctctagctcatgatgggtgccactcctaagattcacatggcaccccaccatcatcagactccccatcccctagaaatgttctgccaaaatattgtctctctctgagaaatgctgaaaaatgtctagttcagatctacatacccatacctcccaggttctggtgtctggtgtcctgacgtgtctgaggtggatcctccgaggcaaggaatcgttagaccatatggagaagcacctagcagtacaggaacccaagtccctgctgaatcattttctctttgaggctgacacacagtgagaggaggaatccccatggggcggtaatgagggagtccaagtggcttgaggagaagatggcagagagacagcctgagcaaggacagctgagtcagcttctccccacacttccaaatccaatgatctaatctaaacccaaaaggtctccattcccacagggaatgaaaagctctagaatcctataagtgaagtcagcaatgggctgctgaataacacagacccagatatgttcacagactgcttccaaaatctggggtggtcgtgccttgccttccctcttccacgttgtattcataagattgcctgcctgtctgctgccctgtttcttaagagcctctctctccaggaagactactgaaggccttagtatcatgaatgtgctcagagaatttgagttcacatcttaaaggcagacacagtgggagaagccacaaatggatgatgtattaactcagacatacacacctagcacttgactcataggtacatgctgctcatgctgttccttgtggatgctgtacctgactaggtcaagtccaggtgactgccccagggaaagcatggtatctgggtcagtaaccgtggagacacgcaggcgccagcatttgcacactgactccccactttggaactgcagacattggtctgatgctttgtgctccacttgttccacctgcaaccttagaggacatgccggctgagctggcatttgttgtggctgtcctgaggacagctccctttgtgattgaaatggtccatttcctgccatctggtatcccagagcacacaaggagtgggaggcatgatggttatcatgaatcttcaggagaggaaaggaaagtgagtctatgtgaatgactcagttcctggaagttcactaaagcagcttccttgcaccagctaaggctgaggacaaagggagagatgcaatcactcaattttccagccggtggctagtggacctgctggagggctgtccacagctgcggctatagctccagctgaggctcctgcaatcctacctgcagaacctccttggggattagcatgatctgcgttccacagacaagcaagctgaagctcagcaaaggcaggctgcttgccaacaccctcagagctaaggggagaagttaggattcaagcctgggtccatctggggccaaaggccaggtcctttccattaaggcagccattcacaagtgttttgtgatcaggatcctcttttcactcaaagatccctgaaggacccgaaaaggcctttgtttgtgttggttacacctatcaattatcattacgatgtggtgatatcatatctaatctaatattatattagaaattaaaacaggaattataagtacatatttactaattcatttgaaattagcagtaataaattagcattacatgttaacaaaagtaaactactttatgtaaaataacttgactattgatacaaaaaaattaatgagaaggacatcattttgtattttcgcgaatctttttcacgtctggctaataatagatgattcttgtatctccttctgtattcaatctgttgcaatagcagtaggtagcctctagaaaactccagcggataagtcatggaaaaatgtcttagaattattataaaaacagtttttacttcaaagacccttgggaaaggtatgagggacctcagaggtctactggccacactttgggaactactgcactagggtacctgcccctgcgtggaggatagagattggaactgctctgtgctgagccctggctgtgtttgctctggggccaccttcacccatgcagaccaaacacttagaacatgaaccactgtgcaaataggtcttagtgacgttgctttaaggaactcaggattgaggtttccttcaaggacaagataccttctcactggccaatgtgggaccaaaagagtagccctgtcactcctatggtgttcacaaggccacacttcttagaaagtggggttagcaccctgtgggaggccacatgcacatccttccataccagaactgacccagccataagccccatccatttctgcagcttgtattcaaaatgatgagagacttttactatgattcaaattgttgctgtaattttcactgtgaaaatatggaccagtgcatgtcgtggggcaaaactgtgggcacttccttcctttgtcttgatcagggttaagcagagtgagggcagcattcaggataatgcccatcagagtgaatcttccagcaagagaagcagacaagggccacgggcaggttcacaagctggagccagatgaatggatatgaaaactaggcagggaaaacacagcaaatagaaagggagagtgggcccacagacctgcctaagtcagggtgtgcagccacactcagaaaacagacctctttcagctccgtccaggtcaggagcatcacaaatcagaatcagaaagggccaggagcaggctggggtttggttcccatcctacgacactcttcacagccacaggaggcttctcagatatcatcgcggacctggttgtaggttgctttacctagacaccattctgtccctgcagaatctaacctcatttctataatagagtacttgtacctattcaactttatcagtaattaaactaaattttgttgatttaaaaaatggtatgtcatatcagcttcaagcatctgcagatttctatgtacatcttttttaaatcacagttttcattaactttgcaaattttgcctttagggtcaaaaaggatctcttaccagccaattacttgggcttttaaatagttttcctaacattttattttctcgctttatagctaggctacttctgtgagaaagatctataaattaagtaagataagtgaattggaagtaactttttcaaactatgttttttaggcacctgtcagtgaaggacaaataaaaaataaatagacttacctttagaaaaatatcacccgaatgcagacaaccattagccttttggcagtcagccatcacgttatggccaccaattaagaaattaaaaggttgcagttccatttttctcgtcactgtattaatcactcaagtctgtattgagcatccactgtaagcaaggctggggaaagcaagatgcctgtcgatacagtttaaccttcccagtcttctgagggttcaaaacatgctgtcagagcttccactagcctctccccaccaactttcttctctgttcttcctctttttcttttcctccctctctccctcacttattcaacaaacattttgtaagtaactttagtagttagcaacaattttcttctcaataaaaagctttatggtgttcactgatgagacctggcaagtatcacatcccggaagctcatagaacgccagggcacacctggctgcaccccttccaacctgacctgaatatcgaccctgcatcactcgctcttctcaggcctctttatgacctcaacctgctatagccttggagaaagagaagagcagagggaaggcccaggagtagtttctgaaagagtctacatgtagatgtgtatgtgtgctttttttattaccttaaactctgttttgcagcatcctcagagtattcaaaatacgaacactgtttctcttggtatctgttaacattacgagggataaatgtgtatgtaaggagatagattagatagatgggtggatagataggaaagagagataggtagatagatgacagatgacagatagataggtagataatagataaggtagataatcacatgacacatagagtcactgaattttataataaaaaatattagagcacaatccctttgttccttgattacagatcaggaaatgaacccaaaggcttatttaggaaccatgatcagcagcaaccttgtccaaagccacctgtatgttgaactccacttctgccttgtgttttagggggcaatggtagcgtcatttccccaggagcttccagtctgaagaaagaacaagcagacaaacatccatttccatgctcactacagaaagatcgttgtgttcattcatctcgctaacccacttgttattttaatttctgtgatctataaatagtaagtccaacagttcacatgcctgaatctgctaagtctgagcatgccctgtttctcaatattaaggatttgaacaaagctcttaatttgtactactctggattgctgcttgtcttgctggctgctttttgtagaatatcaaaagaaaatagatatctaggggccaggagaaccacagtaactcttgccaaggcattcacctgtccatcatggtggaggtacaaagtgtgtttggattccacttcgctcgctgggtttattaatggtaactcctgcctgacaaagcgacaagcacggattacgtctttgatgctgcgttgcgctgcggctttatgtgatttgacatctttgcaaaatgcctgtcttgccacaacgaaaaaaatgtctggtacaatttgtgcaagaacttgatgccttaatacactagatgatttagacattcttttaaagtgtttctctgcttcatgggaatgaagagcaattttcctgagacaccagtgctaacccagctctcttaacacccgtcgggccagaggagaaaccctcccatcctctgtggaagtcaagtcgtcagtattgtcacagttgaattggacacatgtagcgaagaatcaggcctggcagcctggatgggcaagctgagaggggccagagagaggacatggaaatctaatagcagcagacaggagagctgctacccacattgggatttgctccctggaaagcttaaattatagtgatgttggcaactgtccacatagctgctgcctttcattatttgctttctgaaaacttcaaaagtctcatcaccttgtttatggtgaggagagccgagagacgcagcaggtcaatcacctcttggcttccaagattctatcagtgcagagaaacagcttaagagagaacaacattaaaacttgtcacatgtatggcatttgactctaagcagggaacagcctgccctgattagctggtgaggaatccgcagattccattgatggtagcacactcttgatactcttcaattcccaaatttatttgattttgaaatttcttcaactccctttgatagtccagactctaggagtctagagaaggaagtgagttgagaacacacttagtccaaaagagtatgaccttatcaaaacagagacattttacaatgatcatttcactgctgccacttcagtgttcagaggcctctgttaaaggagaatgtgtgtgatggaaataggcctccaaggcatctctgctgacttccttctctgtaagtgagcccttccacctgcatgcagaagggaccaacatctggaccccacaggagtgagcagcctcaatgttatgtgattccaaaccatcagtaaaacacatgtagattttatagtctcaaccaatttgcaattgatcagttgaccctgatcaatgatgagatgtctctgttcctcctcagcctctgagtgtatgaaatctgatctgagacatggcctttggataaagtgatttaacagtaataagacttgtaaaatttatttaattaatatgataatgagggcaatcagggaattaatgggaaagtttaactttggttgatctatatggtgcagttattgaagcctaagtgctccctagttgcatcttttcttccagcctttccattccatatcagaaataggggttaaaaaagtaatagtccctaccacctatcagcattaactgtgctcagagctacactcaaagcaccttattcaatcctcgcatcacctctatgaggtagatgctgtcaccatctcattgcacagatgagtctaggcctcacaagggctaagtgccctgcccacaatcccacagatcatatacataaatatatacatgcaactgccagaaaggcccgggtctgcctggccccggaaccaaggtcttacctacttcctgttctcctgccaaagaagcttcatgtagatgtcagcatgtgtgtcaacaaccacttgatcccagctccctcttttgggagctctgtgatttagggcaaattatttaatgcttctgagcctcatttgccctagctataaattaggaacaataacacatgcccattgttataaaggccaatgtctttggccttttggccacaaatgtctaatatgttatctgatgcatatgaatcactcagtgtctactataggaaagagtgagagaatgaatgaaaaagtgagactctaaggccttttacttctttagagagtcagtacagaaggcaggaagacagggaatcattattagctaacatattcaataagtacattgttggaactatccaataccttataggggttcttagtagaaaaggattcacatgtttttgtccttgttacccatgtctaaatcctggagccaggaaaccagaaacatggccaaggacagcgatccttctttttgcctctccagccagcaaaccccatcatggctcatcagaggtttctgtggagtcctaaggtggctgcaggactccaaatgaacaatctcaaaatcacagggagcctggggtgtcagggaggcagcctcccgacacaggccatggccagaaagaacttggggccagcctcgcatagagaggacttaggtttttaaaatgcagaggaacagaggaagaacatgtcgggtgtgaagcggggctttcgcactgcttcccaggaatcaccgccccatggagggaggagaaggaactccaggcatttgattatggagttacagtggtcattaaagcaattttcagtatcccacttgagaattacggacttagaagagctgcagtgtcacctacagggtcccgctgtccacgctgcctccgccggagtgatgaacctgtctgttgcacattcacgggcctgatgaactgagaggcagctccatgcagtgagcagagctggccctcgggtcagatgccccgggctcaacatcggctccaccggctccaccgcactcttttccccctgacacccggggaagtctctgagcctctccagggttcttgtgaggtctaagtaagatcacatttgtggagcactgggcactagaggtgctcacggaaaagaccgttcctaagaaggtcaagcatttcaaaggctgctttcttcttgttaaatatttcagttaagcagtctcattgaattttcttccatatggggatttttgcttttatttttgcttttacactttcagaagggagtatcattgtgtccattctttcatgggagacaaaacataagcaaagaaaggccttaaagagaccatgaaactagggcaacggatttcatttcatgaggtatttattgcaagtccatgtgtcactaacctgaagatgtgatcctactttcaaaggtatgcccaccacttttcttgtcagtgagtgaagacaggtggagcgacatcccagtgctgttccaatgcctgcccacaaatgtatgtgtccctgcagtaagcccctatcacacaggggaaaagcaggcaattagtaaaaaagggatgagaggttacagaagagccttcagggaaggttaaacagttttgagtgccaagtatataccaccagctcttttatctcattaatcctcctaacgacccttggaagttggtatgatcatcctgatttttcttccaataggaatgttgcccagagtttgcccaaatttacactgctaggaagtggcagacctagaacaaacaggaaacaaaagacaaagcatgactcaatcaaaaaaatgctggctcagaagttaagagtcctggcttcactactcaataattctgtatcatatctcaagatgtggcccagggaaccgcagcaggatgaggaagactaggtgtgggacagccccccagtgggtggtgcaggccccaaaggaacagacacaacccagaggggctggaagtccagagcgtcaggcagaagggcttccggactatgtggacacaatggtcctgaaaaagccctgaggtctcctggcaggtggcaaagattggcaaccaggcaatgagcaacccaagcttgtaggctattggaaggtagcagggccccaggctcaaagatggagccacaagccgggtgcggtggttcgcgcctgtaatcccaggactttgggaggttgaggcgggcagatcacggggtcaggagttcgagacaagcctggccaatatggtgaaaccctgtccctaccaaatatacaaaaattagcagggcatggtggcgtgcgcctgtagtcccagctactcaggaggctgaggtagaagaatcccttgaacccgggaagcagaggttgcagtgagccgagatcgtgccactgcactccagcctggacgacagagcaagactccgtctcaaaaaaaaaaaaaaaaaaaggagccacagcaccaggaggggagtggacaggggtccaggaggctctggtgtctaggaaggactaagatgctggacataggaccatgaggcacagaaacaagacagacacatggttgccaaagctgtgaaccaattctcaggcataaagccaaagccatgtgtaaaccctgtgttggagaggcgttacaggcctggcaggcagcaagcaggcacctgcctgccctagctctacactagagtttcttaaatccctcccctctaaggcacatttcacctgagcgagtgagaccgagcttgtgggtggtgagaagaaacttcaactgtgggagctgtgggcttttataaggacatccagacatttctgaccccaggactttgggtaaattatttaaccagagtgagcttcagtcagtaaatgaagaggcataatgtgatgatttcagtggcagcttgttgtaagaatctgtaagtggtaagactcaacaagcgtagagactgaaatgggatttgcctgcagaggtcagtggaacatgaaacagttttttttttttcttttttgacactgcctaacctacagtgtttaattttacgtgaactcttaactttgatttgcctgtcctaaaattggggataaaggaatgagttctttaggcatgctaaagtttaaactaaatatagcactcctatgcttagatggcatacatggcataaacactgaaaataaaaatctatggccctaggatctctttttaaaaaacctataggagaaaataaatagcttctgttgaattccaacagacaaagaacagagggtaaggaaattctgattgctgagaaagtggagaaagcacagctgcagaagaaactaaaacttaaatacttttgctgtagcagcctttctgcctttaatctctttaattgactgctcccagctacacagaagcacatcttcatctgtctgaaataaattgtgagaacagtctgactggagcagggagatgatggagaattgctgtatttctgtttgccatggctagttgattcctctctgtcatttgcctttaaaaaaaaaaaaagccttttgaaatggaaatggtaaaagttctccctctttcctgaagccctctcctcccatttcttgactcaccccccttctggctgcatctctcagacaacaccccatcctccactgctgctcgctgccagaaggtactccaatcggcctcatccttgtctcctcccttctccactgatttccgggtccatccactggctgtgatggctttccaagcatgtctgcatgcttggactgcagccctgatctctccctgggccatgagcccctattgggcagtcaagggtatttccatacaggtgacctgcaggagcctcacacatgtacaagaactaagtctataattgggttataatcctcagctccaaagcagctaccagagtctctccttccctgggcttccactggacagacgctccaccagcctctcagacacccaggctagtaaccagggccctttgtggactcacattcatccccctgtacatgcacactgtcaccaggccttgaagcaccgtgcctctgctccccatccgtccccatttgcccctgcctgcctctcccccgggaccctgatgggcctccctgccccaatctctcttacctaaatccacctcctgacatccaggtttcctccctgtaacacaggtgtctcatgacactcttctctaaaatttaaaagtagtacctgtggtctgcagaataaaatccacccacctttgtttggattcaaacccactttgctacaaactgtgttctaggctgttccccaacctgggctccatagagtgcacactgtgggcatgctgctccccacccttcccaagacagattgagcccctccagaccctcatgtcactgtgcattcttcactcgtgcctctgccaggaaggcctgccatcttctcacacgctctgacttacaaccaaatctttctcccttgcacttctgcatcacattgcctttacccctatttagtaattatttcacgtggtcttgtactaacattagttagcacaagggggctgcaagtttcttgagtagtgaatggtggtttaggaggcagccctgcagaagaaccctgggaacaaagcccaagtctaccactaatgagccctgcctggactcttgggcaagagacctcatccctgtcacctcactttcctgacctgagagatgaggatcataactgatttgacctcatcaaattcttgtgaggattgaatgtcctcatatttgtatagtgtgtagcacagagcctggcacatttacgtgctcagtgagcgtgagctttgatttttaaaaaattatcattgttattattcctcaacagtcaacaagcactcagtgagttttcaaaattgaattcttccaagaaaaggtggtcaaatccaagaactcgagtcacacgcagagaatctaagaatgatgtgaggttggaatgtttctgctggctcttcaactgaccacttgcctaaccctgattcccaaaacacgttgtggaaaagagatgagtgacccaagcccattgactctgtgggaatgaggtcagactcgtaaaggaggccagcattctcctcccctcccctgacaatcagcgtctgtcttccagctgagtgcagtggaattcgcgagagtgcctttgccctgtcaccaaggtggcgaagtggcccaggtgcagtaataatcactctcagtgggcgcctgagcccctcaggcccagcactgcctgacagcgctctgctgcagccacccatgaaggacagtgacgagaaatcctgtcagctaaagacaactaagtgctttcctgaaaaagaaaagcatcccttaaagatgctcatctgaggagattcacatttagtctacccaaaatcatgtatggaaactattcaaggaaacattatgccactttttaacctctttatggcagttgaaaatttcatagagcacagaatggaagtatttctcagatctgtggctggcagcaggaaaggggcatcagggtggacgctgatttccatggggtcctggagagatccctggactggtcactgaggggaagaagaaaggagacaggagggagagctggctcgtttgtggactgagcccaaaaccaaccgtttaccaagccccggtgctcatccatgcactgcgaaaatgtgaactcatctctctctaaagctgcagtgggaggggacaactctgagatttctaaagctcttttcagccacaaagttgtgattctattagccatcatgccagttcatagctctaaataaataaaggggaaaatatggctttgcttatttaaattttttttaaagccaaaatccttgaagtgacaatggcagagtcaaggctgacatccagggtcccaactcccagtccagtattcccttattcccaacatttgcacccggcgctgcggtttgcttgatgcacactgccccttccttcagtcttaccaggccatgtgactcccatgaaacagaaacattttcaagccctccaaaatttattcacaaaaggatatgtaaaacaatggaaacaaaaagtccttgaataccttcttgctagtcagcctgattcaaataggagaatttcagctctggcagcatcaagtgtgttaagaacaggagaacactctgagctgctctcacgtttctgttcccaccatgtgtgtgcaattcccgaggagcctcactaaagttggctacaccaaatgatttcctgccattcctgatgaacaatggagggaggagaatcatttgtcctttaagctgtcctagaaggctaagaagaaatttctggagctgtccaatatggctttgatgagaaagtaattaaagtcgccagcagaacgatcctcatgtttaagtcagataacaatgtcattgacagcaacgttctgctctgaagggcagggatggaagacaaatgaaaccagatttaccctgagtagttttattgacatccttcttgtgtccagttactaatatttagtccacaattatgcatatatgacattgttttactgattatttcctcctttttgtgagaagaaatgaagacaaagaaattagttgctctattgatcctacgacagacatatcttcacttttcttttctttttcttttttaaatggagtctcactctgtcatctaggctggagtgcagtggtgcaatcttggctcactgcaacctccacctcacgggctcaagcaattctcctgctgcttcagccctctgagtagctggaattacaggtgcgcaccaccatgcttggctaatttttgtatttttaatggagacggggtttcaccagattggccaggctggtctcgaactgctgacctcaagcgatccacctgccttggcctcccaaagtgctgagattacaggcatgagccactgctcccggcagtatctcttccatgacaatatttacttaaagtttctttctattattacttcctttttcgtggcagcaaaagagcatcctttaaatgtcctttaatataactaaacaagttttttaaatctctggttctgtttaagttctttaaaacttggtctgattttttcttgatgtgtataataaccagagagatgcattttgccactcaagcgatattgatgtagctcaggctcacaggtctcacttaatccaatcagtctcaccgctttcccctccttcctgtagcagttatattttatgtgagaggtaaccataacaaagtagtaaggaacaagagtataaaagtataacttcaagtaaaacattgctttgctacttattagttaacagtctgttaattgccaatgaagacaatctcattttctatagactttcaaatgatatgtacccattgttacataaactgtattcttttgataatcaaaatatagagatttgcattaatttatgatcacatgttataaaattccttcatcataaagaaataatgaagccatgtcatttattcaaggtttaactgtgtcttctacagtaagaaagagaaacctcaagcagagattatacttggaagtcagttattaatatgttaaaaatgtgtgaataatcaagggaaatgattagaatattaaatagaggccttgtctaacatcaagttgcctaactgttccttggtcttcaaaggcaacatttattcacatatttactaatcagatatttagtcagcttttgcttcttgcaaggcgcattcctggaacctacaggaattcaaaaagtaatagcattgagtttctgttctccaaaagttttatagactagcagaagaaatgacgagtggcctaagagagagcacccaataagatggaagccacagtttgtttcatatgtaatagattatgaattgtatatattagatatatagtatataatatatgtaagatatataatctatgtagattatatatagagatctctatgttgagattatatataatatatatataatctcagatgtactatattctatttaagtccagcccacaactaaggaaaggacatttcacaagtgcataaagaccaggaagtggagatcactagggaccatttaagaggcagctgaccacatatacgttatttttcctgtttaaatgctaagattcactgttgtgcctagagtgatccatgcaattttccgagccatctttaatgaaaagtctaataaggatgctggaaagaggacaagagtgctgtgtgtctcttcctctgccttctatctattattaaggaataataatttttcctccagcatctcaaagtagacgccacattttctacacattcatttaactcacaaagctccagaccaggcctttaatttctgtgccatcagaaagtaatgtggtattggagtgcctccaggacagagacctaggtgtgcaggatagctgtacatatctgttcttgtttcttgttcagaacatttagtcctgtcaaaacaggcagagtacatcttacatcactaacaatagtctgtgatcatgcagaggaaagaaaagaaatcttaaagacagcttgacaaagtgatgtcagactataggtactgccttttcaaagtcatgattttatctgagattattcagatcagaaatcaagggagagttttatccttcagaatgtctgattaccctgttaggttcatataaggcagggagggcaagggcacctcacttggacaggggagggttaagcttagacattggcagagactggaagaaagaatatattaatccatcagaaaaaccatggctgtaaaaagtaatgattatgtcagaagctaaatacataacagcaaagttatcttcatgtaatgtaggaaaagatacagatccttagacctcacctcacattcagcaagcgtttattgagctcctgttgtgggccgggtgctgagtctttggatagagaaaaaaaaatctgaatgtatgttaatgaactattgctgcaggaaacccatgtctccttttgtatttgcaaacgattaaactccttcgaagccactgttacagaagaattcctggtctccattatttttattttctaattttcaaacaattaaaacctcattagaaaattgttttaggacagggtgattatagggtgaaaaatacatagattatgcagtcatagaaactagatcattgtcttgcgagttaaaaactgtagacttgggcataaggcttcaattcatagagttatacgaattaaacaacacaactcttgacagtcttctactgcggtgcctggcgtaaagtagccttatggtatatggatgccctcattattattgataatcatcatgctaatcaaaacaatggtcacctggtgactcagaggaacggcagagttgaagctactgcagtagaagcaatatgattttgtctttaggagtaagtatagcactaagcaatatgaggtcatatttttccactcccgccataatttttaagtttgtaattaaagacctggtctggagccctgaaagttaaatgaatgcttagaactaggagaactctctaaagggaggcactggaagtgattaaagggctaaaaaatggagcaacgagaaaagtccataggtaataaagctacagagtatggaaaagagaaagctctgaggcttctaacttgggaaacgtaagactggttgttcttcattttatttcggtgatgttatagaagaaacgtctggattagcatagaaagtttcaggatctttgcaaacatatttaggccatgagtctaaattacatgctcaccatgtaatcttaccctaccagttccataccctgtgtgaaccatagcttcacagtctcattcgctggaataatagtgactgcagggtgctcaaggatctggccagatattacttggctgagatcagttttgctgatagaaagtcagtcgacatcaatatgctaaggtgatcggaggtggattgttctgggctgcaggaagagcttgactcattgcagaaggccagcctggctggaggatcacaagcaggggggtgaaaagaagaggacgatggcaggggacagtggccagggcccatcagtcagctcatttccatcaatggcgtttagctatattgtatctagccaaaagcttccaatctgattgtagccagaaatgtattttacctgataccacagcgattctctatgaatttaagccgtatgcccaagtctacagtttttaactcacaagacaatgatctagtttctatgactgcataatctatgcatttaatcccataatcactctgttcttaaaacaattttctaatgaagttttaattgtttcaaaattagaaaataaaataatattcaaacctgctctgaatattagagtcccctggggcggggttacatatcacattgcccagaccacacccagaccaattatatcagtacctctgaaggtgggagccaggcatcagaggtgttaaaggtccccaggtgatttaatgagcagcgaaggctgagaaccattgtcgtcgtgggtactagagaggcttaagtgaagaagccccacaagtgaactctagtttctctcttccctaaatacagcttttagaaggcatgtgggttttcccaagcgggcagtttaggaatggagtagatgatgccttacagcccattctgcacccagccacggtttaggagagaagtttttcttttcttttctttacatgctgtctaaatggccaagcatttcataaattggttaattcggttcacacaagtctattcaaaagggtacagtcgaatctgatgttctctggcacaaggtagacaaaaacagttgcatatagttgcttagatttttctgttttcaaattttggatagaatgcagatccacatatagatttagaggccggaggagaaaacaaattaattgcaaactggtcatcactctaacagactgacagcactccaactttcaaaaaagtgtagctgtagggtattatcattttgctggatgtatgtgaatcacaaaagtagaacaacatatccgatttcaatttaaaagtgttgcttttcatcttcaattacttgtttttagtttctgttcagaggtatcatcattatctgttaaccgcataacgaatgttcatgcactaccttttatgagcaaactgtagaaaaagtacagcactctggggacctagtatgatctagttggggagatcatcaccacagttttctgcaaggcagatgctgaatggaatttgagtggtattggctacaccaagaagaaagacaggaatctatcaggagctcgtgtcattcctattttgggagcccacagaaggtgtcttaaggtggatcccctgagaaagagacagcgatttgggtgcagaaaatttactgaggtgtgctctcagaaacaacacagtgagggtggaggaggcaggacaggaccagaggagctagatggcaatgttcttgctacagaggcctcagcccatccccctgagagggaagcctttcaactgtcccttattaaggcaagggggtgagacttcctatctacacctcgagtggccattggattagacacaggctgtactcatggagggggtgtggatagccgtggcagggcagatccctgagagggcattcagcttacagccatcagcagcaacagcatttcaagcctgacaggagctcctgatggttctctgcaaacactttcccatctcagtgaatggcaaatccattcttctagttgttcaggctaaaaccctttctgctattctagatttctctgtatgttttacatgcacatctcttccatcagcaaatcctgctggttttaacttaaaaataggtccagaattcagcatgcgtctcaccccctccgctgccctcatcctgatcctataactttgctcaggtcctggtagcctgaggtactggtctaaccggcctcccctcttctgccctgtcccctcagtccattttcaacacagcagcccaaatgattctgtgaaaacacaaagccagttcatctcactcctctattcaaaatccttcaacatcgtcccagatcttttcggaccctccatgacccaccattcagtgaggcacaggctcagtgatagcggctgtttcctctgcctggaaggcccttcctgacacctgtccagctcctgccctttttcaggcagtggcttgaaagtcgccttctcatcacgaccttcctgcccgtactgctctctgatgcttctgctctccaatttgccctgcttttttttttttaattagcatttacttctacccattttcccatacttttgttctttagatttgattattgactgtatttcccagtagaatatgagctccatcaggacaggcagcgctttctcctgctgcagttaccggttatctccaattacttacagcggtgtctgacatatgttccagcctcgaataaagagcatgaaaaccaagaagagggccaggcacggtggctcacggctgtaatcccagcactttgggaggctcaggcaggtggatcacctgaggtcaggagttcaagaccagcctggccaacatggtgaaaccccgtctctactaaaaatacaaaaaattagccggagtggtggtgggtgcctgtaatcccagctattcaagaggctgaggcatgagaatcgcttgaaccctggaggcagagattgcagtgagccaagatcacaccattgcactccagcctgggcaacaagagcgaaactccatctgggaggtcttccatgacacaacacctcattggtattccaatgtattgggcttatcttttaaatctgactgttctagactccatgattcaatacgaactactagttctaaccgttttcactttcatgttttgttgttactactgaaattgtattcaaatatttttaatacatgaggtaattgaactatctccctgaggcttttaacaggagtgatacattcttaagtagataatgaatcaataacatgatctcctgagacctagttagggtcctgctacttagcaaattaataatgaattgattcattcctcagcagtgtccagattctcagtctcttcaataactgaccattcttttcatcacttaagcttcaagaaagtttttgtttgggttttgttcagcttggttgtcattgcttactcgggatacttaagaaaattggatgggtagagtggagaaaattttggaactattactctctatttttcattagctgcttcttccaatttcttccttctgtatccaactcttaaacaacaatgatgacagctggtaacacaatgataaaaggactttgacgttaacagtgaaattcttgctgtttgatttctgaaataaggatcactccaacaattgttataaaaagccttggtatattcagtcaagtactatgacaaacatagaaagcacttggtttgttttgttttgatgtggtttgggctttttttttatttggatttgttgctactgtcttatagattaaatctttctctctaagaaagcaaaagaacaatgagctgagtcaaccccagtgaaaagattgtgcataaaaggaagccatgctatctttctagtctagaacaacaaaaacaaatatccagaaagatgtttagaaagttcctttggctgttaaaggactataaatcatgctgctataaagacacatgcacacgtatgtttattgtggcattattcacaatagcaaagacttggaaccaacccaaatgtccaacaatgatagaatggattaagaaaatgtggcacatatacaccatggaatactatgcagccataaaaaatgatgagttcatgtctttggagggacatggatgaaattggaaatcatcattctcagtaaactatcgcaagaacaaaaaaccaaacaccgcatattctcactcataggtcggaattgaacaatgagaacacatggacacaggaaggggaacatcgcactccggggactgttgtggggtggggggaggggggagggacagcatggggagatatacctaatgctagatgacgagttagtgggtgcagcgcaccagcatggtacatgtatacatatgtaactaacctgcacattgtgcacgtgtaccctaaaacttaaagtataataataataaatagataaataaataaataaataaataaataaaaaagaaagatcctttggctgttgttgctcagatagtatgataaactacacttttctatttggttatctttatagattgtgattactcttcattccttgtggttcagtgactaaatctgatgaataaagttgaaaaatgtaaggcagtggtaaataggtttctggaataacctagcaagtgctatgctactttcactttataacatgcttcccaaaataacaagtaggtaagtgaaattgactttttattcaagcttttagacagaattgaattcaagcccttgctttatttctctcttctaataataatagtgattctaaaaacacttccgcttgtaaagtgttctgaggtttatcaagtgctttcacatatgttatcctctttgattctcacaataactttttaaagagattaggcaatcaaacctctggtagattaagcaaatttcccagggtcacaaaacgattaatgatggagctaaaagaaagatgaaaacttatctttgaagtttaagtccagggatcttcccaccttgccatacggtttacttgctggaggcaagttcatagaaaaagaaactggatccaaccaatgggccatggagctgacctgcaaatgtcagctctccctgaagcctaatgcagcaacaacaaataattctgacactaagaggagacatccaggcatcgcaccttggcatctctctctctctctctctctgtctttccagggacacgtcaacagacaacaggcctgcatgcaataacagtcattgaaaattagctgatggtagttatttaacaaatttagggtataaggacagacactgaataatttgggctacacgcctgggttttagactgagacttgacaacaggctaaattgcaattcctccctcagtttgttacaataaccaagttcagtcttaattgacatctgtgtgtatagtgagtaaatactgatttcagtaattgtatttaaattgaactgagtctttggaagaaagaatgagacactagggaagcagctgcaggtggcaaatggtagggctcagaacaaaacgtccttggttccagccccacctttgtcttcgctaattcagtaagctcctgggagccatttgtcttctcacctttctgcacttacaccaaggagaagctgtattgatgtatgtattaatgtcccatgagctttaaggcataaaacaaaagaataactatggcctatatgtgctgaacatatacaagactaaaatattagtggttccatgaattgagaccatactaaataaaattacataacattgggactttttcaattcataaataaaattggcagtgaaaaaacattactagctagtagaattggcagatattcatcacctacaatgtgaggaattctatgctaaaagatataaaaaatataaagttgaaaagtacacagctcttacttccaatgcatcacaataatatacacactgcacaaataaaggcataattttacaaatgcaatacatacagtagacatatagtgttgtgtatatgggtagagcactggggatttaaaggaaggagagaatgcaataatgggagtggggaggctgagggaggacctcacaaacagtagaggatttgatttggtccgtgagatgaatattgcaacatgtactggctgcggaagtatattcgagactgaaggatgttctaaagcaaagctagtgaggcaggaaagcagaacagcaagtagtctacatcgaatcccagggaacacagcagtgcaagagcagctgagaaaggtaggctggaatcacgtgaaaggtggagaatgccagacgggtggtttattattaacgcctcagactttggggatagcatgagaaacttcaagcactggaatgatagcatcagagttgcacttcaggaaatttaattctgcagcaaagcataaaattggaataggaaaaaaacttgaggtaaagagatcagtgaagacagcattgcattcgtttaataagaagtaacaagatctaaatgggaggggtggcaatgggagaggggaagataaatgggtgatggattgcctgtctctgtgacatcaatacagatatgaatgtctttgagctctatggaactggcaggtaataggcttatttagaaatgacattaagtctaagacaatgccccatgtcaacatgtacattaataatatgcataatctattaaatcaacaacaacacacatcttgaaagttatcgtaaagccaaatcttgacactttttttttttttgagacaaagtcttgctctgttgcccaggctggagtgcagtggcacgattttggcttactgcaacctctacctcccaggttcaagcgattctcatgcctcagcctcctgagtagataggattacaggcgcctgccaccaagcccagctaatttttgtgttttagtagagaaggggtttcaccatgttggccaggctggtctcaaactcctgacctcgggtgatccacctgcctcggcctcccaaagtgctgggattataggcgtgagccaccgcacccgccagtacataatttttaaaaatagtagccagttaagtcaaaagatgctttatttgcctctgttatgcaataaaaacgtggcccctgcttattctgaagtgtgagccatctttccttgtctggcttactctattacttgatctgttacttgatcttaaaggtcagttttcacatcactttctttgggaagccatgactatccctcagattaagtgctccttctatgcacgacagtatgagcctcaacttatgttatttcttgctgactagaacaatttcttcattagactataaactccatgatgtctgggcatttgtccaatttgttctcaaacccggcaccagtctcagtgcttggcacataggaagtgcttaattaacatttcactgaagtagtaagtgctttctattgcaagacagatctttgaaatgcaccattcttgtcagacccagtcaaactcacaggttctgtctcatgagatcagcaggaaagcattgccacagagggtcaggaatagattctccatgaatcagttcacttgaaagacaagaggtgttagtttgtgtggatgggagcaaacctttcctttagtaactccattatcaagagcatccccacagtccctacataatccaaacgcacacctgggccatcccaggagcacagcttgagggagcttatctgtaggagcacatgcaactgactggcaattaatttgattttgcacctgcttcagatcacctcggggcattgccctgtaccccaggaatcagtttcttcaaagtacaactttcaaaaatgtaggcttgcctctcaaacaactacccatatttccatgaccaaaagtcatatttacatcctctatgcgttacaaaaagtacttgttttagacacacaggcagggtgccaagtagaccataaccataattgttatagtcaacattttttatagttaacatgagccagaatgtggacttaacgctttctagacatcatctcagtctattcacgcaatgattctatcagttggtactatcattatgcacattttacaggcaagaaaacagaagcacagagaatttaagaacctttccagggtctgcttttaatattttcagagataaatacaaggcatctaataaaaggcactgctaaatatcaacctgtcaggcactagcagccaacaactggcaggttcttctgccacgaacactgaggtttgtttcaaccacacgtcagtatcacaaagagaatatccacaagggaaaacaacctccttgtgtgtaattcactttggggaagctttgactcttctattcactgccaaattccttgaacctggcacgtgttaggaatgaaataggtatttgttgatgaatagagttcagtccctgtgaatgggacttcattacttcctgaacttcagcgtcactctcagtcactccaccctgttgcctattgcagatcacaaagcagtggaccacagacattttcattttccccttggcctctggcatagagttttacatttaattagctgccacggtttaaaaaaatggcatactttacgtaaaaatgtggatttcctaattcccataaaaaactggaacatctaaatctctgcctgtattctgtaatggtgacagctgtggtgagctgtgactgccctctaatgagcacactcagtttgccccagtcctcatcaagccctattgtcttaactccacatagaggccctcaataatagagtcacatatggtcttacaacctagtggcctcactgaatgatattcttttctgatccctggaggcacacagttggcttagacctagagtaactaagattccagcctagagttaggtcttccatgatttcaaagagccacaaaaaatgtagcatcaatgccaattctgggatttgaatgctcacctggaggttggcccctcaccgtttgggaatttagtcttccttagaatctgttcttgccccgttgtttgtttcattcaacgcactctcgtctagcctctctcatcatctcgatgacaactactaccctcaggctgataattattagattgagatctccagccttgatccttctgagcctcaggctatcacatgctacttcctttaacatcttcacctttaactcttacagtcacctcccaaatgagtatgttcaaagcagaaagtgcccattcttccatcatttcctcccctgtatcttctatctgttggagttagcccctccgttacccacgtgagaaacctgggtggtcccataatcttccccctctgagctcactgcattcaaaccctgatccctgatgactgtgtcaagctcattatctcttctccatttgccttgccacttcctggtgtgggcctcatacctctcagctgatcctctgtaacagccattctctctgttcaaggcttcttcaaatccaccctgcatggagacatcagagcaatcaagctacaaattaaatgtaattgagtgacccagctacttaaatgccatcagcggctttcctttttcactcagtctagcacgggggctctcaggggaagcacctccctctctaccccatcttcagactggattctcacattttacttccctcctcgttcctcaccaacaccatactgctttcagttccctgggtaaatcataaatgggtgactggagctatctctggggtgatataaacactaaataggcagagacttttgtaaggaaaacacttcttcacaaacatggaaatggaagtctatacttgagttgaaaagaatttaacttttcaaacttagatatggacaattgcacagagtttcttttgctttagtgatgctagctcaattccttttctccccactgcctttgcctggttaattgctactactgagtatttatgactctgctcaagtattttcttctcctgaagcctttcctaaaactcatggcatgctcacttgcgctctctctctctctctgtcacacatacacacacacacactcagaggctgggtttgggtttggtgcccttactgtacattcctttaaggttctgtccatacatttatcacggaacttaataagtcatatttaattatctttttgcatttatatctccctcacttaacttgtacatgcttaagaataaaggctgtgtgttattcttctttgatccccagaaccaagcagagtagttcaaaactgctaaacgaatgaatgaataaataagcaagcaaatgatgacaccagaaaacatatacacgagtcaggcattaaaaataggctctgatatttaggataaattgagccggaggcaactcaaccaccagtttgaaattagatgatatttttgccaccactaatcatgaaaccaacccaaactatgctaagaagttaagcagttgaatacattttgtatttgtctaaatgtcctagtataggcaacagaatagtgttcctcaatcagagagataaaattgatttttaaatattgactgactttctgtaaattcatagatgatgtaataacattgtggaataatgatttcctaccactgcctacagttgctattcacagcaaattatttaccagaatttccaggtaataaaagtgaatcaggtcagtgccacatataaaatatggtaattgctagtaacggtctcttagattattactgtagtactacattttgcattatataaacatgtattggataatagcagcattattgaatttgatgttcagcagttatctaaaaacacttataaatgatgctctactatacatagaatagacgtccaataactggaagaagttttctcaaagtaaaagtatattagatgattattcccagaaaagttaaaaaataaaaggatgtgttaactctaaagtatctatgtttagagctgggtgagtatgtcaaagttgatatatttttatggtattaattgaaaccaattctttaaaaaaaatttttttaatagagacaaggtctcactatgttgcccaggctggtctcaaacacctggcctcaagcaatccccctgcctcgacctcccaaagtgctgggattataggcatgaaccaccacatctgaccctggaaccagttattaattaaaattttggttactggcacatatataacacaaggggaacaaattctcaccatttctctaaaattaagacaacagaaagagctatttgtaatacacactctgaatagtaagctctgtgtaattgtccatatttaattttagaaagacttgttctttcaaactaaatagtagacttttatttcaagagcaaatctgcctcaacagatgtcttacttccaacagtgtctagctacttaatggttatatcattccaagtatatcatttgtttatttatccaacaaatgtttattaatcctttgtttcccagtgtgtaaaggtgaaaaagaggcagacaccactctcttatagtttataatcattaccctaatctgcagatgagctcattgagaccaacactcagggtctcacgatgaggctactacaggcagtctccaagtacagattatcatttgcgtagttaaaatttaattaaattgtattgagacaaatagaatgttatataacttttttcagtctatgggaactggatgtgatttatacaactttatgtgctttaaaaatatttgtaggacttctgcatccaggaagatgtagtatacatgcatatcctatttttttcactaagtaaaactaaaaaccctggacattatatataaagcaaacataagaaaactctgaacagtatagagattagcaagaccagacagggacttttggcgcccaatgatcaacatagcaaagagttccctgagttttctttttgcctcatatgtttcagatttggggatgacgtctggcaacctggtaatcccatcaatcaaaaagcccccaaaaagcctgcgctctctagccaaatgaccaggtagagagacatcccagcaagacagtagacttttagacagttgccactctactccagccaaacaccacagaaaacacttcccaccctcatttacaccgccaaggctaagcaaggagctgacttccaccctggtcaggctataacgagtcatcccaaaccgcaccggagtggtgttagagaagaagtccggactttcatccctgctaggcagcgagtctgcttttctcaactcccccgtgtgtcacatgagactgcatggggagcctgaacttccacgcccatccagtggaaaccagggagcccccctacttcagtgtagagtcagcaaaacctgtgcaggacttctatgccaaaattataaagcactgacgaaagaaagtgaaagggatctaagtaaataaggagacataccatgttcattaattttaagactcaacatagcaaagtcgtcaattcttcccaaatggatgtgggtttaatgcaattcctatcaaaatctcagcaatagtgtttctagataaagacaaaattattctaacatttacatggaaaagcaagtgaactagaatagctcaaacaattctggatgaaaagaacaaactagtaggaatcaatttcaatatagctacgtaatcaagaccctgtggtattgctgaagaaacagacacatagatcaatggaactaacacaatatacccacaaatatatagacacacaatatacccacaaatatatcaaactgatgttttgtgaagatgtgatggcaatttaatataataaaaatagtctttccaacaaatggtgctggagcaactggacattcataggcaataacaaacaaaaaccttcagcctaaatctcacttcttatacaagaattaattcaaaatggataacagacttcagtgtacaacataaaactacaaaacctttagaagataatactgatgaaaaccttggggatctagagcaaagagttttaaacttcatagcaaaagcaaggttgataacaaaaaaaaaagaaaagaaatattgaggtcgggtgcggtggctcatgcctgtaatcccagaactttgggagccaaggcaggagaattgcttgaggccagcagttcaagaccagcctgggcaacatagcaagacctcatctgtatgaaaaaaaaaatgttttaaattagccaggtgtggtgacatgcacctgtcataccagctactctggaggctaagctagtggggcactgaggtagaaggatcacttgaacccaagagttcaaggttacagcgagcagagcacagcactgcatttcagactgggtgacagaccaagaccctgtctttctggaaaaaaaaaaagaaaagaaaaagaaagaaagaaaaagaaaaattgctaaattgggctttacaaaacttttaaacttttgctctgcagaagacactgttaaggggagaaacaagctatactacagactgggagaatatatttacaaaccacacatctgacgaatgactcatatctagaaaatataaagagctctcaaaactcaacaataaaaaaacccaaataatctagctgggacatgggcaaatgatatgaagagacatttcaccaaagaggatatatagattgcaataagcatatgaaaagatgctccaaaatcattagcttttagggaaatgcaaattaaagctacaatgaaatattactacttacctattataatggttaaaataaaaaatagagataacatcaaatgctggtgaggatgcagagaaaatgaattccgcaccaccccacacacattgctgatgggaattaaaaatgatatagccactctggaaaatagtttggcaatttctttaaaaatgaaacattaaaatagcatatgaccaagccattgcactcctggacacttatgctagagaaattaaaaatatgtccacacaaaaacctgtgcatcaaaagtcatagcagctttatttgtaataccccaaactggaaacaatctacatttccttcaaccggtgcattaataaacaaactgatgattcaatttatataacattcttggaatgctagattatacaaatactgagcagacgattggttgccagagggtaaatatggggtaaggatggagggaggtgttgtggctgaaaacggtgatggaaatattctgcttcctgattgtatcaatattaatactccagctgtgctatcctactatagctttgtaagaggtcactatgttagtgctaggactgtcttagcaaagtatcatagatggtggctcaaacaacagaaatttatatctcactgttctggagtgtggaagtctgagatgaaggtgtaggtaaggttggtttcttctgaggcctctctccttggcttgtagctgcctgtcttctggtgtcttcacatgtcttcattctgtatcagtcctataggattaggactcacccttgtgacctaattttaacttaattacctctttaaagcctcaggcttcaaatagagtcacattctgaggtactgggatttcaacacacgaatgtggggcaacagacacaattcagttcaattcagcccctagcagttaccatgggcagggaggcgaactgagtaaagggtatacaggatctctccatattatttcttacaactgcatgtgaactcacaattatctcaaaatgaaaagcttctttagaaaaagatttgtaaaggagtttgattaactaataagtcaaatgtagtggaagtggctggaccttaactggagaagtaattagaatgtgctcacattgaagtttagtcttttccctgagataaaacaaaatgtcagaagagggaaaaaatatctaagtgcctctgtttgctttatgtatagagagaagctttttagtgatgttaatagacataatttatttaattcccaaaacatcattaggctgtacaactccatgtatacattgaatgagaatttatttcacattaaagggaattcagaatcaaagttcaaaatgcttttaaatgccagtatttaataatatcagtaactacaactaaagatcaattatcttcaccttcagtttttccaaaaaaaagagatttcagaaagcagattatctttagcttgaaaactcatgttgttcctagtaatttgagcatcaaatgtataaacctgtgtttatgttatcgcagccgattctttgttagcatttatcaaaaacataagacagatagtgtgtacaacttctcaatttctcagggtatttgactactatcactacatgcagtcatctgaaatcagacgtttcagttcctagcataaatacattttatgtatatttttgtcatccgatactaccttctgtattttttctcaactgtcttcttgaagaagctaacaacctattcaagaaaaattcacccttatcagataagactcatttgttggggttactcaactgaactattctagcatctgattctttcttcatggactggaagagcaaacccattgatcattaatccaatcctgctcacataatattacgggttatagcatttagctcttcctagcatctgattctttcttcatggactggaaaagcaaacccattgatagttaatccaatcatgctcacataatattgtgggttatagcatttagctctttctataatttcaaatgccttctctctgtggttgtaaattttatccaggagaaggctcactgcaatctgagcattggcttgtgtgtgtgctgggtggctggggcaggaggagggttattcactgttgcaatgtgtagtgaactcagaagccaggccacctgggttggaatcctggctccaccgtttactagctatgtgactttgggcaactattttaacctctctgcatttgtctccttagctgaaaaatgagggcaattgtagcacttacctccgaggggttttctgaagattaaatatttgtaaagttctttaaatggcacctggcaggaagtaaatgctgtgccagtgcaggcctttagtgcccctgtgctgcagtaaacagcctcctccctgtatgatccttgcatcgccagtttgcctttgtcttccattagaaaaagacagatagtgagagcaaggcggtcttcataggaattgcagtgatctttaccataggtgagtggtggatcattgaacatatctacacattaaatattgctttgtaaatatgaaaacgttttgaagaaagaaatctgaggtttgcagaaaattccatttaccagaggaattatgttagtcatattcctattgctcccatttcttctgggaggccttcttgtctgccttcctgaaccttattttcattaactttttcccaaaaaagtctacgcttggccctctaaaatctaggctctttccctgcttgatcttacctttccttctacactagaggagaggaaaggaaaggaagatcatggaatgcatgtttcaatgtggggccttctgtggccaccaaaggcctttctgagtaaagtagcaggtggggtagggtcttcactcatgtcctgctctcgtgatcatggcctgccctctgtgtccagccttcaaggtggcaaactggcttgtaaaggagtatcacttttgtgtagtttactttatatattttaaaatttaaacctgaaattcaaattcactttttaaaaattcatatgacacttttttcacagtaacaatttttttcccagcccaagaattatttcttatcattcaaaataccaagaccaaaatatatcacagaggaaaagagctaactatctaaatgcaattggtttataatttcttaaatactagttaacaaacaagctgtgccttggaactataacacaccaaggagagaatgtgttttcattaatggcataaagtaatagtgagcctatacagaagtcgctaaatgatgacattacacataggatttagttctgtgcattataattgtgaccaaacaatagttaatataggaagagataataataataaatcattaacttgggctctgtttacttttttatactctcattttcaagattactgatttaagtgtagttttctttttatgggtctaccaatggtcatttgtacataaagagaagtttcactttctatgagtctatttcacccaagaaaaaaggcattgtcacctcttcaaagggaaaaacattccttaaacaaatgaaacctttgaaaaggcaagtataaccaaaaagatcgaagaggagagaagggagctaattgtcttgttatgtacgatagacacagcaagtgtgtattaaatgagtattaggaggaagggttgcagagcaagaatctagttctttgcctataatcccagcacttagagaagctgaggtgggaagattgcttgagcctaggagtttgagaccaggctggacaacatagggagatcccatctctacaaaaaattaaaataaaaaacattaactgggcgtggcacacaggcttgtagtccgagctactcaggagactgaggtggaaggattgcttcatagccgaggagactgaggttgcagtgagctgtgatcacaccactgcactccagcctgggcaacagagcaagaccctgtctcaaaaaataaataaataaattagctatcaccagagaaaaatcaagttcaagataaggtgcttcactctttatttttaaaagtttacttattaaaaaataagtgcatatgtaaaatgtggaatatgaccacctatatatacattagagaaaattaacaatgacccagaatgtaaatctacagcatattttctctctgttctctaaaacttgtaacctaattgaattagctacgaagggagtctttgtagtttaaccttattcgtagatttgaattagtcttaccaaaaagaattaaattcaacattgaaaatattttatgtaaaaatttaatatgagtttgaaaaccttcatcttgattgttcttacttgataccaatcgtgtgtgtgtgtgtgtgtgtgtgtgtgtgtgtatgcagaaatggcaatcaagactgtttagatattagttaattggataaaatccaatcacagaatacaagccagattgaaaatgagagtccatcatgggattggtgatatggagacaaaagctacacctcattaacatgcacagaataaacagtcctgagattttagttttatcattattatttatcatacaatgtttgcaaacagagtctcctgtggatatgctggacttctgtgagtaaatctgttaatggtaatgggatttccacccactcagtgtggtaaagattaataccactgtgtttcgactttgctgcttttttatttgttagtggacaaacaatttacttcagagctccttcacacagttacactgtgcctgctgattgccccagagctgtccttgtctgtcttcaaaggctacacaggggcacacatggccagctctcccttccctgctgtgccacgtggggttcaccctgcagcccatcatgcaactccttactccacaaaaatcagcaatgcttgggtgtggagttcactacacacacacaagcatgcctgcagtcacttctgaaagtctaagaaatgttcatgcttttggaaacagggccactcatacacacacaatggaaacagaggtcttggctggtcaaaagatgcccccacttgtctaccagattgtgcatgaatacagcttttgtgtcagctgctcagggctttccaaagctgcatgcattttgtccaggttaaaacattcagtccgcttatagggctaatatattagcttgctgatacatttactaggattagtttgaatcgttgctccttattacccattgtgccctagaccaaaggcggagtctcttcccttagaattgagtacaatgaaggaaaacatccatgaggggcagaaaggagacaagtttgaagcttagggcatctctcagaccctgtgagtaccctaagggtactcacaaagatcagcataaagggtccagcatatgactgcagtggtaggaaaggaacttcaaggccaatttcaccctttttatagctttttatagccctttttatagctttgcctacagctagacctaataggcaacctctttttttttttatttttttatttttttttaattttgagatgtggtcttgctctttctctcaagaaagagtgcagtggcatgaacacagctaactgcagcctcaacctcccgggctcaagcaatgccccttcctcaccctcctgaatagtgggaccccaggcatatgccaccacacctaattttttaaaaaatttttattgtgataaggtcttgccacgttgcccaggctggtcttgaactcctgggctcaagcgatcctccttcctgggcttctcaaggtgttaggattatagtaacttcaatctaatcaaaagatatactcagatataagttagctgccctgaaaccctccacaggattttcaaaggactgctagtgttccatctgaagacggaaagacacattccctgcaacattttctgcacagtgagctgccccaaacaagctgccctgttgcaaatcacctttcagtacagcatattttttctcaaacgctgcatatttattaagcacaccatttttcctgcgtatggaattctgttctctctcaatgttaatctttaatgtacaagccatcttatgattgggtttcaaagtgaaccatataatatattcaatgaggaacatttttcttattaagactaattaacaggttctcgattcccacaaatgcctaggtgctttacagtgattctcttttcaatgacaatatttagccaaccaaaatttaacccttgagagtccttcattaccacagtcaattaaggagtgagtcactgatgttacatctctgctaagaatagtctgcagatgtgcttttaaggaaagaggaatttaaaaataaatgtatttgacaagttcctgatcagatgcctatatttacctcaaccaaattagaatggtgttgcacagaagttgaagtttatcctggaaaattcctaacatgtgttcaggtttgacctcagaagtctttttccattacttcggaaaaacatttggacttccttgggccatgctttttcttataactcaaagaggacttttcttcctgtggtcttttggcctccaacctcacagactgacaatttattgtgaagtaaatgtcatcagaaatagctcggtgtcatgtctctgtgaaaggagagcctcgctggcaccaggcacgggattcaggggcaaccaccatgcaaatcacttctcttcttggagcctccacttccccttctcaaagccaaagtgttggacttgattatctttatggaccttttgagcttcaagagttgattgatccaaatatcacagagggcccggtagctggttccctgagcccaaagtctctacattctgaggggggtctcagacacacattgtatatgcacagcatgttttgttacttccattgttagttctgcccgatcgagttttctaaacaaggaaatctatgttatgaaaggtacgggatttgccgttcctattcagaattcaacacagagattgaatatgtgttcttcatagtaaactaatttttaaatgtttttgttaaggaaataagttctgcataaaagtattaataatctcatatccaaactgaatcaagagatgactttagcaaactgcttattcaattttcttttatatcttttttattttattctttttaatttatttttatttttcaccatgttggcaaggctgatctcgaactcctgacctcaagtcatctatgttccttggcctcaaaatgctgggattacaggcatgagccactgtgcctggcctcaattttcaatattaagggaggaggtttctaccccaaatcagatttagaagtttacatgtgatttttgaatcagggttaagtagagatacagctgacagtctagggattctgacctactctcaagggtttacaacatgagtccaaggcttccctcactctaattacgttcctagctacctacatggtcagtgttagagtcctgtggttaaaaacctcaccagtttcccaaaaatcatatggatctgagaatgtgaatgatataaggagacgtagcaaacactcattgagtgctcactgtgtaagctgcacaatgctagttactctacatacatagttttatttattgggaggaagtgttgcatactggtatagatatgggctctgaaatcagactgttcttgttttgcatgtggctcacagactggcaatggtgatttagatatgtgaacaacaagaataagaaatttctaaaaggaaacattgagtgagctgcaaaaagcagaaaaagcagcagtgtaaataatcatggccatcttttaaagaaactagggaattgggtgagaccccagctacaccccttcaagggagttagggcctgtgcaggtcctccaaacaaacaaacaaaaaaaaaaaagaagaagaagaagaagaagaaagaaagtaggaacaggcagaaacaagatgaatagattaaaactgaaaaggttctggaagcaatcatgaaggaagacgtaacagccagagttcctgtaagagcaagagagggtggcttgagaatgactcaatgagcagggctctaggaacacattaccagacaaaaaaaaaagttaactaagtcccaattcaattcaaaggggaacacctagagaaatgcactgaaatagccttgcatgctcagggataatgactcataataggcttcttcctggcctgaagattatgaaaatatggaaataagagataaaacacaaagagaggattgtggtagctcatgcctgtaatccaagcactttgggaggccgaggcgggcagatcacaaggtcaggagttcgaaaccagcctggccaacatggtgaaaccccgtctctattaaaaaaaaatacaaaaatgagccgggcgtggtggtgagcacctgtaatcccagctactcaggaggctgaggaaggagaattgcttcaacctgagaggtggaggtagcagtgagccgagattgtgccactgcactccagcctaggtgacagagcaagactccatcttgaaaaaaaaaaaaaaaaagagagagagacttataaaagaagatgccaagaaatgagactgcctaagtcaatttaaagaagaaattggtgatcttctatgcctgacaatatggcttattatataaagaaagaaaaccctctggtatgaaaactcataaaatgttatataaaatatatcttaaaatattgagacatagctgagttggcaggaatataaggacaagagaggctataaacaacaggaaagcactatctggagcaacaagtatgatgctagctttcacttggagagcatctgttcatttctattgacagagaaactgagttttaatgagcccaagtaatgcaggagaccaatctgaaatacccacataaagccagaacctcaaagtgtgggaaaactaggacgggggtgaggggttggaaatgaaggaaacagtcttgcatagggaccttgcgtaattcagcctagactctgagtacagaagtaaataagattaaaatgtcttttgtgagaatttccaactacctgctcactctgacatggacatgtgtcttaagttcacattgcttgtgtgaccttagaatcttcaagctaaaaaagtaattgaatgtaccatgggttgatttttatccccaagcactcatcagaagcaaacaaatactctttgaaaaatgcacattaaatccatgcctcaaataatgcccacgtataaagtcccaaagaagatgcgctccttcccaatcaaaattctctaaacagggaattctctaaagagacaaaattctctaaagggaacagaccaccatgagtgtgaggcagaagacctcagcaacagattggcaaagtcagcagatactggatctattagattcaaatataaaataagtattttaaataaagaaatgaaagcatggtgcaagaataagaggcaatcaggtagagtagggacaaatacaatttctgaaagcaaaacattgaaaaactaaaataaaatttgtatgtgtagattaaacagcagattagatatagccaaagaagtaataggtgaaggggaagagaaatctgaagaaatgcagcacaaagagacaaagacatataaaattatttttaatgtcaaaatacatagatgatagagtaaaaagggttaacatatatttaattgtacttccagaaaaataaaataaaggaaattagagataggctatatttgaagaggtaacagctaagaattttttagagttgattaaagatgtctatcttcatactcaagaagcctaattaatcttaacaagaataaatcaagttaatccttaagtagacatagtagcgtgaagctgcaggacgccaaaaaaccaaagataaatagaggaatatagggagctgtaggatgcagagaaggatgaagccagatttttacaaagaaatgagttttgttactaacagctaggctctcaagaacagaaatggaagttagatgatgtcagaatagtatcttcaaagtgtggagaaattttaaaaaactatcagcctagaagtgtgtatccagaatatagtatgttttagttacaagagtgaaatatattttcataaaacagaacagaaaatttaatattaacagacctttactaaagaaacataaaatatgttgaactccaagtagaatgattctataaaaaaggtagaagatgcaagaaggaattcagtgggtgcaaggatgagagaagattactgtgtaggtaaatctaagcaaagagtaatggtattaaaacaattttaaaaagtctaatttagggagagttagaatttaaaatagatataaattcctccaaaaataatagcatattaatctggacagaatgatcagacttaaaaggagttatgatgtgggaattatttgggaggtgggcaaatattctgatttagaccttaggttaaatatgcacatgaagatttctaagacaatctctaaaagaatacaaatagagtgtataacttccaaactagcagcaaaaaaaaatggaatgagggatacattaatcaatcaaagggatgacaagaagagcagaaaacaagagcccaaaagagtgggcaaatataaaatgtaaattatatagtagagatagatataaatatattgaaaataacaatgattgtaaaggaactataatcacaattaaaacatgagagcaattaggctctttctacatctacaataacaataataatgatcctaaaacctaaggattcaaaaagattaaaaggtaaaaatatgattaaaaaagatagctggtacaattattcaagtatcaggaataaatagaagctgtcaaatacaacacagctagtcacggtggctcatgcctgtaatcccaatactttgcagagctgtggcaggaagattgcttgagcccagaagcttgatcccaaaagcttgataccagcctggacaacacaatgacacctcatctctacaaaaaaaaaaaaaaaaatgtttaaaattagccaggcatgctaatgcatgcctgtagtcctagctactctggaagctgaggtgggaggatcacttaagcttgggaggttgaggatgcagtgaactgtgattggactactgcactacagcctgggtgacagggtaagaccctgtctcaagaaaaaacataaaaaaataaagtacagcacattgtcagtgatagaaggtaattacaattaaaaataaataaatcaccaggaaaatataacagttctaaacttacaggcatttaataatataccaacaaaatataaaaggcaaagattttcagaaatatgaggagaaattgacatattttaacacagctctcagtaaataatagattagtagataaaaatgaggaagtatatagaatatttgaaaaatgcattttttaagcttgatctaacaatggacatatggggaacattgcactcgactccataatacatgttattctagagtaatgcatggatcatttatgacaacagaccaaattctggaccctaaaccaagtctcaatatatttcagagttggtttcacacagatacatttctttgactacaacattctgaagttataaattaattaaaaaaatataacttaataagcattggtcagttaaaaggcataattctcaacacaaacagaaatcatgaatcgaagtatagagcataatgtaaattgaaaaataatttggatgaaatgcaataaaagcatgatatattattacttatgaggtatagctaaaacagtgtttagaagaaaacaataagtttaaaaataatatattggaaaaagaagaaagactcaaagttagtgagtttggtatcaaattaggaagttaaaatagaaaataataagcccaaagaaaatagaaaaaaatgagattataattatgaaaacagaaataagtaaaatggaaagacacaatacaaaagattaacaaaaatttttttctttgaaaataataacaaattgatcaatacctaacaatgatgatcaaaaatttaagaggaaagcacaaattttaaaaagaaataaaaaggggcattaatatatttgctgaagaaaagatattactaataactttatgcctaaaaatttgaaaacttggttgaattggacaaagttctggaaaaatacgtattataaaagctgattcaaaatgaaatagataccactttatactcagtaggatggctaagaccaaaaagatagaccctaacaagtgttgagaaggatgtgaacacattggaaccataaaatatcaatgctgggagtgtcacctggtgcagttgttttggaaaacagtttgaaacacagttcctcaaaaagctaaacacagaggcaccacacgagccagcaatcccattcctagatatacgcccaagagatttgaacacatacgtttcagaaaaatttgtacattaaagtgcattattcataacagccaaaaatagaaaaaaccaagcatctgtggattgatgagtgaatgaatcaaacatagtatagccatgcaacaaaatattacttagccttagaaaggaatgaagtactgataaatgccacatggataaaccaggaaaccatcatgctaagtgaaagaaaccagacacaaaatatcaaacgttatatgattccatttatatgaattgtccagaataggaaaatccaagacacagaaggtagattagtggttgcaatgggctagagagaaagaggcgtggggagtgactgctaatagaaatgtggttttttttgcagggggtgatgaaaatgttctggaatttggacaacactgaattgtacactttaaataggtgaatgtaatagtatataaaatatatctcaattaaaaagggcaatggaaagcctaaatgttccataatcacaagaacattaatcactacattcaaatctttctaaaaagacatcagtctcatttggttttacaagtgaattctataaactttaacagactttttataggtaagaaagtgaatactacacaactaatttatcatgctagtataacactgatatataaaacagcaaaggaattctaagaaataaaaattataggacatgtttcctatgaacatggacacagaaattataaataagtattaataaactgaatactgcaatgtacaataagagccaaaggccagtatcaggttaatacttttgaatatatattactatataatatccacattaacaaattaatggaggcacatctcaatagatgcagaaaaacttctgataaaattcaacaaccatgagtgatttttttttttaattccacagcaaaggtcctgttcaatgattgaggttgtttaaaaaatccttaagagcaagagacatagggattaggaagaaagaaacaatactgtttgtttgtagatttataatcagttacattaaaaaaaaaaaaaaaaaaaaaaaaaacagaaggaggggagcagtggctcacacctgtaagcccagcactttgggaggccgaggcagatggatcatgaggtcaggagatcgaaaccatcctggccaacaaggtgaaaccccgtctctactaaaatacaaaaaagagccgggcatggtggcctgtgcctgtagtcccagctactcgggagactgaggcaagggaatcacttgaatccaggaggcggaggtttcagtgagctgagattgtgccactgcactctagcctggtgacagagtaaaactccgtctcaaaaaaaaaaaaaaagaaagaaaagaaaaaaaaagaaaaaatcaaaatgggccaggcacaggggctcacacctgtaattccaacactttgagaagccaaggagggcagatcacttgagctcaggaatttgagaccagcttggccaacatggcaaagccctgtctctaccaaaaatatgaaaattagccaggcataatggcacacacctgtagtaccagctactcaggaggctgaggcacaagaatcacttgaacctgggaggtggaggttgcagggagctgagatagcaccactgtactccagcctgggcaacagagccagactgtctccaaaaacaaaaaacaaaacaaaacaaaaaagactcctgcctcataatacaaaacaaaagtaatttcagatgaatgaggaaataaaatatgaaaagcaaaatgttaaaaccattaagagaaagtataggaagcgaactcaggatatggattaatctctcttaaaattacagaaaatgaaaaccatacagagagttattaataaattcaactacattaaaaatgagtactttttctttcatcaaaagacttcacaaaacaggaaagagaagtagataaacagtagatatttccaggaaatataattggcaaaggattagtatccagaatatgtaaagaacttttaataatcaattaaaaaggtgaatgatttgggcatttcacagaagaggaaatacaaattactaataaactttgcaaaaatgtgctccagcatttcagcaatcatgggaatatacatcaaaatcattttcagcaagttgaaaatttaaaagttacacaatgccaagggttggttagtatgagtagtgacagggactcttgcgtactgctaatgggaatgtatgttactttatgtattttatgtactatcactttagaaaataatttggcatcatctattaaagtttaatatacacagccccaaaactcagcaattctttttctatgcatatgcactagagaattcttacacacacatcactatataaatacaagatgattcatagcagcattatctataattatgtatggcaaaacaacctagatgtccattgattgtaaaaaggaaaaataaaaattgtgatatagtcatatcatgaaatcctatactgccatgaaaatgaataaaccacagctatattgacatgtatgaattttgtttttttgtttttgtttttgtttttgttttgaaacagagtctccctctgtcgcccaggctggagtgcagtggtgcgatctcggctcactgcaagctccgcctcccgggttcatgccattctcctgcctcagcctccctagtaactgggactacaggtgcccaccaccacacctggctaattttttgtatttttagtagagacggcgtttcactgtgttagccaggatggtctcgatctcctgacctcgtgatccacctgcctcagcctcccaaagtgctgggattacaggtgtgagccaccatgcccggccacatgtgtgaatgtttaaaacacaatgttgggtgggagaggcaaattacagaagggcactatactttgattattttatatgtatttaattttatataaagtgactatatgaatatgtctgccccattaatatgagagttttcctgaactaaggaaaactcgcaaaatattttctccctaagagaaaaggccctagaaatcagagtttaaaatttctggcctgaaattatgtctgctagggtaagtttttagaccatgaacagataaaagtggtttctcagagcatgtgctgtctagggcgggagattagggtgggatccttcccactcagcctgctgattgggcactattgcccctagtcaaatcagaagatacaatctgtccctcctccgccacacacaaaaagcctttgagagaatgagaaaaacaattgtaagagtaacggttaccacagtaagagtagcaacaaggttatttcaggcattgttattcatgtacacaggtgttcagtacgaagccttgctaaataggctgccatgctgtcagcaatgccagctgcataagccaaatctcctaacagaaaaggcctccgactgcatacttctgagaatcttccaaagaaaaatctccttgtgctgtgtgagccatttctgtctgaagggctgattgatggagtgagccaatgagagattactgttcccaacctgtagcctgtgtgctgctgcactttgtcctcctgcctcactccactccaatacttagctcagcccccaccctgaaactatagcgttattcccaggaaggcagaaaaaatctatgctgaaagttcaactcaaccatcacgtggaggtacctggcccagcgcaaactaaccttggagcttttatccacatgttacaatgtgcataacatgggctcaacctcagcaggcacagccattctgccagggttttggcgctgggagacgaatcaaaaactttaactgactgatttcttttttttttgacacagaatctcactttgtagcccaagctaaattgcagtggtgcaatctcagctcactgcaacctccatctccagggttcaagtgattctccagcctcagcctcccgagtagctgggattacaggtgcacgccaccagtcctggccaatttttttgttgctgtattttagtagagatgaggtttcaccatgttgcccaggctggtcttgaactcctgagctcaggagatctgcccacctcggcctcccaaagtgctgggattacaggcgtgagctactgtgcccggctaactgaccaatttcaagaggggatcagtagtagttccattgcgaccagcttgcccaataaagtttaggggacagtggctttatgttttcaccatcagacaaatacctacacaatgacaagcaaaacctttgccaggcagtatcttctgaaagagattcctgcagttatccaaggaaatagccacttaggtcaatggacgtttgcagagtggaagatagttttcaaagagcaaacccttacagaaaagcaatagtgcctgccccaaatgtatgtttattgtcaaaaacctcaatccctctttttagaaaaattggatagggaaaaattcattaaccctagagaagtaacttagtcctatctttcacccgatttttgtttgaaatgatggtatagcctacctgattgggaaaaaaaaaaaaaaaagcagaggttaggagtgaggaatgaagcaactaatagtaaaaatacacagatctagatggtgaaccagtgatctggacaggacctttatgatctgccagccaagaaaccatcaaagctaactgtaggaatgtgctgataattaaaaggtaggtgagcacaaaagaatattagaaaccattctatgtggcaagactgaaaagaggatatgacttcttaataaattagatagaaagtgagagccaaatccatgcatcattccaaagttgagatcacagaaggtagatgcaccctagggctcttggtagatggacactacggctcccctgagaggggagaaagggaagataacacacacagactagcttttcaaaaaggttggctaagaaagaaaggaaagaccccacataataacaggggtggaagtaaagtttccattcaacaagtgttttgattcttttacactgttttgtacagctatgttagtgtcactatctactattatcattattctttcattaagagtttgtggagtaccatgaaatgatatctgtccactactgtataatagacagccctgtagtcctcccttcacagaaaagaaaccgctaatcaccagcagttctgttaaagattgcaataaaattcaggcaagacattttttcttgagaacttcatttttagagtactgtattttctaacctgtagaattttaagggacagcccataaattccttttctttctagctgaagaattagaagtctgagactggggaatttgagacttctttaagtcagttttgatgcttggtttattaaaccattcgttttaaaggaacgtaacattaacctctcacagtaaattgtgtctgtcaaatactttgatatgatgtcagttggcgagtgaatgacactgagcccccaccctcactcctgagattgagtcagccccagttacaaagcttgctggcaagcaaactgcctgtcaagtttgctaaaaagaacagcaaaagtgggaacagccaagcttgtacaattttgcagtttctttctttctttggtatatttttaggttgccaggaatcgatttcctcttctatgctttataagtttctattcataagcctggcaatttattaaacttcattttattcatataaaatagtcactgctctggaaaagagtgactcaataaagcgctcttcttcccatacacctggacttctagccagagaacaagatgcggtgtgcacaagtaccaatcaatgaaatgaaaaacactttatgaaaaacaaagcttagtcttgaaaatctgaacatttattttacaagtcgctgattgaagggatttttgcaatcaaaatgaatccaggcaaacccatgctactggattttgattaattaagccaaaatctgcacatctgcgtaatgtctagctcataagtgagatggttttaatcagtgaggaaaatgtggtttggggaagaggctgcaggtggagtttgctaactagcacattttatttatttttctcttagtgggtttctactctttagtaaggttattataatccttggttttctggtttcctgcccactatttatctctcccactaaagatctcccacatgccctgcataacaataatcaactaaaatgcagtagtcaacctggtaggctgaagctttgcttcatagaacagggatgaagctagaaaccacattttgtgcattatgtctattcctagcttcgtaaagaaccatggtgaaccagtcaagacagccatgtatacaaataaagaaaattattacaaataaagaaaaataaagagagtgttactggaaggataagcaactgcctgtagctctgtgattgaggccttacatatctaaaagagcattttgcattgaactcttccagtagccctaaaatccaatgttatgacttattatataaatagtaaatgacttgaacttttagtcatggtggtattaagagattagcaaatcctctcaggttaaaaaaaaaaacatataaaattgtcgaaaattgaccaaaggtgataacaaattgagatatttattctagatttatttatttatttatttatttattttattttgcattcattctctctttatatagactctggttctagaaacaattcgcctgcagccagctggctggactatttacaggcccattgcgggctgtactttggccacctcccggcacggtgctcagctgtgacgccgaaataagttagggctggccgggcggtgcggggcagggactagggctgtacacacaagtgctgggggctcggggcctcactactgccgagggccgggccggggctgtaaacatggccagggctgccctgcccacccctagtggtcggtaacgactggaagcagagcagccaggcaaggtcgggaggctcaggcgtccgacagtcagctctggatccggtccacccactgctgggctgagggcacgtcctgggcacaaaagtcgtaaacgcgaggagttgtcttcacgtcaaagaaggccttctcatccacgctcttaggggcacccatggtggccatgccaggtgccacagcctccacctccacctccaccaggtcgatgacacccttgcactcagtgtccacacggtggtcgtagtagcgtagctggtgcttggtcttgtctaacatgaaccagcgggccttccagggcttcatgaaggcccccttcttgtacagagtgccctcgtaggacctgttctcactctcagctgtctggaactggctgtaagggtgctggtgctgccgcaggcagcctggcgggagccagatgcggtcgagcctctattctggtcactctccaggctgaggctcaaggtggagcccacgggttcctcctgcaggtacatacccagcgagcagcggtggtgaggtgcggtggacactaggagggagctaggggtgccacgtccatctggccgggcttcaaggcgccatgcagccttcacgcggtcccaggtgtccttccagcgcttagcgggtcggctcagctctgtctccaacctctgcaggcgtgagatggcgtcaggctgggctcgggggcagctgtggtagcagggccacaccacacagcacctgctctggggagcgcctccgtcaaaccgttcttcctcaggggctcagggggttccccgagccagttcccagtcatagggagggccctcggccagcatctcctcagcgcagaagtcctacactttcaggttggacacgttgctgtagggccgcaggacctctgtgtcctcgggtgcattcatgtagttgtggaacatggctgtcctcttgctcatccggtccacacagagacctgcaaggcagctggctcctgcgctgccccttctcctcgtacagcagccccagctcaatgtgctcatagtcagagtccagtaggaaggtctagaaacagcgggacacgtggtggtagccgaggaacttgagatagaactggctgaactcaaactccatggggaactgcaggtggagctggtgtaggcagtccaagaactacaggaagatagtgtgaagccgctgctctgtccagccagaatgtgggctcccccgtggctgaagcgatgactgaaggacagccactccttctccaccagcaggtggaacccctccagcgttcagtagaaggggtctgagaacagctgcaccaaggataccacatgggtggtgatgtcccagccgtcctccaggcccatcagcacggaggaacttgagtccaggagctcccccctcccagcaccgacacctgcagcagcttgtggatctgaatcagccactctgagtcctccagcaagcgcaggaaggagactaggctgggctcagcagtagggcagcccaggacacatgccttcagcagctttttgaagctagccttcacctgccgcgcctggaataccttaatgggcaccagctctcactgctgcaaggggtccggccgcacattcttgagctggcctttgtccccgaggatgtagagggctgcttgctgtggccacaggaagcccgggtcgggggccgggggacacccgttggcctggggtggggccatcgcctctctgccagctagctgggagcccacattggcaccaagcccactgctgcgcccacaggtccagacactgcccccacttacctcggggtgcagtcagtctggatgccgccgccatggggttagacagagtggtgaccctggctctggggctgccaatgtgactccccacgtgggctgaggagaagccgctaagtgtgttgcgtccggacgcactggagtagcggggcatggagctgacaacagcctgcaggtacttctcctgctccaggctactcgagtctgcctggaactggcctggagaaggtgcgttctgggccttaaagagtccgactacacctatgccgtacaggcccccagaatgcagcagtactgccttggaccgccggatgcgccagcagacaacggtgaagcggttctggcggtagcagtaggacacgcgctgcagggcgttgtcctggacactctggggcacgatcagcagccccgggtacctgcggtagatggcatgcatgcggttgaccagagaaatgcggaaggattcagacttggcccggctcaggcggctgctcagggggcccaggccaaggcactgatagtcgcggcagcaagccctttccaccaggaggctgctcatggtcatgccgtccgagggcttcaaggctgaggacggggtcagtgtgctgggctccagctcttccgacactgagatctcctcctcctggtcctcagagggcggctggctccagtgctcctagctgagttggggttgtacttcttgcgagtgacatgctgccgcccgatggtcttcttgacgttcttaaccaggttccaggacagggttctgagggaaggacccttgttcttggtgactcggggtggctggccgggtgtgtaggtagagcccagggtgaaggagaaggtggccctgacatccggtgtgtaccgcagcttatgcagctgcttgcagaagagctcggcactgtcagaccccacctcctcatcaaaggccattttcagcagctggaatgtgcaggagcgcagctgcagcccgtcctgcaatagctgatccaaaggggtctggatgctgatgcatttctccttggtcagcgcggccaccgggaaggagcggaacaccaccttctcccccaccagggggtctgtgagcatccccgtgaagatgacccggtacgtagtgaggaagagggcgccctcagctgggagcagtgctggccaccccgcactgcccgccctcgcaccctcctcacgcccatccggtggcaggtagatgcgcaggccatccagcacacactcctcaccagacagcaggtgcagcctcaatagcttgggtttctagatgggcatcagcctccggttctcccgctgcaccgcctccagggtcttaatgtttatctggacgatgtctggcaccatgacatgcagccccttgaggtggtcactggtgaccccactctctgtgcagaccttgtccacaaagcggttgatgaagtggaccacagccccagctacattgcaggtctctctgtcctcaaagccgctccccgtgtcatagctctcagccacactgccagccatgctgttggggaccaggctgttgctggtgctctccaggtcacccagctcctgaagcaggcggctcttgctgctgtccagaggcagcaggaggtagctcacgcagttggtatagtggatggcctggctgaacactgtgctctcctccttctgcatcagctcctgctgcttctcaccgctcagggatggccacaggcaccactgctcagaagccacttctagggcagagtgctctctcatcctcctgggaaggtgcctccccaacctcctgggctggggcctgatcctcggtgggctccaggtaaaggacccagatatgagtctgcatgtcccagtagaacacggcctcccagaactgtggcatgctccacaccacgtgctcctgcacagagctgtaagagaactaccttaccccttggctccgcttccaggaaggctgtgaccagaggcagcagagcagccgagatgccatgcttgtccagagaagtgcagtcctgcaggcagcagttcatcatactgatgacaaagtcaaactgctggtggtccaggaccacccagttctgttgcacatgcaggtacagttcccgggtgaggcagtggcaggcagctcaccacttcagggccctcagcacagctaggagcagcttcttggcctcaagcatcttcccctcaaacacgtgggagatgcagttgcccacgacctccagctgccctgggctcttgacctgcagcctgctgcacccatccagtagggcagtcatgcggggccctgagggccctgtggtcctcctcccagccttcatggctaggggtgcaccttgcatcttggcctcagcctggtccacgatccactgcatggcgccctcatccagccaggggaagggccggggcgcccatctcaggtggctgctgtcacccggcctctgcatgttgtgcatcgccaagtctgggtacaggttcttgttcttgcagagctgctctaccagttcttggatgtgatgcaggactcattgggggtggttctcatccacccacctctgtgccacatcgtgggccaccagctcatcaaacaggtccgtggggcagtacgggaccccacactccaacacaaagagagcaaaggccatgccctccagcacattcatcaggaaattgtcctccaccagcccacactggcccaggaaggctgccttatggaagcggatgacaggctccgggtgaatgcacacgacgtgcaggcaccagagatagccctgcagcagctgatggaagagccgcagctctttgtcctgcatattcaaggaggagggggacgtcatgggtggagggaaggcgaggtcaaccaactccagctccgggtccaggaccattcttagaacactgtgcgtctgactctgcagtggctctagcaagggtggaatgtgcacacactcagggatggtcaccgtctctccatccagatcagctacaatcacgtctagcagctcctgggtctctgcctggaaggccgcattgaccccgattatgaagggcgtgggtgtgctgagggcctccagcagctgggccggcaggatgggcacataggtgaagctgtatctgagaggaaacagcaatgccaggaggctcctgcaggcatcggtgagctgctggtagctccgggacaggaagagaacctcgtgctccatgagggtggcacagaccaaagacagtacgttggtgatgcccagctggcggaagagcaggccacgctgcagctgctgatgggcagggagtcggccagtggagtctggatgacctgccggtcaccagcccccaaataaatcgtcctctactagcccccagccaggggcacggtgcacgtcagcaggttcccaattacgttccctgggaacacattcaggccctccacgtggacggcatagatgaggccgaggctgttcctgaacacctccgcatggtcaagtcgcgacacaggtaccagcgtctttggggcaaacatctgggcagatgggcaggctctgtgggcgacaggtgcgtaaggcctccctcatcctcctcttcctcccactcagtggcatccttagcgcgtgtcgtttcctgctcccagaaggtcaagcagcacagtagtggcgcccggagttgatgtcggtgaggacagcaacaaagaaggtcggtggattcctctcgggacacatctgccacccgctggactggcaaaacagctgggggaatgggttggcctcccagtccttctccgggaagaactgcagaatatggccctggcctttcccactcccgcgcgggtgcggcctgaatgccaccagcaggaagtagtctgtgatccgcgccatggggagggacgctgggcgggctccgcggctcggggactcgagggctgcgcgctcatggcccgggcctggccctggaccgcacacccgggacaccccgggttcgctccgcggcggccgcagcggctgcggctgcggcggcggcccgggctccagacaccatcttctcagccagctggcccgcctggctgttcttgaaaatgttatagagcttcaggtaaaggcagcaggaatctgtggccctcttcgcaaagactacctccatccttcctccccctcagtcagtaagaacagtaattttaccaacctgaagttcaacacggaattcataaactttggtgctagagggggctggctcaattgggcaataggtcaaaatactatagccttcctcgctaaaagtggaaactcagtaggaaacaaaaaaagaaagaagacttgtagcttttccagctcaagtttacaatcacagttacaagtggtagaccaataagaaattgaatagcgagatcctggatatgatacaaccacagtaggattagataagatcaccacacatttctggcctgcagataaccaatgcatttgtgcaggtgagactcaagaaagccaggtgggaaagtaaggccatggcagacttgagaatgggaggactctgaatgtgcttcctgacccacacaaagatcagtcatcaggaggtaggagctttatgggttcaaggtgcttgagaaaaatctggccaaatcttgactgatctctgagttatgcagacaaagggacaacctcaatagctacatgtcatggggaagaaagattatacagtttaaatctatggaaattacttaatcaacaacaacatcctcagaaaaattagtcagaattcagagttgccataatatattatctaaaatttccattttggggcaaaacaattactaagcatgcaaataattaggaaagtgtgatccatactcaggaaaaaaaggaatcaatagagattgactcagagtagcagctgggtgcagtggctcacacctgtaatcccagcactttggaaggccaaggcgggcggatcacctgaggtagggatttcgagaccagcctgaccaacatggagaaaccctgtctctactaaaaatacaaaattagcctggcttggtggcatgtgcttgtcatcccagctactggagaggctgaggcaggagaatcacttgaacccagcgggcagaggttgcggtgagctgaggttgcgccattgtactccagcctgggcaacaagagcgaaactctgtcttgaaaagaaaaaaaagaagaaagaaagaaaaagaaaaaaagaaattgactcagagtagacctagatgatatatgtggcaaacaaataattaatgaaacgcatgatgtctatgattccataaataatctttagagagaaatagaacccaaatattggaagtgaaaaagaaccaaatagaaattccagagttgaaaagtattttcaatatgaagattttgcttgttatatcaacagcaaatttgagatgaggggagaaagaagcagtaaactgaaatatagttcagtagaaatatctcaatctgaaaagtacagacaattttttttgaataaacatagcatcaaaggcatgtagggcaatgttaagcctaccaacatatgtgaaataagggtctcagaagtaaaaaagagaagggaaggggaaaataatttatgtgaaaaaataatagataaaatcctccaaaatttgatgaaaggctgtctacaaatattaaaagctccacaaacctcaaataggataaacatatcagaattcacacctagacacatcataatcaatgactgaaatagaaatacaaagagaaaatcttgaaaaaagaaaaaaatgactcatcagatatggaaaaaaatatgattaatagctgacttatcattataaacagtgaagaccaggaagcagtaaaatgacatattcaagtgctgaattttttttccttttcttttttttttttttgagactgagtcttgctctgtcacccagactggagtgcagtggcacgatctctgctcattgcaagttctgcctcgcaggttcacgccattctcctgcctcagcctcctgaatagctgggactacaggcgcccaccaccacgcccagctaattttttgtatttttagtagagatggggtttcaccatgttaggcaggatggtctcaatctcctgaccttgtgatctgcccgctttggcctcccaaagtgctgggattataggcgtgagccaccgtgcctggctttgctgaatatttttaactgtcaaccaagaattctgtgtccatcaaaactattccccaaaaaataaaagcaaaataaacacatttccaagtaaatgaaaactgagaaaatgcattactagaagatttgacctagaagcagcactaaaggaagaactttaggcttaacaaaatattcccagcagcttaggcttaataaaacattcccagacagaaactaaagttcacggggagaaatgaagagcactggaagtgataaaatgtaggtagattgaaagacccccttttccacttactttccttttgaaaatagacattttaaacaattattataaaactttattgttaaagttttacatattcatacacacacagttaggtttatggatatgtgtgtgtatttatttatgacggtaataatcaaaaaagaggaaagaaatggaattatattaaagttgctgtattttactggaattatgttagcattaacctgaggtagaactacacacaaaaaaaccataaaacgttactgtgagaaatttaaagatctaaatgaaaggagatataccatgctcactgattgaaaaacattattgttaatatgacagtcctccccagattgatctacagctgaaactcaatccatacgaaaattccaggagcattttttcatagacatagacaagccaatccaaaaaaaaattatttggcaatgcaaaatacttagaatagcctaaacagttttgaataagaaatacaaatttggtaaatgtatatttgaaatgagatagttcccttgaccccttcatgagtcttgtgaaggggttggcttgtttactcagcccacaggtctcaacccctcatgggaggggaagcatgcaggtgagcaggtgcagaggctaggatgagtgcttctgggcaaccagcaggagcagaactccatatggtcccgtggcagtgtctaggagttacccatgacccctggagttacagtatgcccttttagttttgctatccgtggatggcttaagtattagacagctcagtggagggccactgtgacagccttttgcacccacacctgggaccttgtccagcatccaggaggagtcaggttgcatgaatgaattgaaggatggtaaatgcagaagattttattgccaatgaaagtggctctcagtgggatggggagctggaaagggaatggagtgggaaagtggtcttcccctggcgttcagccgggaatgtccccagacaaactcttctctgaggtcctactgtcaagctgtccctctgaagtcaagctgcttctcactgacatcaagctgctgcttctcttctctccttttctgctgcactgctttgcccctctgccagtggagcctagggtttatatgggtgcaggatggggagcagggcaggccagggtggttttggaaaaggcaacattcaagggggaaaacagaaatgcacattctcactttgggtcacaggtccaggcttgagggggagacctcaccagcgaccccacccttttctacctagtacctcctactcatatcacactgactaattttgatactaaccataaagctacagtaatcaagagtgtaatgatattggagtaataaagacagagaaataaatcaaaggaacagaatatagagtccagaaataaactcttacctttatggtcaattgagttttaacaaagaggccaagacaattcattagaaaaggagagtaatttcaacaaatgatgctaaaacaattaaatattcatgagaaaaaaaatgatcataaacccttggcttatattagacataaaaactactccaaaatagaacatagacctaaatgtaagtaagagctaaaactataaaactttagaataaaacatagaagaaaatctttctggccttaatttaggcaaaattttacttgattggataccaaaagtgtgactcattaaataatataattggaaattgaacttcataaaaattttaaaaatctgcttttcaaatgccaactttagaaaaataaagaaaaccatagactgaaataagatatttgaaaataacatatctaataaaggacttgtgtccagaatatatcaataactcttacaactcaataatataacaaacaattcaataaaaatagataaaatgtttgaacagacatttcactaaaaaaaaccaaaaacacatacacagaaattgctcacaagctcatgaaaagatactaaacatcttttagtaactagggaaaagtaaattaaaagcgcacacccactataatgactgcaataaaaaagattgacaataccaggtgttggcatgaatgtgaagaaactagaactcttagccattgctagtgatgaagtaaaatggtacagtcactttagaaaacagtttgatggggttttttaaagttaaatattaataatattaatgtatgacccactaattccattcccaggtaacttctcaagagaaatgaaatatgtctacacacagttttgtccacaaatatttctagcagaattattcataatagccaaatgctgaaaaaaaaaaaaaccaaatgtccatcaactggtgaatgcataaacaaaatatagtatatttatacaactggatactattcagcaatacaaaagaataacaactgatagatacaacaataaaatgaacctcaaaaatctggcaaataaaggaaaccgtacgcaaagactacctattgtattattccaattctaaaattctaaataataaaaaaggcaaaaccacagtaacagaaagcagatcagtggctatctgaaatgggatgggagtgagaattgactgcaaacaggcatgagggattttggagtgatagaatattctcaaatcggattatgacactggttgtgccactgaataaatttgctcaaaatcattgaaccatatgcttaaaacaagtggatattatggctttaaattatgcatcaataaggctgttttagaaaccaatagatatttatcaaagaaaataaaaacaaaaagtatgggagggtggagccaagatggctgaataggaacagcttcagtctacagctcccagcatgagtgacacagaagatggatgatttctgcatttccaactgaggtatcgggttcatctcactagggagtgccagacagtgggtgcaggacagtgggcgcagcgcaccaagcatgagccgaagcagggtgaggcatcgcctcacccgggaagcacaaggggtcagggaattccctttcctagtcaaagaaaggggtgacagatggcacctggaaaatcgggtcactcccaccctaatactgtgtttttccaatgggcttatcaaacggcacaccaggaaattatatccctcacatggcttggaggttcctacgcccacagagccttgctcattgctagcacagcagtctgaaatcaaactgcaaggtggcagcgaggctgggggaggggcacccgccattgctcaggcttgagtaggtaaacaaagtggcctggaagcttgaactgggtgagcccaccacagctcaaggaggcctgcctctgtaggctccacctctgggacagggcacagacaaacaaaagacagcaataacctctgcagacttaaatgtccctgtctgactgctttgaagagagtagtggttctctcagcacgcagcttgagatctgagaacgggcagcctgcctcctcaagtgggtccctgaacccggagtagcctaactggaaggcaccccccagtaggggcggactgacacctcacaaagccaggtactcctgtgagacaaaacttccagaggaacgatcaggcagcagcatttgcaattcaccaatatctactgttctgcagccttcgctgctgatacccaggcaaacagggtctggagtggacctccagtaaactgcaacagacctgcagctgagggtcctgactgttagaaggaaaactaacaaacagaaaggacatccacaccaaaaacccaactgtacatcactatcataaaagaccaaaggtagataaaaccacaaagatgggggaaaaaacagagcagaaaaaccagaaactctaaaaatcagagtgcctctccttctccaaaggaacacagctcctcaccagcaacggaacaaagctggacagagaatgattttgatgagttgagagaggaaggcttcagaacatcaaactactctgagctaaaggaggaagttcgaacaaatggcaaataagttaaaaactttgaaaaaaattagacgaatggataactagaataaccaatgcagagaagtccttcaaggacctgatggagctgaaaaccaaggcacgagaactatgtgacgaatgcacaagcctcagtaactgatgcgatcaactgaaagaaagggtatcagtgatggaagatgaaatgaatgatatgaagcatgaagagaagtttagagaaaaaagaatacaaagaaacaaacaaagcctccaagaaatatgggactatgtcaaaagacctaatctacatctacttggtgtacctgaaagtgacggggagaatggaaccaagttggaaaacactctgcagaatattatccaggagaacttccccaatctagcaaggcaggtcaacattcaaattcagaaaatacagagaatgtcacaaagatactcctcgagaagagcaactccaagacacataattgtcagattcaccaaagttgaaatgaaggaaaaaatgttaagggcagccagagagaaaggtcgggttacccacaaagggaagcccatcagactaacagctgatagcttggcagaaactctacaaaccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcattaaacatggaaaggaacaaccggtaccagccactgcaaaaatatgccaaattgtaaagaccatcaaggctaggaagaaactgcatcaactaacgagcaaaataaccagctaacatcataatgacgggatcaaattcacacataacaatactaaccttaaatgtaaatgggctaaatgctccaattaaaagccacagactggcaaattgggtaaagagtcaagacccatcggtgtgctgtattcaggaaacccatctcacgtgcagagacacacataggctcaaaataaaggcatggaggaagatctaccaagtaaatggaaaacaaaaaaaggcaggggttgcaatcctagtctcaggtaaaacagactttaaaccaacaaagatcaaaagagacaaagaaggccattacataatggtaaagggatcaattcaaaaagaagaactaactatcctaaatatatatgcacccaatacaggagcacccagattcataaagcaagtccttagtgacctacaaagagacttacactcccacactataataatgcgagactttaacaccccactgtcaacattagacagatcaacgagacagaaagttaatgaggatatccaggaattgaactcagctctacaccaagcagacctaatagacatctacagaactctccaccccaaatcaacagaatatacattcttttcagcactacaccacacctattccaaaattgaccacatagttggaagtaaagcactcctcagcaaatgtaaaagaacacaaattataaccaactgtctctcagaccatagtgcaatcaaactggaactcaggattaagaaactcactcaaaactgctcaactacatggaaactgaacaacctgctcctgaatgactacggggtacataacgaaatgaaggcagaaataaagatgttctttgaaaccaacgagaacaaagacacaacataccagaatctctgggacacattcaaagcagtgtgtagagggaaatttatagcactaaatgcccacaagagaaagtaggaaagatcgaaaattgacaccctaacatcacaattaaaagaactagagaagcaagagcaaacacgttcaaaagctagcagaaggcaagaaataactaatatcagagcagaactgaaggaaatagagaaataaaaaactgttcaaaaaatcaatgaatccaggagctggttttttgaaaagatcaacaaaattgatagaccgctagcaagactaataaagaagaaaagagagaagaatcaaatagacgcaataaaaaatgataaaggggatatcaccaccaatcccacagaaatacaaactaccatcagagaatactataaacacctctacacaaataaactagaaaatctagaagaaatggataaattcctcgacacatacactctcccaagactaaaccaggaggaagttgaatctctgaatagaccaataacaggctctgaaattgaggcaataattaatagcttaccaaccaaaaaaagtccaggaccagatggattcacagcaaaattctaccagagatacaatgagaagatggtaccattccttctgaaactattccaatctatagaaaaagagggaatcctccctaactcattttatgtggccaggatcatcctgataccaaagcctggcagagacacaacaaaaaaagagaattttagaccaatatccttgatgaacattgatgcaaaaatcctcaataaaatactgacaaaccaaatccagcaacacatcaaaaagcttatccaccatgatcaagtgggcttcatccctgggatgcaaggctggttcaacatacacaaatcaataaacgtaatccagcatataaacagaaccaaagacaaaaaccacatgattatctcaatagatgcagaaaacgcctttcacaaaattcaataacgcttcatgctaaaaactctcaataaattatgtattgatgggacgtatctcaaaataataagagctatctatgacaaacccacagccaatatcatactgaatgggcaaaaactggaagcattgaaacttgtgcctttgaaaactggcacaagacagggatgccctctctcactactcctattcaacatggtgctggaagttcaggccagggcaatcaggcaggagaaggaaataaagggtattcaattaggaaaagaggaagtcaaattgtccctgtttgcagatgacatgattgtatatttagaaaaccccattttctcagcccaaaatctccttaagctgataagcaacttcagcaaagtctcaggatacaaaatcaatgtacaaaaatcaaaagcattcttatacaccaaaaacagacaaacagagagccaaatcatgagtgaactcccattcacaattgcttcaaagagaataaaatacctaggaatccaacttacaagggatgtgaaggacctcttcaaggagaactacaaaccactgctcagtgaaataaaagaggatacaaacaaatggaagaacattccatgctcatgggtaggaagaatcaataacatgaaaatggccatactgcccaaggtaatttatagtttcagtgccatccccatcaagctaccaatgactttcttcacagaattggaaaaaactactttaaagttcatatggaaccaaaaagaagcctgcattgccaagtcaatcctaagccaaaagaacaaagctagaggcatcatgctacctgacttcaaactatactacaaggctacagtaaccaaaacagcatggtactggtaccaaaacagagatatagaccaaaggaacataacagagtcccagaaataatgccgcatatctacaaccatctgatctttgaaaaacctgagaaaaacaagcaatggggaaaggattccctatttaataaatggtgctggaaaaactggctagccatatgtagaaagctgaaactggatcccttccttacaccttatacaaaaattaactcaagatggattaaagacttaaatgttagacctaaaaccataaaaaccctagaagaaaacctaggcaataccattcaggacataggcatgggcaaggacttcatgtctaaaacaccaaaagcaatggcaacaaaagccaaaattgacaaatgggatctaattaaactaaagagcttctgcacagcaaaagaaaccaccatcagagtgaacaggcaacctacagaatgggaggaaatttttgcaacctactcatctgacaaagggctaatatccagaatctacaatgaactcaaacaaatttacaagaaaaaaacaaacaaccccatcaaaaagtgggcaaaggatatgaacagacacttctcaaaagaaaacatttatgcagccaaaagacacatgaaaaaatgctcatcatcactggccatcagagaaatgcaaatcaaaaccacaatgagataccatctcacaccagttagaatggtgatcattaaaaagtcaggaaacaacaggtgctggagaggatgtggagaaataggaacacttttccactgttggtgggactgtaaactagttcaaccattgtggaagtcagtgtggcgattcctcagggatctagaactagaaataccatttgacccagccatctcattactgggtatatacccaaaggattataaatcatgctgctataaagacacatgcatatgtatgtttattgcggcactattcacaatagcaaagactttgaaccaacccaaatgtccatcaatgatagactggatgaagaaaatgtggcacatacaccctggaatactatgcagccataaaaaatgatgagttcatgtcctttgtagggacatggatgaagctggaaaccatcattctcagcaaactattgcaaggactaaaaaccaaacacctcgtgttctcactcataggtgggaattgaacaatgagaacacatggacacaggaaggtgaacatctcacaccggggactgttatggagtggggggagggggaagggatagcattaggtgatatacctaatgctaaatgacaagttaatgagtgcagcacaccaacatggcacatgtatacatatgtaacaaacctgcacattgtgcacatgtaccctaaaacttaaaagtataattaaaaaaatatatatggataagcacatttctttaccatcttactatccatataatcagttgccactttggtttaactctttccatgtaatatatgatgtatcagaatgagttgaatcaatccactatgattggagttttaggttgtttctggtcttttatcagtaagtgattctaaaataaacatccttatacatttattttttgtttggatatctgattaatacctcaggataaattctcaagattgggctaagttatttgattaaaaaatttattagtttttgattttgcaaaacaaattaccacagactcagcagcttaaaacaacacatgtttgtgacctcacagtttctgtgggtcagggacctagtcagggcttggctgggttttccactctgtgtctcacaaggctgcattcaaggtgtcagccagggctgcaatctcatctgggcacagggtccttcccaagctccctgtggctggcagaatgcaggtccctgtgggtacagaactgtcagctcctagagctcagtcaccattctctgccttgtagccatctccacaataggaaaatgtgtgtctccaaggccaacaggacagcatctgttcctgcttggtgtcacttgcctccagactcttttttaaagagctcatttggttagaccagccccactgaggataatcttccttttggttaactcaaagtcaaatgattaggcactttcattacatttgcaaaatctcttaacctttgccatattctgtaacacaagcacgggagtgctatcccttcatatccacagtctctccctcactcaaggggagtggattgcacatgtgtgtttactgagttgggagttggcgagggttgggactgggggccatcttagaaatctccctcccacaaagaatttgcaaatttattaagatttatgatttaaattgccagattttctgaagaacgtttatactccaccggtaaagtgctaatttccccaacactgggtattatcattatgcttaatctttgccaaagacaggcaaatgttgttggcttggaaccactgggcaaagattgtgacagtgagagaacaagtattgaattctttgattaatagtaagattattatggcctttggcaagttttgcttttcttttgcaaatgaccagtccatttatgtggttgttttcctctaagggtaattatctgttacttgttttttaataacctcatgttgaatattcagaatattaactatttatggtttctatagtattttctttcagtgtcttaaaaattgggttacagagacttatgccatgtaaaaatttttaactttcataatcagatctattaacatttatggtttcttttttatgctttaacatatttttgcactgtttatttctaaaaagagagaaccatataaatcaaataggatttccagtttccatcacagaagacaggaactatagagtgggaaatcttgtacaaagatgtttctcataatgcattgcccatccatcttctgattgttatgtaaaccaattcttaacctaaggtatccagccagagagatgaatgtatcattcctctaaatgacttggtcgtgggaaatataccacatcattctgttagctttcaggacgcagcgtgtcaacttcaattatttttttcatttcttgtcttggactgtcagtttacagctctgagtatttgaaaacagacagaagtatgaagccaactttttctagagtatttagttttaatcttgagttttatccccatctctgagcactatttccatgttatatctaattttttttcttaatatgggacctaaaacatgtcttatttaaaaaaaatacattggataatcaagaaagtatgccttttaggcaagatctcttctccctgctgtattaaaaaataatgatgaaatatttctgtgacagaaacaaaatcactttatatctattaaaaagttggttcaaatctctccttttttatagatgaatgaatcataatataaggatataagtttcttaaaccttccttgaagtctcaggcattaaatgtcctcatctataaaacgaaaaagtgaaacaagctgatctctaaggtccagtgaaatctaacactctgattcgtcttgatgtttgacttgaggttttctgcttatattctttctttgcccttttcaaattcccagtctaaaatcttgccttcaaggtttttcctcttttcattttcagattctgactatgcattcttgtaaaacattccattgtcacttccaagtcaaatattcaaaaccaaactcttgctatccctctcgaactacttggtttccatatttattggatttgtaccacagtccttggtatgcaggcatgaaaaaaggaataatttttcatcatccttccctcgccccatagctaatcagtatctaaggacagaatatttctcaactgcaacatctgtctccctgcctttttccaattcctccaaacacattagttctgagctgcagtgtgtccctccaggactcaatgttgaaaattctttatcttcttcaactttcctgatacggtaactccacaacactgtagccaggttgacattcctatggttccctattttttgttagattaagaacaatggcaatgaaacccctctacaatatgtctcagtctggcttttcacacttctttttgtcttccccatgcttatgcccagtgtcttagcctcccaagatccttgctattaatatttcctcattacacactatattttgccatttcctgccttttagggttgattttgaatttctattttcagtgtttaaagtttctgtaaatgttgggatattgactttagctaaaacaaacaaaaaataacaagtaatcactttaaatctgtatcctacttccaagaaacaatattttcattggtgccaaaataatatattccatgttagcataatatagcagaacttaaaaaaaattaaaaatctatgtagaagacaatgaggatagagtgtgttagagctgtacggaatcttgggaggctctattccaatctccaacttctaaggatcagggaagccagtagcctgactataagctatgagctaactaggaacaaatcttgtactaaagatttgaatggttttctattgctcaggaaactaccgaactctgccctttaacaggacctggtcaatcattcactcaacaaacaggttttaagtgcctgcaatgtatcatgtactgggtcctaagaggtgaaatatttaaaatggccccgctttctaggaatgcagtcttggagaaggaattacacatggacaaataagtgcaataagaagtgccatgatagaaatggtgcattgtagacacaaaggaggaggtactcagctctatctgatgtaatgggggaaagtaaaggttttcatagataaagtaaccctatcggcttaatataaaaagataagtaatgttcacaagggtggactagcaaggaaccattattaccgaaggcacagaagcatgcgtcagataataatattggggggaaatgcaaacaatttagaattctagaagttaaggtacaagacgaggtgatatggtttttggctgtgtccccacccaaatctcatctttaattgtagctctcataattccctcatgttgtgggagggacccaatgggagataaatgaatcatgggagcaatttcccccatactgttctcatggtagtgaataagtctcacaagatctgatggttttataagtggaaacccctttcacttggctctcattctcttctcttgtctgccgccacgtgagacatgtcaccatgattgtgaggcctccccactcatgtggaagtgggagtccattaaacctctttcttcttacgttgccaagtctcaggtatgtctttatcagcagtgtgaaaacagactaatacacaagatatatcaaaatcaaattttttaaagcaaggcaagcccccagttgtgaagggacttacatgtcttacaaagaagtttggaacaataactatcattatcattattattagtgagtatgtgtcagcttctcattataatttatggatccttcctactgatcactttctatgatcactataataagtaatttactttgacagacaaggaaactgaggatcaatgattaactcacctaaagcaacatggctattaaatatttcagccaagattcaaactcaggtccacctgatttcaaagctagacatgaatcacactataatcctcaccttgagtctgtagacaatgtggcaccatcaggacattttaaataaagaagaaatgtgaatagacttttgtcctggaaaggtctggcaacaatatagagttgcaccatccagtacagtagccactagccacattgaaaattaaataactatttaataattgagaattcagtccttgagggcagcagccacatttaaagtgttcagtacctacgtgtctggtggcagctgtgttggacagtacatgtgaacagttccatcctcacagaaagttctatcaggcagtacaggtagacaggaaaagtaaagagttttgtgaggtggggtgaggaaagtaaagagactattacctaggacaagtaggaaaggattagagacaaaataaagcactaagagcaatgagttaagcctgtgtttcccaaagtgtgactgcccacccttttcccctcaaccagcagcatcagcacggtgtggaaatttgttagaagtgcgcatccatgcagaatctgaaactcggagttggggcccggccatctgtgttgtaccaagccctcccagggattctggtgttcactaacatgtgaaggccatggatttagaggaaggaacagagctgtaaagcatggtacagaaatatagacaatttggaggccagatgcaaacatggatgatatggtttgaatgtttgtcctctccaaatctcatgctgaaatgtgatgcccagtgttggaggtggggcctggtgggaggtgattggatcatggggcagatccctcatgaatggttaacaccatccccttggtgatgagtaagttcttgctcagtgagttctgggaccttccccaccccctcttgctcctgctcttgcaatgtgatgtgccagctctccctttgccttctgccatgactggaaacttcctgaggcctccccagaagcagatgctggcaccacacttcctgtacagcctgcagaactgtgagacaattaaacctcttttctttataaattacccaactttaggtatttcttgatagcaatgagagaacagacacaaacacagtggtgcatacaggagaataaatctaggataactcctggtgggttgatgaataaaagagagatgttcagagggaaatgataatgaatttgagtttgaattcctaagggacattcgagtatcatgatcctgttcagtgtcagcctggaaatcaggagaaagttctgggataaagatacagttttagggtcactgggattagatggtagattagctaggaatggaggggataggtagctctcaatttttttcctgcataaatgataatcatctgtgtgtctgtaaaggatgaagggtatatctggacttagatacaattctccacatgctagttccttttctctctgattcaaggagtcatttcaaaatgcaaattcagtcagatagatgtgaatatgttctatttttaaaaataagtgatgaacatgcattgttatgctgactattattagtatgtataacttgtcaaacaagatacccagaatcctaaagtgtacagagggaaacgagaccaggtctaagggctgaccccagttcagtgagtgttggagtgtggctgcagcagaggaaccagcaacaagggggagaaaaatggtcagagagagggatggggtcctgcaactccagagaggagcacttcgtagacaaggtgatgcgcactgtcatattccagagagatttgtaagacgaaacctcggatttcgctattctgaggtcaccactgaactttattcaaagtcatttctattattagggataaattggctgatcacctcaagaagattggagtattctgaagaataatggggggtgaggaaacggaggcaccacaggtagatttatgctttgcactattacttggttacagaagcgttgtcttatgttctcggcatcttacagagattttagtgaaacaggtcttctaatttttatactttccctacccagggcctcagcataagtatggcataaaggggctagcatactatgaatacgattaccccacccactaatattgatccattggtcctggacaatgagctcaccttagtcctccattcacccaattggattgattcccttctagaatccactctctcctccagtcttccttggcctgcctcatacactttagtgacctctccaaatccttagagtaaatatagcttcagctttaaagctgggaccttctctgcaaaaaataccttctgtatagttccttataattgacctggcctaaattaatcctcacacccatcctgtgaaggaagtaggaaagtgttattgttcttgtttagtgggtgaaaattgaggttctgtgatagccaatatcttctcccctcctaagtcacaaagcaacaaccctatcttatttattttactaatttattcattccacatttttccatgaaggatttcaggtacagggcatctgaaaaataataagtagaatgtcaagataacttgataaagtaacatagatattcagctgctaaatctccacataattggtatagctgagctttaaattttgttctaaggtttttggcagccaaacagaaaggcagacactgtcaattatgcagttcctattttcaaaaaggaataagtgtgccagtttctcagaggcaccaaagtacatccttgtcttagttctaaaagaaacttcagaaccatgtctttgcatatggaccatttctataaacaagtgtagtgaaacacatcttatattggctataatggtttactttggtaaaatttcacttaaacccaaagttacaacagattctctttccttccttccttccttctttcctcccttctttccttcttttcttttctttttcttccttcctgtctctctccccaccccaccttcctccctccttccctccctccctctctctgtctttccttctttctttcaatgagatattgttctgtcatccaggctagagtgcagtggcacgatcatagctcattgcaacctccaacacctgggctccagtgatctcctgcctcaggctctccagtagctaggactataggagcacatcaccacacccaactgattttatttaattttatttttatagagacgtggtctcgctatgttacccaggctggtcttgaactcctggctcaagggatcttcccacctctgtctctcaacacactgggattacaggcatcagccaccattcctagcctaaaacagacttatcaacagaagcacacttactaacttactgatcactgatggacagttaccacaaagacataaaactttacatattgggctgaattgaatttttatagttgtgactaaattctttgcaccaattagcacatattcctggagtatgctctctctatagagagttaaaaatcaggtagcctttctaactctctacatatttgtatacacactgtgcacacacatatacacacaaagtctaccatcttaaaagaaaaaagtataaatatttttctagaaaaatctgtttctgagttttcaggaaatactcattggcttcagtgaaatgtcatctagtattttaagatactcctggaacaaatagatactcagatgattagaatatagacaaaaattgggggcatttaagttattattggagcagatgctgagtatccatctcccctgactctcaggcactgatgatcactaacatttttaattaatcacaaatccctatggatgctaatgaggctctgccaaaatggtcctttccctcacacagagtgctggaggaaccatgcacccaatgctttattcccgtatctcattaggtaatctatatctggacacccaggcaccacattatcagagtgttcttctaaaactgaatgtttgtatgcagaaaaccagtctgttaaaatgcattaatgaacacctgctggccttagagtcctgagcaaggaactgttccagaatattaaagaaacaaagtcattcgctctgtcttcaaggagtttaaatcctgttggagagacaaaatatactgacatgttatacaactaaaaacaataacctaagaacttataaatacatgcaaaataatacaataaatagtcagtgatactaaatagtacacggataccaaggcagtaggtaagggaaatgactgctgataaaatggagagtaaagtggtgacctctgcccccatcagttcatacaaaagtaatgtgaaatggcacccagatgcagagagcaatgttaggtagaataatagccgcactatatgtgatggcccagggttgtgggcaggtgagccaaattacacaacatacaggggaattccatgcctgaaaatgtggattgtcttatttcagaccagcgattcataaatgttttttgcttattttgttgttgttgttgttgttgttgttgttgttaggctatttggggtgatgggggaaggtcttgctctgtcatccaggctggagagcaatggtgtgatcagatctcactgcagcctcaatctcccaagctcaagcaatcctcctacctcagcctactgaatagctgggactataggtgtgcaccaccatgctcacttatttatttatttatttatttatttatttatttatttatttgagatggagtctcactctgttatctaggctggagtgcagtggcatgatcttggctcactgcaacctccacctcccacgttcaaacagttctctacctcagcctcccaagtagctgggattataggcgcacaccaccacgcccagctaatttttgtatttttagtagagacaggatttcactttcttggccaggctgatcttgaactcctgaccttgtgatccaccctcctcagcctcccaaagtgctgggattacaggcatgagccaccacacccagcctcacactcactatttttctaattttctgtagacacagggttttgccaattgcttgggctggtcttgaactccttggctcaagtgatccattcacttcagccttccaaagtgctgggattacaggtgttagccaccgcacctggctacctcataaataatgagctcttagttcacttagggtacttgaaaaacatgctgatatcgggatcactcacagacagtctaattctgtgggtagtaggtagagcctcagaaagtacattttcacagttctcccaaggatagagttagtctaaggaccccaacatgaggcccactgcctaatgcactaacccaagacccagtcatgtgtgacatgaaggaaaagccagtatcagaattcacagggcgcctgactgtctttaggaagcagtacctgggaagggataggaattctagaatgctccccccagaggtcaaaatgccactcaggcaggaaacggatatggttttaatcagtgaaattgcatgttagaaataaacacatctgagccaagatggccgaataggaacagctccaatctacagctcccagcgtgagcgacacagaagatgggtgatttctgcatttccatctgaagtactgggttcatctcactagggagtgccagacagtgggtgcagcacactgagcaagctgaagcagggcgaggcattgcctcactcaggaagtgcaaggggtcagggagttccctttcctagtcaaagaaaggggtgacagacggcacctggaaaatcaggtcactcccaccctaatactgcgcttttccaacaggcttaaaaaatgacacaccaggagattatatcccgcacctggctcagagggtcctatgcccatggagtctgctcagattgctagcacagcagtctgagatcaaactgcaagatggtagcgaggctgggggaggggcacctgccattacccaggcttgattaggtaaacaaagcagccgggaagctcgaactgggtggagcccaccacagctcaaggaggcctgcctgcctctgtagagtccacctctgggggcagggcacagacaaacaaaaagacagcagtaacctctgcagacaaaaatgtccctgtctgacagctttgaagagagtattggttctcccagcacgcagcttgagatctgagaatgggcagacttcctcctcaagtgggtccctgaccccgagcagcctaactgggaggcactgcctggtaggggcagactgacacctcacacagccggatactcctctgagacaaaacttccagaggaacgaggcagcagcatttgcagttcaccaagatccgctgtcctacagccaccactgttctgcagccaccactgctgatacccaggcaaacagggtctggagtggacctctagcaaactccaacagacctgcagctgagggtcctgtctgttagaaggaaaactaacaaacagaaagtacatccacaccaaaaacccttctgtacgtcaacatcaacaaagaccaaaagtagataaaaccacaaagatggggaaaaaacagagcagaaaaactggaaactctaaaaagcagagcgcctctcttcctccaaaggaatgcagctcctcactagcaatggaacaaagctggacggagaatgactttgacaagatgagagaagaaggcttcagatgatcaaactactccgagctacaggaggaaattcaaaccaatggcaaagaagttaaaaacggtgaaaaaaaattagatgaatggataactaggataaccaacgcagagagtccttaaaggagctgatggagctgaaagccaaggctcgagaactacgtgaagaatgcaaaagcctcaggagctgatgcgatcaactgggagaaagggtatcagtgacggaagatgaaatgaatgaaatgaagtgagaagggaagtttagagaaaaaagaatacaaagaaacaaacaaagcctccaagaaataagggactatgtgaaaagaccaaatctatgtctgactggtttacttgaaagtgatggggagaatgcaaccaagttgggaaacaccatgcaggatattatccaggagaacttccccaatctagcaaggcaggtcaacattcagattcagaaaatacagagaacgccacaaagatactcctcgagaagagcaactccaagacacataattgtcagattcaccaaagttgaaggaaaaaatgttaagggcagccagagagaaaggccgggttacccaaaaagggaagcccatcagactaacagcggatctcttggcagaaactctacaaaccagaagagagtgggggccaatattcaacattcttaaaaaaagaattttcaacccagaatttcatatccagccaaactaagcttcataagtgaaggagaaataaaatactttacagacaagcaaatgctgagagattttgtcaccaccaggcctgccctaaaagagctcctgaaggaagcactaaacatggaaaggaacaaccggtaccagccactgcaaaaacatgccaaaatgtaaagaccatcaaggctaggaagaaactgcatcaactaatgagcaaaataaccagctaacatcataatgacaggaccaactccacacataacaatattaactttaaatgtaaatgggctaaatgctccaattaaaagacacagactggcaaattggataaagagtcaagacccatcagtgtgctgtattcaggaaaaccatctcatgtgcagagacacacataggctcaaaataaaaggatggaggaagatctaccaagcaaatggaaaacaaaaaaaggcaggggttgcaatcctagtctctgataaaacagactttaaaccaacagagatcaaaagagacaaagaaggccattacataatggtaaagggatcaattcaacaagaagagctaactatcctaaatatatatgcacccaatacaggagcacccagattcataaagcaagtccttagtgacatacaaagagacttagactcccacacaataataatgggagactttaacaccccactgtcaacattagacagatcaactaaacagaaagttaacaaggatacccaggaattgaactcagctctgcaccacgcggacctaatagacatctacagaactctccaccccaaatcaacagaatatacattcttttcagcaccacaccacacctattccaaaagtgatcacatgcttggaagtaaagcactcctcagcaaatataaaagacagaaattataacaaactgtctctcagaccacagtgcaatcaaactagaactcaggattaagaaactcactcaaaactgctcaactacatggaaactgaataacctgctcctgaatgacttctgggtacataacaaaatgaaggcagaaataaagatgttctttgaaaccaacgagaacaaagacacaacataccagaatctctgggacacaatcaaagcagtgtgtagagggaaatttatagcactaaatgcccacaacagaaagcaggaaagatccaaaattgacaccctaacatcaaaattaaaagaattagaaaagcaagagcaaacacattcaaaagctagcagaaggcaagaaataactaaaatcagaggagaactgaaggaaatagagacacaaaaaacccttcaaaaaattaatgaatccaggagattgttttttgaaaagatcaacaaaatcgatagaccactagcaagactaataaagaagaaaagagagaagaatcaaataggcgcaataaaaatgataaaggggatatcaccaccaatcccacagaaatacaaactaccatcagagaatactataaacacctctacacaaataaactagaaaatctggaagaaatggataaattcctcaacaaacacactctcccaagactaaaccaagaagaagttgactctctgaatagaccaataacaggctctgaaaattgtggcaataatcaatagcttaccaagcaaagaaaagtccaggaccagacggattcactgccgaattttaccagaggtacaaggaggagctgttaccagtccttctgaaactattccaatcaatagaaaaagagggaatcctccctaactcattttatgaggccagcatcatactgataccaaagcctggcagagacaccaacaaaaaagagaattttagaccaatatccttgatgaacattgatgcaaaaatcctcaataaaatactggcaaaccgaatccagcagcacatcaaaaagcttatccaccacaatcaagtgggcttcatccctgggatgcaaggctgtttcaacatacgcaaatcaataaatgtaatccagcatataaacagaaccaaagacaaaaaccacatgattatctcaatagatgcagaaaacgcctttgacaaaattcaataacgcttcatgctaaaaactctcaattaattaggtattgttgggacgtatctcaaaattataagagctatctatgacaaacccacagccaatatcatactgaatgggcaaaaattggaagcattccctttgaaaactggcacaagacagggatgccctctctcactactcctattcaacatggtgctggaagttctggccagggcaatcaggcaggagaaggaaataaagggtattcaattaggaaaagaggaagtcaaattgtccctgtttgcagatgacatgattgtatatttagaaaaccccatcgtctcagcccaaaatctccttaagctgataagcaacttcagcaaagactcaggatacaaaatcaatgtacaaaaatcaaaagcattcttatacaccaaaaacagacagagagccaaatcatgagtgaactcccattcacaattgcttcaaagagaataaaatacctaggaatccaacttacaagggatgtgaaggacctcttcaaggagaactacaaaccactgctctatgaaataaaagaggatacaaagaaatggaagaacattccatgctcatgggtaggaagaatccatatcatgaaaatggacatactgcacaaggtaatttatagattcaatgccatccccatcaagctaccaatgactttcttcacagaattggaaaaaactactttcaagttcatatggaaccaaaaaagagcccacattgccaagtcaatcctaagccaaaagaacaaagccagaggcatcacactacctgacttcaaactatactacaaggctacagtaaacaaaacagcatggtactggtacaaaacagatataagatcaacaaaacagaacagagcccttagaaataatgccacatatctacaaccatctgactttgacaaacctgagaaaaacaagcaatggggaaaggattccctatttaataaatggtgctgggaaaactggctagccatatgtagaaagctgaaactggatcccttccttacaccttatacaaaaatgaattcaagatggattaaagacttacatgttagacctaaaaccataaaaaccctagaagaaaacctaggcaataccattcaggacataggcatgggcaaggacttcatgtctaaaacatcaaaagcaatggcaacaaaagccaaaattgacaatgggatctaattaaactaaagagcttctgcacagcaaaagaaactaccatcagagtgaacaggcaacctacagaatgggagaaaatttttgcaacctactcatctgacaaagggctaatatccagaatctacaatgaactcaaatcaatttacaagaaaaaaacaaacaaccccatcaaaaagtgggcaaaggatatgaacacacacttctcaaaagaagacatttatgcagccaaaagacacatgaaaaaatgctcatcatcactggccatcagagaaattcaaatcaaaaccacaatgagataccatctcacaccagttagaatggaaatcattaaaaagtcaggaaacaacaggtcctgtaaaggatgtggagaaataggaacacttttccactgttggtgggactgtaatctagttcaaccattgtggaagtcagtgtggcgattcctcagggaactagaagtagaaataccatttgacccagccatcccattactgagtatatacccaaaggattataaatcatgttgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaagctggaaaccatcattctcagcaaactattgcaaggacaaaaaaccaaacaccgtatgttctcactcataggtgggaattaaacaatgagaacacatggacacaggaaggggaacatcacactctggggactgttatggggtcggggcatgggggagggatagcattaggagatatacctaatgctaaatgacgagttaatgggtgcagcacaccaacatggcacatgtatacatatgtaacaaacctgcacattgtgcacatgtacactaaaacttaaagtataataatgataaaattaaaaataaataaataaataaacacaactgcaaacctgaatagaaaagtattattcgatgattcatttactacccagtagactttactggatgattatatgttggattttgtaaaaaataattgaactaaactctttgaacttagaaaggagtccaatatacactcaaagggttataataaaatggaattgtttgcatgaaatttgctaactgataattttcattgaatgtattttggatttccaaaacagaatttttatttttcattatttagcaggcctcaattagatatgtttattttcttaggttaaagactataataatttctgagaaaccttatgccatgctattatcaattatatttttaaaggcttttcaaatttgagatcttcttaccctaggcactttgcaaatgaatcattgttagccctgttcataataaactgagaaaattactcaaattctctaagtaaatgaatatgagtgcaaattgactgtaggctcactcattcaggtggtggtagacattcatcctacatcctcagggcttagtgttctgtattgtttgggaaaaaaatgggtgtataattaggaacccggattccagacattaatctgatcaattttttcagaccacatctttcacccagcatcatcacttcttattatatttctataatttcaactacaaactttttctaaactaagaagatttagtatgagcttccttatagtatagccctaaggtagctttgcaactgttatttaggaaatgaaaataaaatgtggtcatccaagaattttaaaaataagcaaaaatgcaaagccaaaaaggcacatgttaatgttaagagagtggtatgaaacattaaatttggctagaaataaggttttcgttgcaagaagtaatgagaaatggggctggaaaactgaattgagccaagatatgaaggatttaacagccaatttgatcccctcactcatgggtgatcacggatgccaggtggaaacacttgaaaactaaacaacacccttcaaaaataatacataggtaaaaaatgaagtctcaagggaaactttttaaatacactgtactgaataaaaacaaaaatacaacatataaaaatgtatgggacacaggtatagcagtgctgagagggtaatactaaatgcatccattagaaaagtgaaaagcctctcccttaaacaaaaaaaaaagtagaaagggaacagcaaaattaatgcaaaacaggagggaggaaaataataaaggtaagagaagacagcaatgtaagtgaaaacagaaaaatagagaaaatgaaatgaaatgaaatgaaaatgaaaagctggttctttgaaaagatcaataaaattgacaaacctctcacgagactgacaaagaaaaaggagagaagacaaaatatgcatatcaggaatgaaataagaaacatcactacagaccatacaatatccagagtgaagcaagagaataccaggaataacactactctcataaagcacttaggtgaaacgaaccaattccttaaaacacataagctaccccaactcacccagcatgaaagagatgacttgaatagccccatatctatgaagaatattgaattaataattttaaaactccttaaaagaactctccaggccaagaaagctttactggaaaattctaccaaatgtttaaataattaatagtaatctacacaatcatccagagcatagaaaaggaagaaacattttccaattatttttatgaaactcatattaccctgactctacatgtaaaacaatgcaaaaagaaaactccagattaatatctctcatgaacatagatgcaaaaaccattgacaaaatatttgcaaactagaattccacaacatttaaaagagaatgatacaccataaccaagcagggtttgtactaaggatacagtctgattcaatatttgaaaatcaatcaatgtaatccacctgattaacatgccaaagaagaaaaattacatgacatgatgtttaattttatgtgtccacttgactggaccacagggtgtgcagttatttggttaaatattgttctgtgtgtgtctgtaagggtgcttttgggtgagattgacatttgaatcattagattgagtaaagaaggctgtcctccccagtgtgggtgggcctccttcaacccactgaaggcctgaatagaaaagaaagattaagtaagaaagaattctttctctttgcctgtcttgtcactgggccattgatcttctcctgtcttcagacttggacttggactggaacctacatcactggcgcttctatttctctggctttcagtcccagactgggactataccatcagctctcctggatctgacttctcagcctccatgattgtatgagctgattccttatcatttctgtttctctggagaatcctctctaacacatatgatcatatcaactgaggcagaaaaagcacttgacaaaattcaacatccattcatgataaaaattctcagaaatctaggaagagaggagaacatcctcaacttgataaatctacaaaaacctacagtttacaatgtactttatgattgaagactatatgctttttctgtaaggtcaggagcaaagcaagatgtcctctgtggccactgttattcaacatactactggaagttctagacactgcaataaggcaagaaaaggaaataaaaagcatatactttgaaatggaggaaataaaactatccctgtttgcagacagcatgcttatctgaacaaaaaatcccaaggaatatacaaaaacaaacaaaaaactagaactaaaaagttcagcaagctcatagaatataagataaacatagaaaactgaattatatttctacttgttatcaataaacatatggactctgaaatgtaaaatataatactatttacagtcactcagaaacaaaggaaatacttaggtctaagcattttgtatttttagtagagatggggtttcaccatgttggccaggctggtctcaaactccttacctcctgcccccctcagcctccaaaagtgatccgtctgccttggcctccgaaagtgctgggattacaggcgtgaaccaccgtacccggcctaagtgtttctttttctactggttatagagctggctactgtactccttctggtttctctccattggggtggtcagttgcccactggggcacaggaaaggggttggcttctgttgagggccccaggagctaagtataaggatgttctgggattggaaaaaccagtgctgatcataatctcaaaagactcaatctgaatgccataagcccaaaaacataattctggaaaatgtaattttaattttgttcttaaaaagcatttatttacattcttaaaagggaatttaagaaacataaaacatgaaagaatactacttcataggccactttatacagtaaaatagatacatataaataatcacatataaatttttgcaagcataaacacccaggaattctaatgacagtcacacaggtataagagctatgaagagatgaaccataaaaaaatctgtcagaaagtgaggtataagtgcgcatcactttggtgcataattgtgtgcacccagctttatagctacagtcgtctgaaatattaatatcatgacagaaaacctaagtcttttgaccagatctatcaaaaacctcagtgagtcacccctgcatatgcagtcacccaaagagctgagctgtcaagaaatagtatcttttacaaccacagatgcacaaaaagaagatctctacatttattgaggaagttttaatgttcttatatacaaagtcaacaattgtgataatgtactttcctgaagtcaaatttgcaaaaattgcatgaaacaaattagaactctctaaaagtctctgcacaattatacctccagcatcagaaataacacaaagatgatatatatggcatagccagttggcattatgtgtgaaggggcagaagtcatacacaattgaatagtttggcaggagagatttcttgtattttttgcctgtgttttcacttgatctttgaaacactcactgcacttgtatttggatagtggttggggcctacaaattttgtaggtatatgctacccatttgaaagtctggtcgctgctcagcaattaagcaattttccaccttcacagcaccaataataattagcttttaaacttttatctttcaccattaagtaccttcatacacttaacttatcacagtctttttgtgagggagcaatttcacagatctcttttattgtgttgtaaggaatacggtaagaaggaatgaaattcagtttccccaataccaaatttgtactagtcagggttctccagagaactagaaccaatagaatatgtatatagagatatgagaggggatttattagggaaattggctcacacaattctgatgactaagaagtcccatgacagactgtctgcaagctggagaccatgggatggctgcaggatggctgaatccaactcagatggcctcagagccaggaaatccaatgatgtcactctcagtccaaggccaaaagcctctggacctgggggacaggtggtgtaagtcttagagtctgaaggccagtgagcctggagttctgatgttcaagacagcaggagaaaagtctgccccaactctcagagaaagaccaattcacattctttatttgttctctatgagcccacagtcagttggctggtgcccaccaaaattcagggcaggtctttctccacatagtccactcagactcacacactaattgcctctggaaacaccctcacagacacacccaaaataatgcatttactgggtttctagacatgctttctttttttttttttcttgagacagagtcttactctgtcacccaggcttggagcacagcggaacaatcctggctcactacaacctctgcctcccagggtcaagcgattctcatgcctcagcttcccgagtaagtgggattacaggtatgcatcaccatgcccagataacttttttgtatttttagtagagatggggtttcaccatgttggccaggctggtcttgaactcctggcctcatgtgatccacctgcctcagcctcccaaagtgctgggattgattacaggcgtaagccactacctagttactccttaatccagtcaaaatgacacctaaaattaaattcacgagtcctcccattgtcagcctggcacccctacacattgtcttaaaacatacttcacttccaagtaaagccaatagcagataatagttccgcttaacatgatgccaccatcccaaatacaaccaaaaatgcactaatcccttccacagaactctgctttcaggatttccaactctggaattttaatcattcaggattgtacatggggaattttagacattaagaattttagacattagtgcttttgatcattctgtatttcaacatacgggattatggcctttgggactgtctttcaggattatgatcagcagcagattgtaacatgtaaaaagtcacggacaatgagttactcctacacacctattagaatggcagaaatccaaaatactgacaccaccaaatactgatgaggatgcggggcaacaggaactcttattcactgctaagggatgtaaaatgatgcagccactttggaaaaactaaacatgctcttatcatatgatccaggaatcacattcctagatatttactcaagttagttaaaaatgtaaactcctacaaaaatgtgcacacaaatgtttacaacaactttattcataattgccaaacctggaagcaactaggatgtcctttgatagataaatagataaactgtggtacatccagacaatagaatattattcagcactaaaaagaaatgagctatcaagccacagaaagacttggaggaattttaaacgtattgtactaagtgacagaagccaatctgaaaagacttcatattgcggaatttcaactatatgatattctggaaaagaatggagagaataaaaagaccaatggtggccgggcgcggtggctcacgcctgtaatcccagcactttgggaggccgaggcgggcggatcacgaggtcaggagatcgagaccatcccggctaaaacggtgaaaccccgtctctactaaaaatacaaaaaattagccggggtagtggcgggcgcctgtagtcccagctacttgggaggctgaggcaggagaatggcgtgaacccgggaggcggagcttgcagtgagccgagatcccgccactgcactccagcctgggcgacagagcgagactccgtttcaaaaaaaaaaaaaaaaaaaaaaaaaagaccaatggttgctggaggttagggggctgacaaggatgaatagatgggacacaaaagattctcagagcagtaaaaccactctgtatgatactacaatggtggatacatggcattatacatttgtccaaacccataggatttacaacacgaagagtaaaccctaatgtaaacagtaggctttcgttaaaaataatgtattcatattggctcatcaatgtactgcatcggtaacaaatgcatcacaataattaatgcaagatgttaataataagggaaactggcagaataaggctatggaaactccctgtactttctactcaattttcttataaacctaataccgctctaaaaaatagtctattaattttttaaagatgtaacttaatagtaaccatgttaccctttcaaaaactgtttgtcaattttgctacaaaagagaatttcaagtatttatctgttaagaacaatagttacaacaaaaacatggagatatttttgcaaattaaaaacccgtggagagataagtttggaaacaaacctaggacttaaaagatgaagtcctggctcctcatgttgtgttactttaggtaagtcagttaccctcttagacctcagtctaacacttttgttatttaaaaaaaaaggattattatgatgcatcaaatattttatactagatctattcacttaatatatttatgtttaagtatctcgtaagtaaaatgaattatttaaacattttcaaattctacataattcctagatatatgtcacccatgaatataaacatatattttaaattatatgaactaggtaagtcatcaacatgaaaatcaagtcaaaatcaattacacattaaattggttacagtatgtatctttaacttaccaccaccatctatcttcaaatcactttatgccacttgatgtataaaaactttataatagtatacttctgctttcccctcccagcctttgtgctattgccatcatacatttacatgtgttataaacccccatggtacattataattgtttttgcctaaatagttatgttttacataaattgaaagtttggagatccattttatatttacctaatctttaccatttctgacactctttattactttgcatacatccaagtttgcttctaatatgctttccctacaacataaactgtctataatatttcttatgagatcatttatagtgccaatctatggtgacctaggtaaagaatatgcggtacctatacccatggaatactatgcagccataaaaaagaataaaatgatgtaaaatgatgttctttgcagcgacatggatgcagctgaaggtcattatcctaagtgaattaccacaggaacaaaaaaacaaataccaaatgttcttacttaaaagtaggagttaaacaatgggtgctcatggacataatactactaggggagagagggaaggagaggggcaagggttgaaaaactcaccattgggtactatgcttagtacatgatgacaggatcaattgtaccccgaaattcagcatcacgcaatatacccaggtaacaaacctgcagatgtaccctctaaatctaaaagttgtaactattaaaaccagaaaacctcacttctcacccccaaaaaatataaaattaaaaataaaagacgctgtttcattgtctcctggcttgcattgtttataatgtcagcagtcatctttgttcctgtgtacgtgacatgttttttttaattacttttttactctgactacttttaagatttttttctctatcacatctttctagcaatttaatacaaagtactttggagtatgtatagtgtgtgtgtgtgcgcacgcgcatgcttgtggtttgttttttctgcttgtggtttgttgagaaccttggtttacagtttcctcaaatttagaaatgtttcagccattatttcttccaatattttttctgccccccccccacctttatgacattccagttacacaagtgatagacagtttgctattgtttcatagcttactgaggctcagatgggtttttccagcctttttctctctgtgcttcagtctagatggtttctattcctatgtattcaagctcactgactttatcttatgaggtctaatattctgttcttccaatccagtgtattttttatttctgatataacatttttcacctttaaagtttcatttggctctattttatatcttttctttcctcatgatgtccatgttttcttctacattcatgagcacatttataatagcagtttttaaattaacacttgctaattccatcatctttattatttcaggttatgtttctatcggctgatttttctctgggttattggtcacatttttctgtagctttacattgtccatgattttttattggatgtggcatatttggaatttgaattttgttgtcttctttgaaagagtgttgaattttgtcctggcaggcaattaacttacctgtggatgagcttgatgttttgggggcctcttaaaacactggtagggcacatctggagtatcttttattctaaggctagtttagctctactttttaagacatagccttctggggtcttttctgaatgctccaggtgttcaatgggctcttttatgtctttgggggtttgtttgtttgtttgtttgtttgtttgttttttattgctggggagaggagggggaacagagtctcgctgtgttgcccaggctggcctgagactcctaggttcaagtgatcctcccacctcagcctcttgagtagctaggattacgggcacacaccacagccctggcttcttttattttggatggtcaaaacgtacagtatcacaaccgtatgtaagctctgagaattgttccgtttacaactccccaggagtctatttttgcctagtttatgcatacatggcagagcattcaacaaaaaactcaagaggatgccgatgcaggtttctggaactttctctttgcaccactccctgctctccggtattcttccccacaaagttcagccatctcagctctcctgaacactgacatctgcctttttcagagtaatgctctacttgaattccccttccctgtgccacagtttagaaggtgtctccaggcaaagagccagggcaattgctggtctcacctaatttattttctttctatttaagatacaggcctgttctgttgttcagtatctgaaattgttgtctgttatattttttccagttgtctagttgtttatggaaaggaaaaaaattcagaaccggataatttgtccatgctttatatatttagtaggagtttcaagaatgtctttataatgggccagattgtctcaaaaattacaagtatattaaacactaaatatgtatatgtttcttcttaaccccaaaatactaagccatgattttatttctcttaaacatttctatatttaattctgaattttactgggtttaaaagattctcacccattaaggaaaacagtcaccatccccattaactgaaccacaacactgattgtactgattgtgttctaggcagtcctgaggggactcactgagtactctttgtgattgccatgtccatgatgccatcgcttagaagaagtgccacttggcccacattcctgaatgcaagataaacacattaattcttctgtctactcacagcagtgctcaactccaactccagttgatcgtttgatcagattcttcatttgtttggttcctaagatatagacatgtctttctttctgtcttaaaaggcctttaaattccatggaatcctgcatttttttcagtctcgtgatttacagatgatgtattgctattcagttgaattttagatctctctcctggcattatcaaacttgcagccataacatctgaggtcactctctcagcaccaggggccttgtgaatctgtgagcactgtgccagcacagccttacaaagctgtggctcagacagggcagatgtgatcctcagtagcagggcaattgtaactatgccaacaatgactctttgggtctgggggaaagtttctgtctatccacagtggactctagaggatagtgtgggccaagtggatatagtattggttcattcagaaaaatacaaacttctctaggtatctcaagctagaaagtgatttaaattaaggaattaagagacaaaatgtgggagctaaaggagcaaaaattgggaaagttggtggtttccaaagatgagaaacatcagaaaatcatagcatcctaccaggagtaatgcccatctaattcctcatttctcttccctgatacagcatgtgagctccagaaagcctgggttttgctagctatttcctctgcaggcattatgctcacctccagaggtactagaactgctggcactattgcaatagtctgtagtcacctgcctctgccataagcagggtagtttctatcttcttcccacatttaatttgttatgagtgcctcccattgccaacaaggaatcccaactgagcacaaaatctggcaaatgcagtttgcaggtttccagccacagtggcttagggaagagtataaaagagcaagtatgggtctgtagctatagctacattaaagctatggctttaatgactctatttttgaaaagcctgacacataggaaactctcaaaaaataactgtggtttctgttatttttatttaataagcagtggcatgaaaagtcaacctatatctgggctaaccatacaggaacagactgtaaagatgactgtgccctttacccaatagtgctacccatccacacagttctcctttttccatttcaggaatggataaaacaatgattgtattgatttcctgctcactgtggtattaattgcttgtggtccccaaacacaatgtaagttagtaatcttcgtatccatccatttgttataggatttttggggtgtcacttcaccagctggaaatctctgtggctagtggtgcctttgcccgagttttgctctgtcccactgggctcattctgcccatttggcctgtcaggctgcgtttggctcatgctactggcctagatcccacgcctgccaagggcaagccaggcacagagcagcgaggggtgtatgagtggagtgtggggtccaggcatgctagctgctgctgcagggtgggcagctccaggtgccaacacaggcactggctccctgtgagggcacagctggaccaggcacaccacaagcagcacccacagctggcactagggaacatagtggtgcccacaagcttggagatgccaggaaccacagggctccaaagagggagtcacagccctggcttggggagttcccaggtttgggctccccaaagagccacagctctcctcttcttttcttcacccacaacatggcaagcaagaggcatgtttcagccctgtttgtgttacagctcttttagccccgccattcaatgggtcccaagttcttgtcctgcatccaggaagaatgaggtatgcagagaagtggagggcgagcaagacgaagaggagttttattaagtgatagaacagctcagaggagacccaaagtgggtagctcctctctgcagccagggtgtccaacgagtgttcagctctcagcagagagggtaactcctctctgtgagcaggtcatcctatcatcgtttcagttctcagcagagagtgccgctcctctctatagctggttgtctgtcctttctccatcctctctttgagtctggctgagtctggggtttttatggacctcagacgggaggaagtgcatgctgattggtccatgcacagccatgggtggccatgggcaggcccagggaaaagcactacaagttccccctctggtctgcaggactgactgccctgcccccaggcttcatgacctccccagctggaaggtggggcatcaccaggcacatgcccacttccacccaggaacctgtctgtctcctgccactgttcatggctcccaggctgttcatgctgaggggtgctggcaggccagcaccaggctgtcctcaatacctgcttggcctccctcccacgcttgtcagtgcccaaagtccagagcgggctgaggtagcagggagctggcatgtcagtgctgcctcgagcatgtgcacacccagccaggcttaccagtgcctagacttggcccagacttgtcccctactttgctctgagattggagtgggcactgaccacagggagaagccaggcagtgagagcaggtgcttctgagcctgctgcaggtagcgagggccttcctggacccccaagagcacagagatgcctgggtctggagctgcagcagagtggctacagctgcacccaaggagctcccgccccacccactcagaaggagcagggcttccacttgtcccagctcctgctggctccatggagcatgaacccccagctgtgcttcctcacagcctgtggcaggtgttccaggttcttgctgtgcccctctctacccattcctccgtgccctaccacattggcacgcagctcagcccagccccatcacagtggcttccagggtcgtgggctccagggggcctcccaggggtggatttgaggattgtctccttcccccccaggccctccccacagtggcggtggatgatagtagtgacgtagggccagggtctggaggagcagaggctctgggcaagggagtgggtcccacccagctgcgagaggttggattgggggcagctcagtcgactgccttagggatgcaaagcacaggagacccaccactgccactactgctcccgcagctgcttctgctgccactgctactgcctcttcgctgcagctggtggccactccagatggcctgcagctgccatcacattcacagtgaaagaagttttttaccaaatgtatatattcacacacctcaaaagcaccatatgagaaatattttagaaaaattgcctcaagcataacatcaaggtcaaattaacttgagactatgaagtcagcaatgtttgcttagaaattaattcagtcattcagtcaaagctcacctgctggctgttgccaagagggctttgacgatatggtctgtaaggaagtgggacaccgtaggcatttgatatatgttaagtaatagtaatgagggcaataagtactcgcatactgagtggagggagctgttcgggttaagaagaatgcttctaagctctaatgcttaatggataaagattaggactctggaaacctttctatagtcaacagaatcattgtctcttattcaccctggctgccaattcctggaccagggtctgataatgcaaatatctctttaaatagcagtctaaaagaaaactcatattgtgtttctttaaaacaaaaaaaaaattaccatttgagccaaccagatacctgggcttaaattctgattctgtcccttacaaaaggagagatcttaagacagccaacctctcagagcttcagtttactcatctaaaaattagggcattgataatacatttttaagattgcacagtgcttctcacataagtaatgggtattcttataaaaccaatctgcaattacaggcaactttggacaaatttcttctttaagaaactacagtgaaaacctagattccctcccaactcccctgcaaaaactatgtaggcttttgaatgtgattttatatttgaatctctatatgttatatatcctacaagtgcacctcagacaaaacactgcatatctaattctggttgaggtgagcaattcattttcctagttcaacatttctcaaatatttgacatattttcataaattataatcccatcattagaaagtaccatttaacagatcagaatttattcaatatatctgaatagttctaggggaaaataactgtgtcaaatatccataccagcctacccaatctgtcccttcagtagtgatctccaccagaaaaatgaagcctgtaagatcctgcccaggagctccctaatcctacacctcaatgtccggtaaatacatccatcctgtgtgcattcaggagagattcatgctgcaatacactttcgtccatgaaaatgtctcttctcttcactgatctatgagaaatatttttgagctgtaaaagcaaactcctgaaccgtatttcccagatgtctatttaacaaactgccatttccctattacgctaagcacttaaactcaacactaaaagtcaaataagagattgaatataaatgtatatgtgctgatcaaaatacaataatgaaaaaggctctgataaggactctacaaaatttgtgggaggatttgtttgtgtgtgtttttaatatgtttttaaatgggccatcataacaggcagcttattgattatatttttttgacgtttataaagttgggaaaataataaccaataattattgaatgtttattatatgtgtctgttctaaccttttgctttattaacttatttaccctcaaaacaatccagtgaaataagtcccattgttatctttattgtcttcccaagaagaccccacttcagaaaatgtgaacttcattcttctagttgttcaggcaagacctttggcatcatccttgagtcttcttgttcacaccccacattcaatccaaattcaagtaaacaaatgcaagtgtcaaagacaaatgtgcaatgtatatttctcctatttcgagcctgctggattattccaatgaccttactgacctccttgcactagcccttgtccctgcagtctagtgaccacacaacagcctgggattcttgtgagatccaagccggatcctgtcacctctcttctcaagagcccctaataccttcccacctcacaccgagtgaaccccaaagtcctcatgctctcctgcaagaccctacaccagtggcccgggatctcccagactcagatccccatccccgctgctgttccacactcagccctctggtcacacccactccaggctggccccgaggattagggagggagccagaacaggggtgcagggcctggctttgcagggctccgcttggggtttaagactactctttgttgctgtcttgatattcttaataataaaatatctctgaatgtgtgtttgctaagaaaagaccaaaagagcctcagctggggaccacacacctcagcctcccatggcctaacctccaaggatgggctctggcagccgctgcgccctaaggcccacctgtctaactggactaacccggtcccactgctagggaagacggatccccatggtcgccttccgtcccagagtgaacctggacagggcatgcagggggtcaggtcatgtgcagagggtcaggatcgtgcatgtccctggcacctctgcttggcccgtgcagcaggctttgtcaccagtcctgtccaggcaccgagcgcatcctagcaggaaggttacagtctccaggggtcacctggctgctgtgaaacggggtgatgcagggccgggcacagtggctcacccctgtaatcccagcactttgggaggccgaggtgggaggatcacttgaggtcagaattttggaccagcctggataacatggccatctctacaaaaaaatacaaaaattatctggggccagtagcgtgtacctgtagtcccagctactcaggcggctgagtcaggaggatcgcttgaggccaggaggtcaagggtgcagtgagctctgatcctgccactgcactccaccctgggcaacagaatgagaccctgagagagacagagacagagagagacagagacagagagagagagaagctcactactttatgtctatatccctagcattggatacttgcaatggaaattcatccaaattttctgaaaaactgagtttccactttgtagatgaggaaattgggactcagagaagcgaaaggacttgactttctaggatccatccactcccaggcagtctgcctcaggggcaagatattcaaggccgtaaataaagccaatttatctgctgacatttcaatcaaacataagatgaaatcctccttttttcatttggtcttctcctggttacttgaggaaacgttaacaaatatcttcagaatccagaaagaatgtcgactgacttctagatagtaatcttatagaaactataggcaccaaagttaaacattaaatgtgaaaatatgaaacccacaggctatgctaagataatgtatggggaagcactatgaaatttgacattaaggtgacattatcattattttaaatgcctggagcatagaggtcctttaaagaaaggggttattaacatgttccttaaatcaatgcaacttttctctcaatactatttatcccactgtttgaaaatcatttcccacctaccatgtgacacacatcagatagtccttgggaccccaaggacagagttattccactccagagggcttcatttttgcaaaaataatgactggcaaatatcttttctggtgttattttagaaaatttacaagttaggaacctgaaaagtgttccagaagtgtggtctgttaacaggcagagagaacttgttctcctcacatctgcagtgacctattgtgagatggcccctgggactgatcacgccactgaactgagacttgcaaagatgatgaaaagaattcaaggcaactgactacagcagcttggcagagagagccgtcacacactaataatactaatttggtctttatttttatatttacacagcagtcggctgaatatccagctgttgcgctgtctttagcaaacagttctcctttctgattttgctttgttttgtttgggctatcactgtaattcaggatggagcctggagattttcctccagtatgtgaatttctcaatccctaggtgtgccctccttgtgtctatatgaaacagagtatgcatacctcttgaaagtaagaggaaagaaaataatagccagtgtcaaaaatgttatcacattcattttcttctttcaactcttccatcttccttctctagagcttgagagcaaaggtgagaggaaatggttttactgcctgaaaggtgtcctcgaaatgctctgtgctgcagggaggaagggcacgatgaggagcaagctactcagaagttctgggaaaagcatctgctccttcaaattgggccaaaaaaaaaaaaaaaaaaaaaaaacaatgtaacaagaacattgcagcaacaaggaaaaaataatcataatccttgaattccccttgttttcctggctttattttttctccatatttctgcaagtgtaagatatcttcaccagtattgaaagccatattcttttctcaaaggtccagatgacctatttttctccctgagattgtcatcaaagataggtgaatgtcattatgatgcttattttaccacattgacaagatccacccattattctctaagcacttattaagcagcatgttagacatacagctaaaagacaaagtagacaacagtccttctcatctaggatcttacagtctagctcaccacaggagacccttatggaaattactaaaccaccctcctctgtcctcttccaaccctaatctaggaaaattgtatgacaccatcactattccctctcatgggaagactgatcacttatgggggcaaagagaagacggaaaccaacatttgctgaaccttctggtgtctgacagggacacgctaggtgcttttgtatttacaatctcatttaaccctgcaaaacccctaaaaaattaatgttgctatccctattccacaaatgagaatgctgaagctctgcatgccacggagctataggtagaaccagcattcaactctagttctaaacccaggttcaaaatacagcctttgccattatacacacatgcctacaagtaactaagaatggctcttcacccaaaagatatgtgctggcaagctgatagatagaaacaggagagatgcaagatagagttacttgagtttcaaatttacataactctggagccctggcaggtaatcagttaagtagaacagacaggtgtaatactgtagagaatgccgaggcttgtggcagattggagggactagtcaatgtaaagcaacaaattcaattttttaaaaaactttatagaaacctaaatgtatctggtgccaaattagtactcagcgacagtgtacaacttccgcttgaactgttaagtttattagaaatagctcctgattgtttttattgtagtaaaatacatgcaaaataaaatttatggtttgatattatgtatattttacataacatgttaaccatttttaagtgtacggttcaatggcattgagtacattcacactgttgtgagacattcactaccatccatctccagaaatgtttcgtcttcccaaactgaaattctgtacccatcaaacactaactgttaattctcccctcacctccagcccctggcaaccaccattcaactttctatctctatgaatatgactactctaggtgcctcatagaagtggaatcatgccatatttgtctttttgtgactgacttatttcacttgttgtaatgttttcaaggttcatccatgtagcatgtgtcagaatttccttcctttttaagactgaataattttctattgtgtatgttgtaaatacatacatatatatatatatatgtaacattttgtttatccattcatccatcagtaaacatttgggttgtttccactttttggctattgtgagtaatgctgttatgaacatgggtgaacaaatatctttttgagtccctgctttcagttcttttgggtatacagtcatccctcagtatccacgggggactggtcccaggaccccctgggatagcagaatccacaaacgctcaagtctcttatataaaatggtgtagtatttgcatataacctatagcacatcttcccatatactctaagtcatctttaaattacttacaatgtacaatacagcgtaaatgctatgtaaggagttggtataacatattgtttaggggataatgacaagaaaataaaagtctgtacattttgagtacagagacaaccatcctcttttttcaaatatttttgatccatgaatcttttcaatttgaaaaatatattttttcaatgtttttcaaatatatttgaatccatggatgcagaacccatgggcaaagagggctgactatgtatccagaaatggaattgccagatcatgtggtaattctatgtttaattgcttggagaactgacatactgtttttcatacgggatgcaccatttaacattcccaccaacagtacacaagtgttcctatttcttcacattctcaccaacacctgctattttctttttttttttaagtaatagccatactaataggtatgaaatatgaaattatatctcattgtggttttaattggtatttctctaatccttagtgatgttgagtatcttttcatgtgcttattggccatctgtgtaacctctttgaagaaatatctgttcaaattcctttgcccatttctaaattgaattttggggtggggaggttgttattgagttatagtttttttttaatatatctttatcagacatatggtttacaaatatttttcccattctatgactgtctttttactctgttgatagtatcctttgatgtacaaagatttacattttgatgaagtccaatttatttttttcttttgttgcctatacttttggtgtcatacccaagaaatcactgccaaatcaaatatcataaagcttttcctctatattttcttctaagaattttctacttttagtttttacatttaggcttttgatccattttaggtaatttttgcatgtggtgtaaggtaagagtccaccctttttgcatatgttttcccagaccatttgttgaaaagactttcctttccccattgaatgtcttggcaatcttgtcaaaaatcgtttgaccatctatgtgggggtatatttctgggctcactcttctatttcattggtctatttgtctgtctttctgtcagtactacactgttttgattactgtagctttgtagtaagctttcaaatcagaaattgtgattcaaatttttttttcaagattatttttgcttttctgggacctctgtgattccatacgaattttaggatggatttttctatttttgtaaaaaatgtcattgtgataggtatttctctgagtctgtagatcactttgggtagtattgacatcttaacaatattaagacttctaacccatgaaaacaggatatctttccacttatttatggcttctttcatttcctttagcaacattttgtagttttcaatatacataccttttgcttctttggttaatttataagtattttattctttttcaagctattataaatgaaattttttcttaatttccttttcatgtttccattacatgtattgcaaatatattcatgttgtccactgttagcatatagaagcacaactgattttatatttattttttatcctgcaactttgcaatattgacttattagttctgtcatgttttttgtggaatctttagaattgtctacaaattatgttatctattcagagataattttaattcttcttttctcatttgcatgtcttttatttcattttcttgcctaattgctctgactgggacttttaatactactttgaagagaagttgcaaaagtgggcatccttgtctttttcttgaccttagaagaaaagctttcagtcttttaccatcaagtatttttttagctgtgggcttttcgtttatggcctttattatgatgaggtagtttccttctattcttagtttgttgagtttttttaatcttgaaatagtgttaaattttgtcaaatgctttttttgcatctattgagatgataatgtggtgtgttttccccctccattctgttaatgtgctgtattacattaattaatttttatatcttaaatcatccttgtatttcaggaataaatcctacttggtcatggtacaaaatccgtttaatatgctactgaatgcagtttgccagtattttgttgaggatttttgcatcaatgttcataagggatattggtttgtagttttcttttttgttgttgttgttgtttttgttttgttttgttttgttttgttttgttttgttttgtttgagacagagtctcactctgtcgcccaggctggagtgcagtgatgcgatctcagctcactgcaacctccacctccctggctcaagcaattcccctgtctcagcctcccaagtagctaggattacaggcacaccccaccacacctggctaatttttttttttttttagtagagatggggtttcaccatgttggccagactggtctccaactcctgatctcaggcaatctgcccacctcagcctcccaaagtgttgggattacaggcgtgagccaccgttcccagctgtagttttctttacttgtagtgtttctatctggctttggtataaaggtaattcttgaatgaagtaggaattgttcccttcttttcagtattttgagagtatttgagaaggatttatggtaattcctctttaaatatttggtaaaatttaccagggaatccatcagatccctgggcttttctttgttagatggttttgcctaacagatgttatctccttactagtgataggtctgttcaaattttttatttctttatgattcagtcttggtagattttgtatttctaggaatttgtccacttcttttagattacccaattctaattggcatacaactcttcatagtattctcttataattctttttacttctgtaaaattcgtagtgatgtcccaacttttgctactgattttaataattgaggttctttttttttcttaatctagctaaagattttgtcaattttgttgatccttttaaagaactaacttttggttttcttgattttctctattgtttttctattctctattttatttctgctctaattattattatttcctttctccggcaagctttgtgtttagtttgttctactttttatagttttttaaggtgtaaagctagattattgatttgagaccttatttttcaatgtgagcatttatatctatagatgttttagcttagcattgctttgctgcatctattagtttttgctgcatctattagtttttgctgcgttgttttttcatttttatttgtctcaagatattttataatttcccttgtgatttcttctttgacccactggttaagagtatgttgtttaagcctgggcaacatagcaagacttcatctctactaaataaaataaaataaaataaaatagccaggcatgatggcacacacccatagtcccagctacctgagaagctgatataggaggatcccttgagcccaggagttccaggttgcagtgagctatgattgcaccatgatactcctgcctgggcaacagaacaagaccccatctcaaaaacaaacaaatttttaaaaaataaaaataaagagtatgtagtttaatttccatgtatttgtgaattttacagatttccctctgctatttatttctagtttcatctcattgtgatccgaaaagatactttctataatttcagtcctttgaaatggtttaggacctgttttgtggcctaatgtatggtctatcctggagaatgttgcatgtgtgcttaagaaaaatgtattttctgctgaagtcctctatttccttattaatcttctttttggttgaacaacctgatttttaaaaacaggaaaactaaaacagatactaagatacatgaagtaatttgttttaaatcaggccatgtccatcatgacaccaaataatcttcctatatcaaaatatatatttgaacttttaaagcaactttttcaagagctgtcatatgtggtcatacaggttctgcactgctcaacataaatgtgtgcaaatgctttaacttctaactggcagtagccaccattttataactctgaagtaattgaaagacagaatgagattccccttgcaaaacacagcctgtatcctttcagaggttttttgtgtttgtgtgccccctctcccacgaatgcatgaaatgcaaattaaacaacaggtgttttctctcagtccacagggcatctgggaggacttaggacagtgggtgatgtaaggagaggactcctgaatcagtctggcatctctactaactagagatcaaatagataggcctgaaaggctcacagcaaaaatcagataccagccacaaggtttcccactcaagacctcagccagaaggaaaagctgcagatcaggcacacactatagacctgtactgcagtgccttgatcagtcactacccccagcagcagcactgacttcatgtatgccttcctttctcttagtgtcttattaagagcctggctgaagccctaggaaggtcaacaccccatcttccaccttgcaccatctttgtttaagatctcatcttgttaatagtgtagagataatttaatgtgcataccagtccattatctgcccattacctacttcccctttccctaactaatatctgagaaaagctgattttgtgcctgcttgactcagacatgaagtccattctgccctcattgtgtttcaactcagagatgaaaagtccatacagacctactgtgtatacgagttggtttagatttctgatgaagtatataatgcaagcaatagactgtgaatgcagcatttattgcactccatggaaaatgcagtgactatgctggttcactgctgacagaatattccacaaggacaattactactttcttttatccaatgacaagaattatttaactcattaaatttttttttcactttggcttcttggaagctcagttaatattagcttagggttgtggtgtcacttttttttcttattctctgtcaatcatttactgagatatgtttctttatgattatctggttcaagtcttttctacaagtttatcattcagaataagcttaatggggactattggcctcagaatgatcacatgattgtcacagccattggaccacatatataacagcattgccaaatttttcagttccttgtattgtactaaccccaaaagtctgagacatgtataaacccagagtttttattgagaacttagacttggcttctttaatactatcaaagcacccctatacatatatttataaaagctgaaaataattgattctcatccattttctttttttttattattactgttggatttttttttattatactttaagttttagggtacatgtgcacaatgtgcaggttagttacatatgtatacatgtgccatgttgttgtgctgcacccagtaactcatcatttaacatcaggtatatctcccaatgctatccctaacccctccccgcaccctacaacaggccccaatgtgtgatgctccccttcctgtgtccatgtgttattgttcaattcccacctatgagtgagaacatgtggtatttggttttttgtccttgcgatagtttgctgagaatgatggtttccagtttcatccatgtccctgcaaaggacatgaactcatcattttttatggctgcatagtattccatggtgtatatgtgccacattttcttaatccagtctatccttgttggacatttgggttggttccaagtctttgctattgtgaataatgccgcaataaacatacgtgtgcatgtgtctttatagcggcatgatttataatcctttgggtatatacccagtaatgggatgactgagtcaaatggtatttctagttctagatccctgaggaattgccatactgacttccacaatggttgaactagtttacagtcccaccaacagtgtaaaagtgttcctatttctgcacgattctcatccattttcaaagatttagaaagagccttgaatgtggaattggtcatttccatttaaaagtctctgtcttgagaaattactgttcttttattgctagctagcatacaaattcctaattgaaaaacctttacaagcagtgatggcatgaattgaacttacttctgtcctattagggacatgtcttggtcaggaaaggaatgcacgttggattcttaatgatttgtgttttatacggtctgtcctcaagggctatttcagtccccaggatgctaataagcagtccctgatccaggtcatttgtatttttttatcagcaaaaacagcatccaagccatacctcaatttagaacatctctaaattcaattctgttcaattcaatacaacttatcaaataattatcaattgtgctaggcattttctgtttctggaagtgcagcaatgaatagatctcagtccctaccctcatgaatgccacaaaagagaaagactgacaagtagcttgacaattaagtcacacagaggagaagcttctttctggccaccagtggggagaggacaggataggtttctcaaaggagatggctcaagcaagcatcacagacttgtcagcctggaaggatgatggagactagacccagatacagttcagagaacacaagaggttcaagagagaaggaggtggaggccctgagcattcccaggggctagtctggggcaacccaaggtgggcattcagtaagtgtttactgaattgaacaactgagtataaagaaatcagaaaagaacacaacagtgtgaaaatgaatggagtcatcgctgcttattcatcagggtcaccgaactcaggctacagactgcctgggacaggggattcgtgtactgacttgactttgaggtgagtcttagtataaagcaaccctccatttttccaatgaaaggagaacatataaaacagttttgaagccaacttaagtatataaacttttggaactggagatgaaatagctgaatgtcaatgtatactatttaattcattatcttagtcacaaatacgaatcaaataatatatggattgaaaaagtttacttctttccttcatcatcatttttcagtcttctagaaggcatagttggggagcactgcctctgtcctccgctgcctgttgaatacgtagcactgctctgaacaggtgtgtgaggcacctactagagacaacacctgaccaaggttctttcttgccatttatgatcttcagaactactcactatgttgctttaagaggttgatttgtaagatccaaaacttaattgtgaactcatacttccaggaatgcttcttaaactgaattaaatttctgtacttcctttttcatttccatcttgtcctttgtttcactggttctgtcagtaaatttctataatcagcccaaacatgcaatgatttaggtcacttcaaatatgtaggccttcccaaacagaattttgttatttaaaaaatacagtaattatcagagcacctcaaaatttggcaggtctgctaaaaggtgactcctgttcctaggagtgtgtatggggaagaatctctctataatcatccatgacaaatatggaagtaatttacattagctggtgaaaggcttatttatctctaaaaataaggttatactagaaaagattggctggactggctttggtactcctgaacctggaagctggctatcacacgccaagtttctaaaggctgccaaagtgccagccatttcatcctctaagaaccctagactagagggatccttaataggtctgatcatctgttctttcggcaagaaaggcatctctcacagccagcgcttttctaaaagaaagttcatagtgctcctggttaaccaagactgtgaggttctttcctttgggctttgttttctgaatgatggaggtaatacctagtatttgtaaaactctacactttacaaagcacttccacagcctctctctcccctactcccagcacagtccttggagttaagagcagaacctacttgggcttcaggtgacacacccacacccagcaggcagaatggcccctgtgtctcccctcccaggggcaggagagacacccacaggctgagtcctcagggaaggtcaatactgcaagaaggccaggcagaaggcctaggtggcagagaggatggaaagggacaaaacggcttcctgagccaggatcccaggagtcctccaggtgggcaaaggagtccttcaggtggagaaaggagaccctgagaccaggagagagaggaagggggtctccaggcagaaggtggacgagaagcgggaaggcgcaattctggaaggacttggtatgtcatttatcttgtggggacataaatagggagtccttgaagggttttcagctggggagatatttgatcagatttccatcatagacagttcattttaattacaaactaaaaaccccacgggagggagaggggttaccaggaggacagataggaggcttcatctgatggagtcctaaactcagggatgggcagatgggaatgaagaggagtccactctcccaaagccctgcagggccccagtgtgaccccctcccaccccacatctgatcctaaatcctaaactgtgtcagctgagatcaagctgctgctccggaaaaagagcagcaagttactctcctctccaaggtgatcttcatcatattattagatgctctcatagtctgtcttccccaggaaaaactttttcctttttcaaaagccctgagcatctcccagagacagcatgtaaaggagcatgccaagtgatgccctaagagttgcaggagcaatggcccaggtcccgtgccctgcgatgagaagggtgactgagaaggctgggccacttctgagcccttggggtcctcacacggtgggctttctcccagccagtccaaccattagagcagagaatgctacccatccatgtcctcagggtattgagttgttttttgtaaatcacctagaaaggcactgctgggcttgaaagcacaatttattgctgcattattaaatggtcccagcagcaagccacgttctttttattgacagagtaaaaatgaagcaacccagggggtgggacgctggaaaataggacagaagccgtggttccagtcccttcccaccccagacacacagaaaaagtccttttcctgctccccctgaaccccgcaggccaaggaaccaattctatattcaagatccttagagaaagctactgtgtgtaaaaggtgaggtatttttaaagggcatcaatttctgccagaaattatttgcggaatgaagccaggaaacataagcaatcaaaagcagacaaaggaagtgtccgttgaggtcccaggacctcagaagggtttggacaggcattccctctaccttctgccttcccccaaccagccccttgcccccaagtccttccctttctgcctccttttcagcatcgggaggaacccccacatatagggaccctatattatgagctgggccatgccctcctttcttgtacacaattcaggaaaatcctgaggaaggaagccactaaaacctgcttctgtctcagatttctctgcaaatcctggaacagcttcgacttcgcccttccttttttccaacaaagtggactctattgcataggcctttaagccaataatattaagtacacattctgcacaggtaaataatggccagtatttttcctcatactttgagctgatttttgaaaatattatcctgtcaaaagcatttcttttatatctctaaggaagaaaaaaatatttattctgtagctcgtaccttttattgtattctttctctgtcatgctattctattcaaaccaacatcctccaataaaatttccttcaatcccggggcattgaaatgctccagagggggagtggagtggggagggcaaaactgcaagcaaagctaggattcagaatgaccaattatatttatagagaagcttttctgttcataaagtgctctaacagacacatggtgtcactgattctcactcactcaaatccatgaaaaatgggtgaagtcaagtgactcacccagaggcacgcagctccagaagtgacctctgcatcctctagagctccacagaaattgcttccccaccctcactgccatcttcacccaagtattgagataactcccgcctctgtctggagggtccccttccctctggcacactctgcccactcagggatcgtacacgcaccttgccacgtggctgccaaaggtgcaactgcctcaggtgccactgcctcaggatgatacctgagtccctttgtctgggatatcatgaccacagcctcctgcctcctctggccagccctcctcagccctgcctcagacacacccaggccagcctcagccacacctgcaagctttggcctgtgcccatctcttcttgagcttcctttcccctcctggaccaagccttagtacacgggttctctcttctctacactgctcactatgctgtaaatatgtatgttgcaaatatatgtctgtcttccatactgatttttcagttcctctagggaacgatgtttgtgtctttagtgcctggcacttagtaggtgttcaataaacatttatgagaggaaagaattgagagagggatggagagaggaggaaaaagtggggaggatatgagtctgggccttctgagtgcaacccacaggtcactggaacacagctaccaatacacccctccatggatgggcacgccagtgtgttctctctggggtctctccttgagaaactctcccaccacaggtgttctttctgccttcctctctacctggtaggcagagactcgtttaagcagactcccagctctcctaccagaaaagggcttcaggtctcaaggttcacaaatgcaaatattggtgccaccttgtgtgatcatgaacatcccacaccagcaccgcctctacttgtgccacctaccccaacacctactgccaaagcatatcttgtgctccttagtttcattcaccctggtcccagtgtgaggcagtgtgagtgtcaccatttctcatcttctgggcccccttccaagtccacgaagcatgaataactctgaatgtgggtgagtggatagtagttctccttagaattcacacttgattacagaccccagggatgcagactcactctcccagggatgcactcattacacattcccctaaataggccagtaactgtcaatattagtgatgcttgcggatgttttgtggcatgtgggccatcgaattcacatgcatggcagactacaaaggcaccttagggacatctaggaaggagaacagctaaatttccatctcagaggctttggccagcatggtcaggggtgaggctgggtagaagagctgcccttcccacaaataggggcagaatgaagcacccagaggaccagcctgaacctatcatgcctgttcactctgcaagtgcttgcctgctgtcctggaaataatcaggaagtgtatcgagatgtggcatctgcggtccttaacagatacccacaggtggaaagagtcccttttcaagaggtttattcatgtccatactccaccttgtgtataggaggtactgacaccaggaggttccataggtttgtttggttgtttggctggccaccgtgcctctgggctttcatgcagacagcaccacctatgcccatactgtaaccatctaaaaaagtttctttgagttaccaggtttcacaattggcctaaaatgtttccatgcatataggaaaaagtgtaaggacttcgaagtcagaaaaatgtgggtgtaaatcctgcttctgttacatgttagaaatgtgtccaccagtgaaatgagtgaggggccaggaaactgaggcccatgggccacatccagcccacctcctattttttcatctgtttaggtatttatggctgtgttctctcaataacagccaagccaaatgcttgtgacagagacccatatggctgacaaagcccaaaatatatatctgggcctctacagaaaaagtgtgccacccctgggtaagattatttcacttctctaatcctcagttttttcatctgtaaaatggacaaaaaatttacattgaagaagtagtgctgtgagaaataaatgagaaaaagtcagacacatagcaatgcttgcttgctacatgctgggattctttttttttttttttttttttgagaaggagtctcactcactcttgtcacccaggctggagtgcagtggcatgatcttggctcactgcaacctccgcctcctaggttcaagtgatgctcctgcctcagcctcccgagtagctgggattacaggcatgtgccatcatgccaggctaatttttgtatttttaatagagacggggtttcaccacgttggccagactggtctcgaactcctgacctcaagtgatccgcccgcctcggcctcccaaagcatgctgggatcattaaatgcagattaaccttgctgttttctagccatgtcattcatggacaggtaagaaagggacacagcttgtcttcctgtctccatccgtgtttccctcttcatttctcgcctgcccctgaaagtagaaaagcaacaaaaaaacaaacaaaaaaatcattcagtgtctttttttttaaacgtgggatggaaaataaacttaccctaaacaaaaacttaattctattgggcatctcaggttacttattgtatcatcattttatttttagtgtaaaattaatcacgcaatatgtagtactgaacaaagaagagggccttcttgctttctcccatttacagaatttttttctcagagaaagtattgtttagatagtttcaaattcccacacttaaaatatttgtcttcttgagaaattttaataaaaaactaaattttataatggaatggagctatgtgagattatctgagatatgttttcccaaccagaaggaaataatcttccatatttgtcaagaaggaggagagacactttgcttctcccaacaacttcctccaactctttttatattaaaactttttttaatttcaattcgttgttttccttatcatctcctcagcagactcacaatttgccttgcaaagaagtagaaatcctccaaatggattaccaaaagaaagtatatccctaccaaaactaaacatattaaagcatttaaatatttttaatcagaactattacaaggtttaaaacagagataaaatggcttcagtgcagggatactgagaaagccctagacccggtggagcttgtattaccttccttcccttcactgcactcagcaaagatctgagcatagaggttgtcgtgtttttttttcaattattaccttccttcaactaggttaattagctatgattccagccaagaggttctactgcttttatacttgtaactaaaagacaatctctaaacacactgcagaaatgggaaaccattctggctctggatattcattttgtgacctgctactcttagatcacatgattcaactcaagtatggaactgtctttcctcaggcaaaaatccaagaagactaggaggcctcttttagatcagaaagtgcaaagaggagaaaagcatggctttcctcccaggtgcttgtgcctctgatccattttgtgaaaagaatccaaaattgatcctttggccttggcaccaatatggttgctacagtcctacaggaattagtgtgaggcaaacctattagggagcagttgcctaaagagggggcaagagttaaagacctccaggtcctccacagcctgccatgtaccccgtgagtgtgaactgtgggagatttgagatgtccctgcacttgtaagtctcatgctctggttgttggtgaaggtaaccataccaatccattgtggtggatggagctttggaagcaggacttctgatgcctgttctcattgctaattacatgagtgtgggcaagtcatttaacctctctttggttctgtttgcctgtttgcaaaaaacaatacttgcctcaaagtgttcttatgacacttatattgcacaaaggctgtagttgcctaacatatcactgtgcacaaagcaagggcccaacaaatgcttgttccttcttaatttgtctatgattatgagcctcatatgcactaaagaaactataaaatttcttgactgcaagaaatcaatattatactgccatctaaaattcagtattgtgtttgttagttggttggtttacttagaaattatgcctttaggtgaaaaaattatggtgagagtgtgaggagaagatatatgtgtaatgaatggtcatgtgatcatctcacctctatagtagggttatgttgtaaatcatccattcttaaaactacttgtgagaagatactttaaatttcctctaaaaaatgttgaaatcaacagaaaggacgaagaaatggggagagaaaaagggaagtcaagatgtttgcaatgatgttgggaagacagggaaatgatatgagaaaagctactgtatggcaaatgtactcattcattaaaaagtcaaaaaaacaacagatgttgacaaggatgtggagaaaagggaatgcttatacactgttggtgggaatgtaaatcagtacaacctttatggaaaacagtatggagatttctcaaagaactaaaattagaactatcattccatccagcattctcactactgggtacatacccaaagggaaggaaatgattatactgaaaagacacctgcacttgtatgttgatcgtggcactatacacaatagcaaaaatatggagtcagcctaagtgtccatcaaaggaggattggattaaaaaaaatatggtacatgtacaccatggaaataccatgcaggcataaaaaagactgaaatcatgtttttttgcagcaacatagatggaactgggagccactatcctaagtgaaataactcagaaagaggaggtcaaataccgcatgttctcactcacaagtgggagctaaacaatgggtacatgtggacatatggagtggaataatagacattggagactccaaaaggtgggagagtggaggggggtgagggctgaaaaattacctctcaggcacaatgtttactatttgagtgatgggtacacatagaagcccagactttaccacaatacaacataggcatgcaagaaatctgtacttgtgctctgtcgatatatacaaatgaaaaaattaaagtttttttttaaatgacaggggaaaatgcactaatttaggaagttaataggcaagcagagagacaggtgctggggataccgtggtgagccacaggctgcacaccctccctcctggagtcacatccgtcagtacccacgcagatacagagctacagcagtcatgccaaggtatgttaggaccaatgcagggtgttaggggctagaaaaggtttcccaaaggaatgaatgatgcttcaactgaaaattgaggaatgagtgggaattcattggagagagaggcttttcaagggcgagcacagcattttctatctgtgggaagagaatgcggctttacgtagcatttgagaaacggagagatggcagtgtggctggagcacagagaggcaggtacaagacaaggcaggagagctccggtgggcccagagagctgccaggtcgggccttccaagctgtcctgagagagtcccagccatcagcacagctgttctgactctggaaataaagagaaagaagtcaatgagagccctttagttgattccgtatgaaggatgcatttgttgttttattctctctgcttttttgtatgtttgtaaatgttcatgatagtaaatttttaagttagaacaaaaaaaaagagcccttctcaccagctgcaatttggttgtgaatgtgggccagtgaccagaagtttctctgagagtgcaaactttggcttgcctgtcacaggggaaggttatggcctccttagagagaaagaaaaagacaggctcattctcttcgtggaagaatcaaagaattcgagcacttggttaatttactgagcctcttccatctagagaattaggctgtacatcctacgaagcgtgctctggggatttccacgaattcttgtttacacccagaccacaaacaacacaacaggagttcagattttattacacagtgatttggcatttgcagctgaaactgaaattgcaaagaagcagaagagaggaacaataaagaaccatgcaaatcttttgaacacttcactctctctgtggttctggctctacatttggaatactctttctttttttccttccgtccttccttcttttccctctaagtgtcaattctgaatatatgttaagcactttgcaatgctcaaggggacagaaagataaacaagtatttatccccgcctaaaagaccctctgtagtgagaaatacactaattaaacaagcacaaaatgaagcataattataaagtgggatccatgctcttaaggaacaggaattgtgttctttccacgagaaagcaaatgttgtcacctacagccagattgcttccaggtatttcatcgtaggcccgtggggtttcaggtctcacagtcagacacacagttctggggctcagaaaggctgggagtccagatgggcatttgctgtctgctggattcaagacatggagtgactgaggtcacccagaaaaaggctgagaagggaagagaactgaggactgcatcccaagcaatgccagtagctaaaggacaaccagaccaaaatggggcaacaagaaacaacaggagggaaaacaggagacacgtctgaaataaagaagaggagagagaaaaaaatcacaccaatggtgtttcttgggttaaaggaggcttgttacatgtttgtaagatctggggaaggcgctcttatagaggaggagatggaatccagagaaaggcaggttaactgttagcgcccttgtttaggaagtaggagagttcgctttggagaaggacaattttcacccaagataaatgggaggcaggagagagggaagataacctctcaaagtgagaatcaatttcttttctataaaataagattattgcactaggtaagctctaaggtcttatcacctattttcacattttaagagataatatataatcccttttagtcccctgtagctgtttttatagcttgatcttagaagcaagttttcatgagtgatatactattcattattttgaaagaaaagactgacagacccattatatattttttcctggggccactgaaggaatcgtcatattttagtatgatgatcctgaaaaaatacattgttcaatgtcacttatatattcctgcctagcaatgtaaccatgaagaagcagcaggtaaacccaaaattaggaacacctttttttttctttttttcttattttcaagtactatactcttcaaacaatgtcagtgtcataaagtcaaagaaagtatttggaaataatccagattaaagaaaactgaattaatacaacagccaaatgtagtacctgattctagacttgatcctgtataggggagaaaaattttggaatggacattgttaatgtcaattggtgaaactagaatactgatagtggatttttttaaagtactgtgtcaatgttaaattgattgaagttgataactttatgtggttatgtaagagaatgcccctattcataggaaataaacactggcatattttaggataaaggaccataatgtatgcatttaatcgcaaatgggtgagagagagagacagagacagagagagggcaatgataaagtcagttgacaattagggcaaatgaaatatagatgttcaatataatatttctagtcttataatttttctgtaagtttgaaattattttcaaataacaacttaaaatacacattaatagctaaaggagtgctcagagtcctgtgttccagcactgtgccactgcatatcagaagctccagagaactctaagaataaggccatgccttgctgaggaagtctgtcttggcattggaaaaaactgagctcgtattatttgtataaagagcaaaagaactaagtgttctgtggcagttgtgaatttgtgaagttgtaagggtcttaacttgtatatgaccccatattttctgttcagcatatatttgtcttataaaaatcaattgttaaacagaagaaaaagtaaataataatcaaaggaagccccagcacggtggctcacgcctaaaatcctagcactttgggaggccaaggcaggaggatcacttgaagcaaggagttcgagaccagcctgaccaacatggtgaaaccccctctctactaaaaatacaaaacttagccaggcgtggtggcacatgcctatggtcccagctactcaggaggctggggcatgaggatgggttgaacccaggaggtgacggctacagtaagctgagatcgtgccactgcactccagccagagtgagactctgtctcaaaaaatcatcatcatcatcatcaacaaaggaagaagagaaattctcattgctaaagcagagaattcataaagagggtatcacagggacatgaaatttccctttggtatagattttttaaattgtaagatatagagagagcaaagctgatagaaagccttcatttttctacggctacagtatcatcttaacaagttcctggagtgtcaaacgcaggctgaattactcttttaggacacgcaataaaaggggtagagattacagggtaatttgaaggaggctaatgtttctattcttttaaatctgacaacagatcatatcatcatttcatgatactgtgtacttaaagttttcttactattttttcactgctttggaaagcagccttaagtaacgtcttcctgtgcaaactggtagaaccattctgaccaccccgttaacaaccccgctttggttggcgcgagcctgaccggcggtgcagttatcttcctgaaggcggcgctgtgccccagctgtgctgaaggaggccggcgtgaaggaaggggaggggcgttcccgggcagaaacccagctgggcgccgcgtttaaaagcacaaagggagcatagtctagtgagaagctacacgtttgcaagtggtacacataagaagagagatatgagcggcttctatgccctacaaaagcgtcgaaattaaaaaaggcacaatcttttgttcttaaatccccaagtgataataaagatgttcgcatagtcattatcccattaccttttatttcgcatttctctcaccttcttttgtcattttttaaactttttctccttccccctctttcactccagaatttgttttataattgatgtcgatgttttctgttgcttagaaattaaattatcagaaactcctttgtatactggtctctgacctataaatagcaccacagctgcctgtgacttacagcaattaaagatttttgtgctagccagaaaaagaaaagaaaagaaaaacctgaaggtcccagtgtagcatgtctagttgttctgctggctttattgggaggaaatatgagaaatggctcttagaaaatattttccttatcaataattgttctttggagttcaccttactcaacgaggatgtatcagaaataattattggggttgaatgtatttcctgtcaattagtgtggtctttttccacaagagtactttcttttcatttttcaaggatcatagacaacagctcttccctataaaaatatttttgaataaaaagtaccatttccattataagatcttggcaatcaacatatcttctattatatccaaaagaagagaaaggctttaatggggcctggttatgattaataatagatttggtgaagaaaaagccagccagactttaaaatagatgagaccattcttagtcttggtgagtcttggttcagctcattagggaagccagctgcgatgcagattggcataccatttctgtgacagaggaatttcccataagagctctctcctaaaggaggccagtgtgtttttaggtgagccctggccacatctggacgatagagatgaactgtgccatacaggaggtggaacaagagtagaggaaaacaatacaaatgacttttaacatttggaagcctacttttagagggaataccaaccaaatgggaccaataaaatgataaaataagaggagtgattgaaaaataatttcagcacaatctttaatctatgaagagctaagagatggaagacagggaacggacatgtcttcttttgtgggaaaggcaataaggaacagataaaggctgtaggaagagtgccagattgcactaggacaaactgtgcaccaggtatcacaagaaacattgccaaggatgttgtacacacaccttttatttttaagaatgcataaactgtcttttgtgaataaactaaatttaatcctgcttacaagcagaaagataaaccaggtagtccctaatttcttgtgatcacatatccccttcaatcatggaatcacaaagctgacagggagctttggagatcacacactttataaatgaggacacccattttgacaatagtccaaggtcatgagggtagtaagtggcaaagttgaagcaacaacccagttctgacagcctccggtccatggttattttcccacttcacaaaattacctccttagtccatttacaccaaatacagaaagttaaactccatcccatttccaggtctcacacccatgctgggtttgagtagcattcctattagcttcatgacttctccatatgggtgagccttagagaagacagatacgaggatccccatctgagttaaaacccaaagaaaatcctggcttacatggtgaaaccccgtctctactaaaaatataaaaaattagccaggcatggtagtgggcgcctgtagtcccagctactggggaggctgaggcaggagaatggcgtgaacccaggaggcggagcttgcagtgagcagagatggtgccactgcactccagtctgggcaacagagcgagactctgtctcaaaaaaaaaaaaaaaaagaaattaagagtctttgctgaggtcaaagccagccttccccaagcccccagctctgtgtgacttccagggggcattgctgcaactgatttctgacacactgtcttcctgtttgcctttgtaggtttcacagcggcagcttccctcgtgtccctggcctgggccttggcctcctaccagaaggccctccgggactctcgagatgacaagaagcccatcagctacatggccgtcatcatccagttctgctggcacttcttcaccatcgccgccagggtcatcacgtttgccctctttgcctcggttttccagctgtactttgggatcttcatcgtccttcactggtgcatcatgaccttctggatcgtccactgtgagacagaattctgtatcaccaaatgggaagagattgtgttcgacatggtggtggggattatctatatcttcagttggttcaatgtcaaggaaggcaggacacgctgcaggctattcatttactattttgtgatccttttggaaaatacagccttgagtgccctctggtacctctacaaggctccccagattgcagacgcatttgccattccagcgctgtgtgtggtgttcagcagctttttaactggcgttgtttttatgctgatgtattatgccttctttcatcccaatggacccagattcgggcagtcaccaagttgtgcttgtgaggacccagccgctgccttcactttgcccccagacgtggccacaagcaccctacggtccatctccaacaaccgcagtgttgtcagcgaccgcgatcagaaattcgcagagcgggatgggtgtgtacctgtctttcaagtgaggcccactgccccatccaccccatcatctcgcccaccacggattgaagaatcagtcattaaaattgacttgttcaggaataggtacccagcatgggagagacatgttttggaccgaagcctccgaaaggctattttagcttttgaatgttccccatctcctccaaggctgcagtacaaagatgatgcccttattcaggagcggttggagtacgaaaccactttataaagcaaaaggagttgcaggacccacaacatccagatgaaggggtgacagcagggctgtggccataatgacacttcatcctagagcagggcagtgagccgtgaagttcctagtgggaccgtcatcaccattatcatttgatcctgtcggctgggggcggctggtctccttccaaagcagctgcacccgagagtctctgactccacctgaaagaatgacgctggcttaataggactctccattgctaccaaactcctcctgcacggtcttgggtgcacccaccagagggtactactattatggaaaaattttgcctccaatcattagggtgtcttgatggcgttaactgatctttccataaaaatagattcagtcatacacacatacacacactaacacacataagttacaccagtcctctgtcaaaaaagcttaggtgacttttcttgatgcaaagctctgattcccacaggaatataaaaacaaagaaagagggaaacatccctcgagaaaaaaaatagtattgcttagaaaagaaaccattttctcatttggaaatccataccatgtgtgaaaatcctatccaacggacagcaaacccaaatgttgtctacacatgtgttagcattgatggagtggttcattttctacacatttcaggatttgttttatattttaaattttcagttgcgaacatcctttttgacagaaatcctatgcagcccatgtacggctttcaacaagaccaaggagctcaataacttcatgatgtaaattaaatagtaatcatgattcagtattcaattgcaaaaatgtaacaggtacacaaagaggaagtggggaaaaaggcaaaatgagagtctgattcccaggcatgtgcagcgcccattgggacataacggcagtgcggcgcgagccagaggaatgggctggaaccggatctgtttccagacgcagaatgagtggctctgtgtgaccataggcagatgctgactctggaagactccgtgccactcctttctagtgccaaacaccatccaaccacaggactgacgtggaagccccaaacaactgagaatgagtggcatgagccccctaaaagcaggcgagagaacgagcaatcaagttctccactgtgtacagacttttcctccccccaatccaaggtcaaagtgatgtgtcttttagaggctttgggacactttttagtaagtatgagcagacaaatgcaatgaatatgctatgaaaaaacccttctgaactgagagagggcttatcactatatccagctaagatttgtatttgaatcatctgtaaagtcgcactcttacaacaagcttctgggttttaaatacctccgtacagcaagtaaacgttccccgctttctgttctcagtgtcctcggtcatggtgcttttcgttgcattaaaagtgccggtcaaactttgatagtatttttttatagttggtgcagagtggaataactcatggattatttcaatatttttgtaataaaaaatatagggtatacacataggcatcatcacattttttatagacctggaatcgtttaaaatactttaagcatcataattacttgggatgtcagaaactggtccacaaattccatcagcctgcctcagcagattgaaaacatttgtctcttgcaagatcaccctactttgcaagttggtgcccccaggaacctggccaggggtgctatcagaatatcaggtgaagagagaatcagcttaaatagaaagggcttgtcaagactggccaatgtttcccaggaaatcaaagatgtaaatgattactttcatccatccattataacaaacctgaccacagtggaagctgtcttaaacttccttccctggttttatattaacccaactgatagattaagtattagtcaaaccactaa

SEQ ID NO: 2467 - DNA, 82938 bp, Homo sapiens
cgagtcacgcgatttccgggaacccgtcaggaaggacataaacaaaacaaacccgaggcagcatggagaggggccgtggcccctgcagcggaaccggacccagtccctgagccgcccctacacccacaggtgagcgccgccacccgctgctcggaacccccaggggcctgggctgggggaagagcggaacggggggcggagggccgcttgcctaggaggcagcagcgctggggctctgggccgggccggcgcggggcgggggccgggaccacggccgagtgctagggcgcgcgggccttgggccaccgcctgcaggtcacgggggctccgctcccctcccccacccccggcccgggacggttacataaaagcgcggggcggcggtagatgggactcgcgggcgggcagtaggctaggccggggatgggcagcgccgggcgtccgtcctgccgggccgcccggcccttccccgctgcctccgagcccggggccgctgctgccggcagtcggcctgtcagagaagagagcgggtgggaggggcccgggaggggaggggaggcgagactggcgggggaggaggggagagaggggcgtgtgaggaagggccggggccgcggaggttggagccaggctggcaggagacgaagaggcgcgggctggggctaggggggtccgagcagggcgtctcgggggtagccgctcccccttctgtccccgcctcagaggcgacgggcgaggggcctccctcccgggatttgtttatatgtcttctcaaagcagcttgaagcggctgaggggcggagccctcagagctgagtggcaggctctggcgtccaatggagcgggcggatggagacttctgcaccaatgggcgtgggggaggcggtgccgcgggggggccactaattggttaggctgtgccggaggtgggccgggcggggcagccatgttagatgggaggggaccagtggtggtgggtcactgagaggggaggagacagggcaaagggcgagggagccgggccgggggtgtttcgggtgtccgaaggcgagtccgatcggaccaggaagtagctcaggggagcctgacctcgacccgcctttctcctcacacgagctgaggaggcagggaagtaccgagggcagtcaagcctcccctgggggtggttcctgggactagatggagctcagtctctggattctccctctttctcggccctatgcttcctgacagacctggccgccaaaccctgtaatcgccctcctttaacccaagaaagcaagtctttctgccgtttctgagctggcttgagccttaagactaccttaaggaggtacttggataaatagcggtctgaatttctgtaccaggcctcagataagagacaggcagtgaaggggaagttttgtaaaagaaaacgggactagaaaagccgagcaagttgagggctgggcggggtttctttttttttttttttctcatcaggatgccttttaaagattaggccccgtgcttgtcctagtcttagtagtaatttgcccctcttgctaacataagttggtagtccacattaatcagcttcttgagaaaactgagcccacaggaagttatttagtttcgaaggttctttgggacttttcttgcgaataccctgcaggtgaaaaataggatcaaggcctggaatttctttttttttttttaaagcagaaaacaagacttgggtgtaaatcttgtgatctgtcgtaaactagttgtcacttgattgtacttttaaatatctttaatcttttaatccaaaataggatatacaccagaggcagggaaaaatggtatgaataattcgaaaataacttattttaatctaattgtattatggttattttggcatccttttggccttgttaaatgcttaatttaggtttgtgtttacatcggattacaacctgtggctacgttggtattgtcaagggtaccaagctcttgatggcatctttggttaagtacttaggcgtaagaacatgccttagatagatcatgcaggggctaatcagagttagctgtattaagaatttgcattatcttctattttattagttggagaaaaagaataattggtaactgattcatcaattttttttttttttttaatttgagacggagtctcgctctgtcgcccaggctggagagcagtggccagatctcgactcactgcaagctccgcctcccgggttcacgccattctcctgcctcagcctccggagtagctgggactacaggcgcccgccatcacgcccggctaattttttttgtatttttagtagagacggggtttcaccatgttagccaggacggtctcgatctcctgacttcgtgatccgcccccctcggcctcccaaagtgctgggattacaggcgtgagccaccgcgcccagcctctttttttttttttttttttttttttttaagacggagtctccgtctgtcgcccaggctggagtgcaatggcacgatctcggctcactgcaacctccgcctgccgggttctagcaattctcctgcctcagcctcccgagtagctgcgactacaggcgcgtgccaccatgcctggctaattttttgtgtttttaatagagacggggtttcaccacgtgctggtcaggctggtctcgaacttctggctttaggtgatccacccacctcagcttccaaagttctgggattacaggtgtgagctactgcgcccggcctgattcatcaatttttgtagtactttggcatgactgactcagttctgttaataatgatacataaaaacgtaatccctgattatttgataaacttgaattcttacgtataacttttgcagtaaataagggtattagcttatttatcagttcttctttttcttttttttcttttttttttttttttgagacggagtttcgcccttgtcgcccaggctggagtgcagtgggaagatctcggctcactgcaatctccgcctcccgggttcaagcaattctcctgcctgagcctcctgagtagctgggattacaggcgcccaccaccacgcccggctaattttgtatttttagtagagacggggtttcaccatgttggccagactggtcttgaactcctgacctaaggtgatctgcctgccttggcctcccaaagtgctgggattacaggcgtgagccaccgcgcctggcctatcaattcttattttatcaggtggcattgtgttgcttttggaaccctagcccttacaatgccctaattagtttaacagagaagtatagtgaaaataaaaataaacacttttcattgatacttagaatattccaggcagttttcactgttgcatcggttgataaagtcaatcagcattgcttatataatgctctcttattctaagaatggcaaatagatgcaatagaacttatttgggtataattccttcatatgactggtatatcagctttgggttttttatattcataagcatagaagaggctaaatagctcccgaagagagtctggatgctccatttaccatcattctctgtcatggcaggtgaaagcaagcttttatatagacaatgttctacttagtttacagggtgtctacttagtttacagggtggatgtgtgtgggttctgggatactagtgtaagaagtaaaggaataactagcatggttcctggtggtggttaaatacaagtgacagtgaagtacagtaagtttgtgtgttgattctgttaatataactcagtttttaaaagataaagagaactgaaatcactgtttgcttttaaagcttaattttcagtcaagatcggcatctatatatttatttaaaaaatacatatatatatatatgtttttttttttttttgagacggagtctaactgcgttgcccaggttggagtccggtggcgtgatcctggcgcactgcaacctccgtttcctgggttcaagcgattatcctgccccagcctcccgagtagctaggattacaggcgtgcaccgctatgctcagctaatttttgtattttcagtagagacaaggtttcaccaagttggccaggctggtcttgaactcctaatcttaaatgatccgcccgcattggcctcccaaagagctgggattacaggtatgagccaccgtgccccctctagttatgtgattttgaaatgaattagcagtcgcttgtttccaagtagggttgaacttggatttttttgaggaacaattcactgacactttcaccatattcagtagctcatttcgggataggtaaactcttagacgagacataaatttgtcagataattggttctgattattttaagacaagggttgacagactttttttttttttttggaacaggatcaaatagttaatatttaggctttttcagccttccagtctctgccacaactactcaactttgaatctgtagcatggaaacagctgtagaaaatatgttctacatatttttgggctctattccaataaaactttatttacaaggtcaggctgtgcctctatttgtgcttccacggctatagtttgtcagcccctgttgtaagacatcagtcattgaggttttttgtttgttcgttttttgagacagagtctagttctgtcccccctgctggagtgcagtggcacgatctcggctcactgcaacctccgcctcccgggtttaagcgattctcctgcctcagccttctgagtagctgggattacaggcgcctgccaccgtgcccagccaagttttgtatttttagtagagacggggtttcactgtgttggccaggctggtctcaatctcctgacctcctgatctgcccgcctcagcctcccaacgtgctgggattacaggcgtgaaccaccacatctggcccagtcactgagttttaagtacttagatgttaaggtatttcagaatatacaaatagacactttaggtacatttgagcatttgcagattgtacagtctcctgccttgaagagaatttttagtacaagagcatatggcaacattgtattttgtatttttccttcgtttacatataaatgttttcttgaaaagctgtttaaagcaaatattggtataaatcctgttgattttagagatgcagtctgattgaaaaaactttggccctaagatatattcaggatatggtcctcttgaagtttcaaagcacatttagcatataatccttaacaaagctgtatagctgtttcaagagatgatagtcacgtgaatagtcaacacatgtagttcttatattcaaatatgcagttaatttagaagttaagacattgagtgctcattgcctgagatgcttgaagaattaaagagagtaggatgctttttccaggcccaaaaagatacaggttacctcctctctttttccagggaaaatgtcaagtcgtgctaagtgcctagtgaagcagagatgccgtaatctaaaaatataactgggaaatactaaatttttttgataacttttgctttatttttaatgtaatatttcaccatttttgttgacttgaactggatttcaagtggaagcgtaaaagtttagaaaagagaatatattgacctttatgaactgagaaacatgtggcctgcaatcttgtttctagatctagctaacctagggtctgcctggatgactacagataatctcagtttattaatttgtagtggtagggattaatgatgttttccatctcacaaggggatactgggaaatttttagttactgtattcttaaagtcttgtactttgaatatgctaatatttcggtctgcttgaaaccacttctcaaatctggattcgattttctcctggcttatttgtcttcccattaaactatgagctccttgaggtcagagtctgtgttttatttctatatattcactgcctcacactgtgcctgataccttttagtgctcttgaactgtttaaatgaatgcatgcattgctgagaactgcttatctggaaagtaataaagtctactattagagatgttgggcttttcttagttagaaaggaggaattaatcaccgtctgttcaaacaaaaagccttcattctaaaattgatccgttcttttaagaaagtttttagagaagctattttgatgatgtttaaaaatctctttagttcctttgttaatttgttttcagatgaactccattagttagacttgttgaatattccttgcaggtattaaaaaaaaaaagttgtgctttgttctttggatttgtcctatttggcaaatgtggatggaatctcttatttcatacaggtttgggataatttttcatctacatagtagggtctttttttaaggagggcactgtaaaatcattcttttttttttttttttttgagacggagtcttgctctgtcgcccaggctggagtgcagtggtgggatctcgcctcactgcaagctctgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggtgtgagccaccgcgcccagcctgtaaaatcattcttgctaataagtctgactcacctctgtggggtaggctaggatttggatcgagtttgacgcagggtgcggcagtagtatcaccagccaagccttatatgcatttcaccaatttatgacctttcctccaaaatctatattgtaactctccttcctaaacagctttctaaactactgctttccgtacttaactcttggcaacataaatcatcctacactctgtcctttcaacaccaaaaccacttttatatcttttgggtattactgattttgagaatttcctatgaaagcctcacaaatttcctgatttcttcttctctattttttttgagacagagtctcacgctgttgcccacgctggagtgcagtggcgccatctcggctcactgcaacctctgcctcctgggttcaagcgattttcctgtctcagcctcctgagtagctggtattacaggagcacgtcaccacactcagctaattttttgtatttttagtagaggtggggtttcgccatgttggccaggctggtcttgaactcctgacctcaggtgatccacctgccttggcctctcaaagtgctgggattacaggcgtgagccaccacacctggcctgctgatttctttttcttaatttttaatttcttgattaaaaagaatttttgttctttttgactttttttttttgaggcgagtcttgctctgtcacccaggctggagtgcagtggtgtaatctctgcccctgcgaccttcgcatcctgggttcaagcaattctcctgcctcagcctcccaagtagctgggactacaggcacctgccaccatgcccggctaatttttatatttttagtagagacagagtttcaccatgttggccaggctggtcttgaactcctgacctcaagcgatctgcctgccttggcctcccaaagtgctgggattacaggcgtgagccaatgcactggcctaaagttttttttcttaaagactagtgtgatagtaaagcttgctgttttttttgtcctccagtttttttttagattcttgttgtacatatgttttcttcagtataatattttgtcctgagggtttgaggtgctccttttataaaagcagtttcttttttggctgctgatggaattgctgccttttctattataggttagtcatttactgagaaatttaaagcattacaaaaataaaacgttgatatggggaggaattaggggtagggtgggtgtacttttgaaaagattcattgtagaattccttaaaacagcaaggcttctagcatcctagtggtatggtataaatgaggtggactcatgcagtttttgttgttgttgtttgagacaggtcttgctctgtcacccaggctgaagtgcaggggcacgatcacggctcactgcagccttgactttccaggctcaagcagtcctcctgcctcagcctcctgagcctcctgactatctgggactacaggtgcgcaccaccacacctggttaattttttttttttttttttttttttgagacagagtctcgctctgtcgcccaggcggagtgcaatggcacaatctcggcttactgcaacctccacctcccgggttcaagcgattctcctgcctcagccttccaagtagctgggattacagggatgtgccaccatgcccagctaattttgtatttttagtagagtcgaggtttctccatgttggtcaggctggtcttgaactccccaccccaggtgatctgcctgccttggcctcccaaagtgctgggattacaggtgtgagccactgcgcctggcccacctggctaatttaaaaaattatttgtagagagagagttttactatgtttcccaggctggtcttgaactcctgaactcaagtgaccctcctgcctcagcctcccaaagtgttggggttacaggtgtgagccactgtacctagctgtacagtttttgaactgctttttagtaaggttttcatctttacctttgaatcctctactagagttgcccatagactaggagaggagacacacattgcagcccaatgttacgatggtttttcagaacaaaatgttctgaaatatggaagaaggactgctaactctgcctggggaaagttgaatattcattgaaaaagtggtgtttgaacttagttttgaagattagtgaaggaggcattctagtacagctgaagtataaaagatgtgtagtgtggggttgggtatgagatggtttgagctaaggcagaggtgggagggagaatggaagaggaggaaactgatgtgtaagatttaggaggaaatagctttttttgctttcactttgtcctctaattctcttcagtctgttctatgctgtcaggtctccagtctcttttccctgtagctccctgtacctctgactttggttgattggttttttcccctagtgttccatttttcttttagtcccaccttttctaatgtgttggtactaaagtacctttcattctgactctatttgtctcttgcgtttatttcacctcccaccctccctccctctctctctttattccctttgggttatatttctttccttttcttttcctttttcttcttcttctttttttttttttttaaagacaggatggtgcagtggcacagtcatggttcactgcagccttgacctggggctcaagtgatcctcccacctcagcctcacgagtagctgagactacaggtgtgtgccaccatgcccagctaattttttttgtagagacagggtttccccacattgcccaggctggtcttaaactccagggctcaagccacccacccaccttggcgtcccaaaatgtgcgattacaggcgtgaccaaccgcacctggcccctttgggtttctctttgcccctacctttcctttttatttgctttattttattttttattttttttgagatggggttttgctgtgttgcccaagctggcctcaaactcccggtgtcaaacaatcccatctcagcctcctgagtagctcaggctgcaggcgtgtgccacctctcattatcttttatttaaaagcaaaacaaaataaattcttgcgcactatctgcttattttacatgtaaatagcaaaataagctgattccctcttgggaaatcttgtaagatcaactagcttttgatacctgttcaaagactaattatccatttctgtgaatttctttttatgaaacattttcctttgtattcaaagatgctacttcttcaaaggccacagtgtagaatgtgactgcctatgtgccctgttttctatttcttatgcacctacaaattgtttgataacaaagtccaattcacctttttcctaaagcttttccaaactttcccaggtagtagtattctcggtagttgtctattattttgtaaacacctctttttaaaattcagctttattgaattataatttatgtaaaagaaaattcaaccaattttgagttttgacaaacacatgctgtcgtctaaccactgttatatctctaacatttttatcaccacagaaagttcctcatgccccttttgttcagttctcctgcactcgcccttggctccagtcactgatttgctttgtatcactattgttttgtcttctctgaaatttcatataaatcttttggtagaatgtgttgtcttttgagtctgacttcttttagttaacattgattttgagatactcatattgtgtcgtatattcattgaatctttttttttttttttttttttttttgagacagggtctcattctgttgcccaggctgagtgcagtggcgtgataatggctcattgtatccttgacctcctgggctagagtgatcctccttcctcagcctcacgagtgtctgggactacaggtgccatcatcatgcctgattaatttttgattttttgcagagatggggttttgtcatgtttcccaggctcgtctggaacttttggttgcaagcagtcctcctgccttagcctcccaaagtactgggattacaggtgtgagccacctttctcagcctgagccaccgtgctcggcctgagcctttgtcattgtatggacataccacaatttatctgtttatcagtgggtagacatttgcattgcttccagattttaggctattataaataaaatggctttaaatattcatgtacaagtcttttagatatctcttttaacattcattacattttatttggaagttgagttgcagagctgtcaagactgaacacccaacattcataaataggcattttgctagttctgtggttttgagcatctttcagcttagattcataatctgtaaaatgggactgggtggagattcaagcaagctagagagcacaggccaatttaaagaggatacctctttttagttcaagtgatcatctttctgggaatgtatacccaatgtcagatctaattttttcccccaaaagagtggtatttgagatcagacatcaaattttatatgaaatttcatgtgaaatttaaatactggtagttacaatttaaaaaacactaatgcaactgatttgcaactgaacacaactgatttgtgggcgttgatttctcactgcagtacagtttgagaccttggctttaaatcttcagttaattggccgggtgccgtggctcacacctgtaatcccagcactttgggaggctgaggcgggtggatcaagaagaggtcaggagatcgagaccatcttggctaacgcagtgaaaccccatctctactaaaaatacaaaaaataagccgggtgtggtggcgggcacctgtagtcccagctactcgggaggctgaggcaggagaatggtgtgaacccagaaggtggagcttgcagtgagccaagatcgctccactgcactccagcctgggcgacagagcgagactccacctcaaaaaaaaaaaatcttcagttaattttgtcttctgttttaaaatgtatatcctcccagtagagtgcacttgttaggtcctttttaccttagttttattagcataataacttgctggttgtcaaaattcccaagttaaaaactaacgagttactgtaaattttattcttttgtctgattggaaggatattaagaatactgactgcctgatggaggagtggaactaggttcaggttactctatgtacttctccttctctgatagctgctgattatattcagtgctatgttttctcagcagttggaataatctgcctcacttgtttgatttatctcaacacttttgagacaagtatggtataaactctgtgtgtctctttattagaaactatgcaaggtgttacagatatacatacaaattttatatgactctgtttcatatggctcagattgtccagagccatttggtgaagccagtataatgaactatgaaaaagtgataaattatatgtaattgtttgaacaataaagagcaataatctttctaaagaggccttttcccctttatctgccatttctttattgtgtatagagatgactagtttgcagctttatgaatgactttgtgagtccagagattcttttgctgattaaaccagcataattgacatacaccctcataaacctgggggcaagggtgttaagtgtcgtgtgttgcctgagtatcccatattcaccctggttctagcttggtggaatgtggaatttagacaatttaggattttgagtgggccaggcgcggtggctcacgcctgtaatcccagcactttgggaggccgaggcaggcgaattgcctgagctcaggagttcgagaccagcctgggcaacatggtgaaaccccatcagtactgaaaaaaaaaaaaaaattagctgagcgtggtggcgtgcacctgtagtcccagctactcaggaggctgaggcaggagaattgcttgaacctgggaggtggaggttgcagtgagctgagatcacgccactgcactccagcctgggcgacagagggagactccgtctcaaaaaacaaaaaaaaagaaaaggattctgagttgagtttggttttataccttaatagcagcaacatcccaggagtatcacataccaaggaatagatctgagaataaaaatagccaccatttattgagtgtctgttttgtgctagggctagatactttatatgttattttattgtgaatcacaatatccccacaaaataatggggaattcttgcatttatacataaagtaaggcagatgagagtctggaatgaaattcttttttttaaatatatttcttttttttttgagacagagtctcactcagttacccaggctggagtgcagtgccgcaatctctacctcccgggttcaagcaattcccccatctcagcctcctgaatacctgggattacatgtgcgccaccacacccagctaatttttgtattgttagtagagatggggtttcaccatgttggccaggctggtctcgaactcctggcctcaagtgatccacccagcttggcctcccaaagtgcagggattacaggcgtgagccaccatgcctggccatgaaattcaaaatattcactcacaatgcataaccttttacctagagtttgttcctcataaagcaagctttttaggaatgttagagccaaagtggcaccgagcttttctcagtgttaaaagagatgactgcaaaaccatgttcaaataacctctgtactggctattatgtagtttatgctggtggtatagcctgcttcacagtaggaaggaatttgaatatatctctagtatatttcatgctgcttttgaaaaggtgccaaatctgagaaaggaggaaggaaacaattttttttttttttgagacggaatctctcttgtagtctaggctggaatgcagtggcgtgatctcggcttactgtaatcccgagttcaagcgattctcatgcctcagcctcctgagcagctgggactacaggtgtgtgccaccacgcctaactaatttttgtcttttcagtagagatggtttcgccatgttggccaggctggtcttgaactcctgatctcaagtggtctgtctaccttggcctcccaaagtgctgggattataggcagtgaaccactgtaccttgcccctacagtaaattttgaagaagagttcaaatccttgctaacaacagcatcaaagttgttacagtgtgtgaagaatgtgtggtgtcactggaatcctgctgtgtgctccagtgcattctcacttgcaccactgcctgtttttatgccgctgccattaattgtactgttctctttttaacattttatagatttctgcagaacagcttagaaaacaaagtgattctttaaaactaaaatctttaacatcctgcataaaatattttgttttactatggtgagtttatcttcctgctttgtagtttaaaatattaaaataaaataatgacgagggagagaacaatataacatgcatcggtccagtgcctgaattcagttgatttaaattaaatttaattctacttcttcctctgtcctctcttccctagataataattacatcaggtctttaaaatggactaaaatttaaatatcactcttcttggaaattaaaaaaaattcaggagtacaatttttcatatttttactatatgatactacagtggttcaagactcaatttaacaaactaagatgctttggagcacataaacgatgctcaataaatatatattgaataattgacttttttgtaatgtcctcattgtgaagagcaccacacctttgattccttatccagaaggacatgtggtcttaggggattttcccattcattttcagccatctcttgtgtggatgactgctcggaagggcattgcatttggcactgtagtgaaatagatgtgagatatgatggtcattctcaaagatgtcacagtctggtagtggaagcaagggaataggagagaagatgaaaaatatgagctaagacatgaaggtcagtctcactactggaagttcttagtggagtaaagtgggattgtaactatcttgaggattaggggaaatggtaaaatcagtctaatattagacttaagagtagtggaagacagagttggaaagatagtgtcattgtgtatgagtatttttgtttgtttgtttgagatggagttttgcttttgttgcccaagctggagtgcagcgccatgatctcgcatcactgcaacctccgcctcctgggttcaaacgattctccttcgtcagccttctgaatagctgggattacaggtgtgagccaccacgcccagctaatttttctttttagtagagatggggtttcatcatgttggccaggctggtctcacactcctgacctcaggtgatccacccatcttggcctcccaaagtgcagggattacaggcatgagccaccgtgcccggccttgtttttgtttttttaagagactaggtctcactttgtgggccaggcttctctcaaactcctaggctcaagtgatcctcctgcctcagcctcccaaagtgctgggattacaggtatgagccacttgtgtctggcctaaggtctgagtagtttggacattatccaagaaatgtatgggagttgctgatgactttggagcacagtgttaatatgacgtgtggtaggttagaaagaataattttatcttatattaataattattttaggctgggcatggtggctcatgcctgtaattccagcactttgggaggccaaggcaggcgattgcttgagcccaggagttcgagaccagcctgggtaacatgttgaaaccctctctaaaaaaaaaatgcaataattagccaggcatggtggcatgtgcctgtattcccagctacttgggaggcagaagtgggagggctgcttgagcctggaaggtggaagttgcagtgagctgagatcactccacatcactccagtgtaggtgacagagcaagaccctgtctcaaaaaattattttaataattttcattaatttttaataattattaaatttaaaatttttcctttttttttaagagacagagtctcacactgttgcccaggctgaagtgcagtggcacaatcatagctcactacagtcttgaactcctgagctcaagccatcctcttgactcagcctcctgagtagctaggactataggcatgtgccaccatgcctaatttttttatccctttttttttttaagacagtgtcttgctctgtcgcccaggctggagtgcagtggcgcaatctgggctcactgcaagctctgcctcccgggttcatgccattctcctgcctcagcctcctgagtagctgtgactacaggcactggccaccacgcccggctaattttttttgtttattagtagagacgaggtttcaccgtgttagccaggatggtctccatctcctgacctcgtgatctgcctgccttggcctcctaaagtgctgggattacaggcgtgagtcactgtacctagctgcctggctgatttttactttttttttttttttttgtagagacagggtctcacaatgtttccaagaccagtctcaaactcctggcctcaattaatcctcctgcctcggcttcccaaagtgctaggattattggcataagaataattttaaaatggggcataagaactcaagagagggagaggaggatagagacaggaagactgtagggtaaatattagaatggtaaatataagatgatgaggaccaagtaagggttgaaaaagagggaagggcaaagtcaaacagatgcatttgtgctcagtacaaggtaagtgatctgtacatctttgttaaaaagaattggtatgattcaacaaaatgagtaggggaggagaatttaaagagtgaaggctgaaatcagccttctatccctgaaagtcagagagtgatagtattgacagaataggaatgtttggatggggagatggcatgttgtatctgcagtgatggaatgtgaacatggagatatccacatctcagatgatagagctcacgcatgcacatgtttaggttcaaaatgtagatttgcgagtcttttagaaatgatctctgaggcccaaagagtagagatagtctttgtaacaataggtttgcttggaggcatccatttactgaatgaccttggacaaatctcttacccttgctgtactttttatttattgatgtaaaaagggttggacagggactgggggatagtggttatcctgataccaagactatattacctagatgttttatcaaaatactggtccttgttacttcaccaagttgttttattaaatgacagggtttagaaatgtactttaatctgtaaacagctacacagatacatacaaactgaatattttgtccccagtggtaatcaaagttggctgggattagaaatgcattctctggttctgtctaaaattgttccatgctcttattcttgtgctctgaacaacttaattgacagataccaaggctgcagaaagcctccaataccttgcaattgatagttttcagaaataaaaagtagtccttcccattcaactcagattaatccagaaacttgctttaatagtctttttagggccgggcgcagtggcttacgcctgtaatcccagcactttgggaggccgaggcgggcggatcacgaggtcaggagatcgagaccatcctggctaatatggtgaaacaccgtctctactaaagatacaaaaaattagctgggcgtggtggtgggcgcctgtagtcccagctactcgggaagctgaggcaggagaattgcttgaacctgggaggcggaggttgtagtgagccgagattgcgccactgcgctccagcctggtgacagagcgagactccgtctaaaaaataaaaaataaaaataaataaataaataaataaataaatagttttctttttggccggttgcggtggctcatgcctgcaatcccatccctttgggaggctgaggcgggtagatcaccggagttcaggagtttgagaccaacgtgaccaacatggtgaaaacccacctctactaaaaatacaaaattagccgggtgttgtggcacatgcctgtaatcccactacttgggaggctgaggcaggagaatggcttgaaccctggaggtggaggttgcagtgagctgagatcacaccattgcactccagcctaggcaacaagagtgaaagtctgtctcaaaaaaaaaaaaaaaaggcttcttccttattggttcccaaagagctttgactaagctcccatatgttgtccctgtaacccaaagattaaagttggataggagcctttggaaaggaattgaacaaaattgtaactgagagttcttctgtcttcctctaacatggcattctaagaagagatcacttttgagatttagtatatcctctttgctttttaagattttcagtaaaaggtggttttattttgtttaattacattttttgtggcagacctaattcacctcccatattttattttttattttttaaaatttttatttatttttatttttttattttttgagacagagtctcactctgttgcccaggctggaatgcagtggcatgatctcagctcactgcaacctccacctctggggttcaagtgattctcctgtctcagctgcccaagtagctgggacggcaagtgtgcaccaccacgcctggctaatttttgtatttttagtagagggggtttcgccatgttggccaggctggtctcgaactcctgacctcacgtgatctgcctgcctcatcctcccaaagtgttgggattacaggcatgagccaccgtgcctggccacctcccatattttaaaaactctccgaatgtgaggataaaagactattacattgatcaggtatacagagtttgcaaggtggtatggcaaaaggatcacagattcttacaaggtcattataagtactgctttggctaggaaaatgatcttttttcacccaatctgagggaaaagatacactttcttccttactttcctcttttcccattgtccttccttaaagactagcagcagcagaatttggaaaataaataatgggcatgttttgctaataatcatgacaaactataataatctgttttgaattttacttgcctgtttctaaattttggagtctagagaactgctatcaaagggtaaaatatagtgattcacctgcagttttggttacaggtttcatattacataataaagggagaacttgagccccacctttcccccagtgtattccttgcataggcaacctctgctgcttaaatgttttggagactttgggatgtctgatttcaactgtaccgtgaaacaggtagtggcttgacttagtaagcatctgaaggactgttttgttctactcttgcagagtagagtagttttcaaaaggaaaggaaaggaattgttgagtgggacctatgaagtatagcaggatggatagaatatgaggcagatgggtcctagtttgctaaagagcttgggccatctgataagttgtctttcttgccaaacaagggagtcacgtggggtatacacattgtataagcttttcagtcaccgaggttgcctgtccttcctgcctccctgtttcgttgcctccttgcctcccttcctcacttcccttcctttcccacctccctgtccacaccccttccttcccctgcctctcttcgtttccctttccttcattctttcctgccctcctgcctacttccctgcctcctttcctttacctcttgtcttagtctattttctgttgctgtaaccacagattggataatggataattttaaagaaaagagatttatcgctgggcgtggtggcttatgcttcaaatcccagcattttgggaggccgaggcaggaggatcgcttgagcccatgaattcgagaccaacctgggcaacataataagaccccatctctacaaaaaaaaaaaaaaaaaaaaaagtaattaagtaaaagaaaagagatttatttggctcatgattctgaagactggaaagtccaagaacatgacactggcatctgttgagggtcatcccatagtaaaaggtgagaggatgagagcacgtgagacagaggaagttgagctgaattcattttttctatcaagagcccactcctgtgtccagtgataatgtcattgatacctacctcttaaagggtccaccttccaatactgttaggatggcatttaaatttcaaacatgttttggaggggacattcaaaccgtagcatcttccttgcctgtcttcctttctttcctttcttcctctttcaactttactgaggattaagtcttaggagaaatgatttatttaaattagaggtcatggccaggcatcagtgtctcgcacctgtaatcccaacactttaggaggacaagatgggtggatcacctgaggtcaggagtttgagaccagcctggccaacatggtgaaaaccggtctttactaaaaatacaaaaaaattagccaggcgtggtggtgctgcatgcctgtaatcccagctactcaggaggctgaggcacagcaatcgcttgaatccaggaggtggaggttgcagtgagctgagattgcaccactgcattccagcctgggggacacagtcagtctcaaaaaaaaaaaaaaaaaaagagagtgtttagaacagtttctgcctcttagaattgtggatctggaacagtttaaagacaacagagagaggaacaagacctctggtcacatgaaagaaatgagcatgaaccagcaaagattaggaaggatcaaagtagaccatagtatattaactacatagcagtataaatttattggcttttttttttttttgagacagtgtctcactctgtagcccaggctacagtgcagtggcacaatctcggctcactataacctctgcctcccaggttcaagcgattctcctgcctcagcctcctaagtaactgggattacaggcgcccgccaccatgtccagctaattttttgtatttttagtagagacggggtttcaccatattggccaggctagtctcgaactcctgaactcgactaattcgcctgccttggcttcccaaagtgctagaattacaggatgggccactgtgcctggcctgtattcaggcatttcttacctaaaaaacgtaaaaaaaattttttgtggtaaaatatacataaaatttactattttaatcatctttagctgtacaattttatggcattaagtacattgagaagtgttgtgtaaccatcaccactgtctattcctgaacacttttttttgagaccgagtttcactctgttgcccaggcttactgcagtggcatgatctcagcttactgcagcctctgcctcccaggttcaagcgattctcctgcctcagcctcccaagtagctgggactacagccgtgagccaccatgcctggctaatttttgtatttttagtagagacagggtttcaccatgttggccaggctggtcttgaattcctgacctcaagtgacccacctgcctcagcctctcaaaagtgctgggattacaggtgtgagctaccacccccagcctccagaacacttttatcatcccaaacagaaactatgtacacttattaaataaaaactatcccagcccttagtaacctccattttactctctttctctgttctaagcacctcataaagcctaatcatataatatttgtccttttgtgtctattttacttaccataatgtttttaaggttcattcttgttgtagtgtgtatcaggatttcattcattttcatggctgaataatattctgttgtatttgccatattttgttgatccattcatctgtttgtggacacttgagttgtgtttaccttttggcttttgtgcataatgctgccatgaacataagtgtagacatatctgtttgaggccctgcttttaactcttttaggtatatacctaggagtggaattgctagatcatatggtaattggatttcgctttttgaagaaataccaaaccgtttcccacaccagctgcaatcctaccagcaaatgcacaagggctctgatttctctatatccttgccaatatttgttattttccactttttggataatactcatcttaattggtgtgtcaaaaatgttttaacatttactgtgatgaatgttagatgattcggaagagctacttactgttgtgaggaaccagtttccttaagttactaaaagggggcttaagccagttccatataaaacaagagctgcagggattctggccatcatatacaacatctccttattcataaaatactctcatttacaaaaaggtttatgtatttattattattaatgtataataaatatatatttattattcgtaaaatactctcatttacaaagaggtttatatatttcttgatgtgaagtttttctttttctttttttttttttgagacggggtcttgctctgtggcccaggctggagagcagtggtgcgatctcggctcactgcaaactctgcctcccgggttcacaccattctcctgcctcagcctcccaaagtgctggtgagtatttttagtagagatggagttttgccatgttggccaggctggtcttgaactcctgacctcaagtgatccacctgccttagcctcccaaagtgctggggttacaggtgtgagccactgcgcccagccgaccctattgctagtaaggttaatttttcagattttaaagggtatcaaacttttctcccaaatccaggttttatgccaagattatactgatccactttattgaacacatgacttgaattagatgcctttagggaggcctaagtcataggtctagaaaaagtgactgaccttctttctcataggaatcaggggagagaattagggcaatgattatgactacataccagttgtaggacgacggcatgaggtcacataaggagagactgcacaagaacaggcctttggcaggaacagggagcaatctagttatactgtagcactgaattgaaaagcatagttaactgtttctaggtgggcacttgacattgtttcctaggttagaccagtgagctgggaacgacagcccactggaggggagagtgcagcaaagatccagaaaatgtgaattatagtcagtttattaatctaattaagtagaacaatgattgagtccctgggtgtggtgttgcttgcctgtaatctcagctacttgggaggctgaggcaggagaatcactggaacccaggaggttgaggttgcagtgagccaagattgggccactgcattccagcctgggtgacagagtgagactctgtcttttttaaaaaaaaaaaaaaaaaaggaaattaatacaatgtaccactgtaaccctctagcccagacaatgtgctgacttcagaaggcaaattcagtgtaaattgactgtttaccaatataagaagtgacactgcttctggactgaattagatcaaggataggacagtggttctcaaactttagagaggaccacaatcacctggagggcgtattaaaaaacattgctggtacccactcctagaggttctgttttgattcttcattttaaacaaatttttaggttgttgctgatgtagtactgctgatccttggatcatactttgagacccactgatcttggacaggaaaatgaagcgagtataactgtttagttcctcctggttaaagtcttcatggagaagggaaaaaacactaacatttaagtctgtaccctgtcaaaatcctgtgccagatgatttgtagtcattgttttacttaacccttgaaaccactctgcaaagcagtcctcaggcccgttttccctcaaacatacacctgttaaaaacttgctggaatgattctttcttcaatgagagcttatacttataactgaaagaataatgttggcatataccattacaaatgtgattttatttaatgtagaggatatgttaagttccattgctgactattatgtattcattactcttctgttgacttatgagagagataaaatgtagattaatttagcagtaatgattatacaatagatggaattaaattttgagatatgttttctcataaagaacataaaatgaatgagagcttgactttaaaaatcaatatattacatctttcagatcacagaaaaaataagcctatgttaattttgtgttttttttttttaatgttgccaattggttattgaccagctctattttagaaaaatataagaggaggaatggtaaatttcagaatagtaagtattaagatatgaccaaatccttgataactcaaccataagacttactcatttaaagtacagtattctctgctaatattatttttcaaaagtcaactttttttttgaaacatcaacttgtttttcctggaattcagtgaagttactttgtgttgtttgacagacagcatcgcacagaattattttaaaaaaaagcagtgatccaagcaattgaattggaagcactctggggaaacctgctgtttattgtggaaatcatcttcgatcttggaattgaaagtaaagctggaaaggaatttacaaacaagaaaaaaaagaagtttggaatcggattcacaggatctgggcttggaaatgcctcaggtaaatcatacagagtaggtgcaaagttttttattttcccactacagaaagtcaatacctttgactcttaaatgaatcttaacacaactttgcatactacctttttgtgatatctcatttctgatctcagctagttttgagtacatgttcttccttccattggcttctatttcttactttgctatcacttgaagtttaatgagttctacataggtagtatgataaataggtagaaggtggacagatctgctggctttatggggcaaaaccaactcccttgaaaattagtctgccacagcaatcccgtttctatctcctcactattcctatttcccaattcttacctttcatttatgctagctgaatttagaagtaattaagaggaaatagtgagagacttcaggctgcctcccccaacccctctcatctctctctttctcatagacacacacacatacctatgtgtgcacatgtaaatatctccccacaaaatatatctaagaatgattgtatctgtttatattatggcagctactctgaattgatcagttttggttttaggcaatcagtgagacaatcagtgaagccctgttagtccccattctgcttatctaaactcctccttttcttctccagtgtttagctcttgcccctcccctgtttgtttcagtgctggggagaaacctagaagtaatgagtgggcagggactcttgggtggctttttgtgttgccatactgagctatcccttgagcacagggaatcaacaatttgctgggattgtctggtgactcggagacaggcagaagaggtaaagaaaggggacttggtaatagatattgaaaagaccagcggccggctaggcacagtggctcacgcctgtaatcccagcactttgggaggccgagacaggcggatcacaggtcaggagatcaagaccagcctggcgaacattgtgaaaccctgtctttactaaaaatacaaaaactagctgagtgtggtggcacacacctgtaatcccagccacttgggaggctgagacaggagaattgcttgaacctgggagtgcaaagatcatgccattgcactccagcctggggacagagcaagctctgtctcaaaaaacaaacaaaaaagaacagctgcctaccgccaccccaacctctgtgacagatggactgcatatacccttttagagtggttgcccattcaaggtttagttttttttttttttttttttttttttttgagctggagtctcactctgttgcccaggctggagtgcagtggtgcaatcttggctcactgcaagctccacctcccgggttcacgccattctcctgcctcagcctcccaagtagctgggactacaggcgcctgccaccacgcctggctaattttttgtatttttagtggagacggggtttcaccgtgtcagccaggatggtcccgatctcctgacctcgtgatccacccgccttggcctcccaaagtgctgggattacaggcgtgagccaccgtgcctggccgaggtttagttttatatttattgagtacttgaatttggggcttaaattttaaacttattttctcaagctaactttttctaggaagaaaggttctgcaggctggaaaagtagggggaagataagagaaagaaaaaaaaataagatgggatgtaccaatgaagaaaaatacgatgagagggtctatgaaaagtccggtttgtgaaagatagaaagtatatgaaaagaataagcaaatagattaataccatttaaaaacatttctgcagaaacttgcaaaaaaaaaaaagaaaatactaaaaaagagaaatttttggccagttggcagtggctcatatctgtaatcccagaactttgggaggccaaggtgggcggatcacttgaggtcaggagtttgaaaccagcctgaccaacatggtgaaaccctgtctctactaaaaatacaaaaattaggccaggcgtggtggtgcgtacctgtagtcccagctactcagaaggctgaggcgggagaatcgcatgaaccctgcggggggaggttgcagtgagccaagatcacgccactgcactccagcctgagcgacggagcgagactctgtctcaaaaaaaaaaaaaaaaaaaaaaaaaaaaaaaaaaaaaaccgggtgcagtggcttgcacctgtaatcccagcactttgggaggctgagacaggctgatcacttgaggtcaggagttagaccagcctggccaacatatagtgaaaccccatctctactaaaaaatataaaaattagctggacgtggtggtgcctgcctgtagtcccagctacttgggaagctgaggcaggagaatcgcttgaacactggaggtggaggttgcagtgagctgagatcatgccaacagagcgagactctgtctctccaaaaaaaaataaataaataaaagaaattttttattctttctcattctctttcttcatctcagttagatttcaaattgaggcctttctattatttgacccactttaggagggtgagcccagacttgactctggcgggatttgtatagatgttaaaatgtaaaaagaagatagagaaaaaacaagaaggagaattaatgctgggtcccaagtcttttttttcccctttacttattatggaatggactgtgcccttttcaggaatcaggattaaggctacagagttcatgcccaagttactggtcttaccaaggagatttttgggtatttagttgattctgtttccattaccttcctgcaggcattggttgtactagacagtgatgcccaaattgtcttccagcttgctttggaaaataagacatgggactcagcagcacagagtgagagtgatttgctgtatctgcagaccctaggaaaagacagggaattctctactgatagttaaaatagtgttgttagacaaggatttgaagaaatgttatacagctaagtgaaagtactcgataggtgctgtatggtgactggtggctaaataagctttactttctagaagatattaattgctgctctatattttttcaattttttttgacagggaaaacatttttttaaattacaaactcaatttatttggtgtatttcaaaggtgcaatacttttcttcatgtatcagtgaaagaagttagaaattaacttcccaaaaaatcagcaaatggcagacagatgtctgtgaaagtcacagtcacatacagtgtggcctagaaaacagaggggcaagacaggcttcacccactttcatgagtttcatcaaatactggatctactcaagggtggaaagaaaaggcaactttcaaaaaggagtatgttattaaatgaggcatttactatactccttcctgagagcaccagatggggaacatgttttctaaactagatctaggaagtggatccttcctcctccccttaagggctatctactggttaatgaattaaaaaaacaagactgaaaaacaaactgcacactcccctcaaaaaaagaggaggaaaaacaacaacaacaacaacacaccaagatgtcccagattactctccagggtggaaccagggaacagcttcaacaattccaattagtttgttacagagtcatccataagcatgccttgcttttaaacaaataataataaagttttaaaacaacaaaacaaaaactggtactaatcacttttctgacgatacacaattactcaaaattaactagtactgggagggggaaggggggaccatacctgtgggccttgtcccacacaagtgcatgtgggtaggtacgcggcatttgtcattattgcaaaaatgattttttttcttttttatttttatttatgtatttttgagacagagtctcactcagttgcccaggctggagtgcagtggcacgatctcggctcactgcaagctccacctcccgggttcatgccgttctcttgcctcagtctccggagtagctaggactgcaggtgcccgccaccacacccggctaattttgtctttgtatttttagtagagacggggtttcactgtgttagccaggatggtctcgatctcctgacctcgtgatccacctgccttggcttcccaaagtgctgggattacatgtgtgagccactgcgcctggcctattttttattttttgagatggagtttcgctcttgttgcccagactggagtgcaatggcacaatttcggcttactgcagcctccacctcctgggttcaagcgattctcctgcctcagcctcctgaatatatgggattacaggtacgtaccaccacacctgactaattttcgtatttttagtagagacagggttttgccatattggccagcctggtctcgaactcctgacctcaggtgatccgcctgccttggcttcccaaaatgctgggattacaggcttgagtcactgcccccagcctgaattttaatttttaatctttagtttgatttaaacactgcttttagtatgatgtcaacaccagctatgcagaaagggctctggagagatgttcatagcagcacacacctgcggctcttcttcgatcctggaggctccagggcagccaatattgtatcgtcaaatacattctttttttttttttctttttggagacggagtttcgctcttgttgcccaggctggagtgcaatggcgagatctcagcttactgcaaccttcgcctcccaggttcaagcgattctcctacctcagcctcctgagtagctgggattacaggtgcctgccagcacgcccggctaatttttgtgtttttagtagagacagggcttcaccatcttggccaggctggtcttgaactcctgacctcaggtgacctgcccacctgagcctcccaaagtgctgggattacaggcgtgagccaccgcacccggccatcagatacattctttaggcctttctgtgtgagtgtagaacactccacatacctgatggccttcaggtcatgggtcagctttttagcagtctctggagtgataggcttctgtttgttcttggcaagtttctcaatagtagaggggtcatctctgagatcagtttgggtcccaacaagcaagaaaggagtctttgggacagttaggcacccactttttttcacattttcaaatgaagatggagagaccactgaaaaacagactagaaatacatctgtttgtggataactcagcggtcataatctgtcataatcctttgccctgcagtatcaaaaatccaagagtgtatggttctctaccaatcataactgtgactgcatagttgtcaaaaacagtacgttattccgatggaaatttgtttgtcgtgtaggatatcaggagacatgttttgccaacagcaccatcacccacaacatatttaattgtctgcattgctgaaatagttttgtatccactttaaatatttcaaatctgatgttgacctcagcttctccactggggcattggcagcactctattttttctatttttaggtattttcctaatataagtctacagttcagtgttagccaaagctcttaaatatactatacagtagaaaaaaagtatagaaatgttttctgaaaagaataagttacttagtgggggtggggttggggctcatatgtgataaattggtctcaaagtagtctttaactttctaaaataaaaatcactctgttgtagcctagtgtaagcggaatggatccgcctttcggggatgcctttcgaagccacaccttttcggaacaaactctgatgagcacagatctcttagcaaacagttcggatccagatttcatgtatgaactggtaagcaacattttcttggttttggtcttgattgatttggggtaaaagtttgtgggagagttttttgtttataaatgcctgaaaaaaaaagatgtgcttgggccaagtttgattcttatgattatacctaggataattttatttatttatttttatttttatttttttgagacggagtctcactctgtttctcaggctatagtgcagtggtgtgatcttggctcactgcaatctccacctcccaggttcaaatgattcttctgcctcagcctcccaagtagctaggattacaggtgtgtgtcaccacatccaactaattttgttttttttttttttttgagacagagtctggctctgttgcccaggctggagtgcagtggtgcgatctcggctcactgcaacctccatctcctgggtttaagctattcttctacctcagcctcccaagtagctgggattacagccacctggcaccatgcccagctaatttttgcatttttagtagggacagggtgtcaccacgttggccaggctggtctcgaactcctgacctcaggctatccacctgcctcggcctcccaaagtcctgggattacaggcatgagtcactgcgcccagcctaatttttgtatttttagtgcagacggggtttcaccatgtcagccagacaggtcttgagctcccgacctcaggtgatctgcccgcctcggcttcccaaaatgctgggattacaggcatgagccatcgcacctggcctacatctagtaattttaaaagtatgcagctgttggctgggcatggtggctcacgcctgtaatcccagcactttgggaggccaaggcgggcggatcatgaggtcaggagattgagaccatcctggccaacatggtgaaattccgtctctgctaaaaatacaaaaattagctgggcatggtagtgcgcacctgtagtcctagctactcgggaggctgaggcaggagaattgcttgaaccagggagtcagaggttgtggtgagccaagatcgccccatagcattccagtctggcagactggagtctcaaaaagaaaaaggatgcttctgggtatggtggctcatgcctgtaatcccagcactttgagaggccgaggcgggtggatcacctgcctgaattttaatttttaatctttagtttgatttaaacattgcttttatttatttatttatctatttatttgggacggagtctcgctctgtagcccaggctggagtgcagtggcacagtctcggctcactgcaacctccgcctcccaggctcaagcgattctcctgcctcagcctcccgagtagctgggattacaggcatgcaccaccacacccggctaattttttgtatttttagtagagatggggtttcaccatattggtcaggctggtctcgaactcctgacctcgtgatccacccacctcggagtgctgggattacaggtgtgagccaccgtgcccggccttaaacattgcttttagtatgatgccgacagcagctgtgcagaaagggctctggagagatggtcatagccacacacacctgcagctcttcttccattctggaggctccagggcagccaatattgcttcatcaaatacattctttttttttttttttttttttttttttttgagacagagtttcgctcctgttgcccaggctggagtgcaatggcgcaatctaaaattagctgggtgtggtggtgggtgcctgtaatcccagctactcaggaggctgaggcaggagaattgcttgaacctgggagacggaggttgcagtgagcggagattgcaccactgcactccagcctgggcaacaagagcaagaccccgtctcaaaaaaaaaaaaaaaaaatgaatgcatcaaaaatggtaaaagattatctaaatatcttcaaatctagtttttgataaagataatgggcttttcagctggaaaacattgagcaaggcatgtgaatgacataaagaatgtggcacaaaaataacaattccaaacaggatctgcatatacttaatcatttattcttgaggtaaatagacacttaaaattcagaagaaaaacattttaaaaacagttttaattacataaaattgaaataacacaaaaatatataaaaactggaaaactgagtgctcaaatgcataaatctactaaaaattattgaattgtctacttaatataggttggttttatggtatgtgaaattatacttcagtaaagctgttaaaacatacacagacaggccgggcgcagtggtcatgcctgtaatcccagcactttgggaggctgaggcaggtggatcacaaggtcaggagttcaagaccagcctgaccaagatggtgaaacctcatctctactaaaaatacaaaaaaattagctgggcatggtggcacgtgcctgtaatctcagcaattcaggaggctgaggcagagaatttcttaaatctggaggaggaggttgcagtgagccaagatcgcgccactgcactccagtctgggtgacagagtgagactccatctcaaaaaaaaaaaaaacaaaaaaaaaaacccatacacagacaacacacacacacacacacacaccccaaaaattaaagaaaaaaaataactctggaagactcaaaacgtcctcattttctttctgtgcctccaccttccaaaccttttaccaaaacgtaactaacaggttcttttccatgcatatgtaaacatatgtatatagtttttttgtatatactttttaattggataatatagataacagttttctgtaacttgctcttttaaaaataaaaatatatggtgggcagtctttcatatttgtacattagagctatgctgcattcatttcaatggctgcagagtcttaactgatatttgaaattgacatctccagtggcacatgcctgtaatcccagcaatttgggagggcaaggtgggcagatcacttgaggtcaggagtttgagaccagcctggtcaacatggtaaagccctgtctctactttaaaaaaaaaaaaaaagaaaaaaaaatcatctctaaaattcgtgaggagtattttactctgcctgcccaagtgttgttataaggtcttgcaaaagatcttaccattctgtggttgaattccaactctctttggattgctctttgcctctatatttaagttcccactaaaaagatatcctcttctgtaatgagggtgtctttattattttcattgttaatattttaaattcttctctctcacttatcacattgtttgctttttagttgaagtgtctccccctgcccccaccctaccaccactaaggagatcccaaaatccttctaagataaggaaatgtaaacttttttcaggcagaatgtttatggtaaactcaagagcccttgatatttggatcatacctgagcctctcaagggacacactttccgtcttttttaaatttaatttttaattgatttttgtttgttttattttcattctactttttcttgcctaaggaaatgatgacattatatgaaatgataaagcgtcctgtcagtagcctttatgttaaaacagaccaaaagtcaagtattgatttatcagtttgacatatggaggtgaatatttccttctgaaatatgatgtgcaatttcttttttaaaacctttctcaggatagagagatgaactaccaacagaatcctagagacaactttctttctttggaggactgcaaagacattgaaaatctggagtctttcacagatgtcctggataatgagggtgctttaacctcaaactgggaacagtgggatacatactgtgaagacctaacgaaatataccaaactaaccagctgtgacatctggggaacaaaagaagtggattacttgggtcttgatgacttttctagtccttaccaagatgaagaggttataagtaaaactccaactttagctcaacttaatagtgaggactcacagtctgtttctgattccctttattaccccgattcacttttcagtgtcaaacaaaatcccttaccctcttcattccctggtaaaaagatcacaagcagagcagctgctcctgtgtgttcttctaagactctgcaggctgaggtccctttgtcagactgtgtccaaaaagcaagtaaacccacttcaagcacacaaatcatggtgaagaccaacatgtatcataatgaaaaggtgaactttcatgttgaatgtaaagactatgtaaaaaaggcaaaggtaaagatcaacccagtgcaacagagccggcccttgttgagccagattcacacagatgcagcaaaggagaacacctgctactgtggtgcagtggcaaagagacaagagaaaaaagggatggagcctcttcaaggtcatgccactcccgctttgccttttaaagaaacccaggaactattactaagtcccctgccccaggaaggtcctgggtcacttgcagcaggagagagcagcagtctttctgccagtacatcagtctcagattcatcccagaaaaaagaagagcacaattattctctttttgtctccgacaacttgggtgaacagccaactaaatgcagtcctgaagaagatgaggaggacgaggaggatgttgatgatgaggaccatgatgaaggattcggcagtgagcatgaactgtctgaaaatgaggaggaggaagaagaggaagaggattatgaagatgacaaggatgatgatattagtgatactttctctgaaccaggtattataatgcttgcaagcttaccagactgacctttgtattactattttgaaatagaaaggtttttgtttctgttttgtttggataatttctttattttagtttgggaattaaatgacttaaaccttggattggatatgtaattggtttttctattcaaatagctctaaaatgatcacttttgctcacatagggattcataagctgattccttgagggcttattttttattattttatttcttatttttaaaattaaaatagagatgagagcttgccactgtgcccagctgaggacttattcttaatgtatcttatgttaagtgacctgttttgtcactctcttgagcatttatgcaaagacaccaataatttattggtttaaaaaatattcctgtttagggccaggcgcagtggctcacgttagtaatcccagcactttgggaggccgaggtgggcggatcacctgaggtcaggagttaaagaccagcccggccaacacagcgaaaccctgtctctactaaaaatacaaaaatcagatgtggtggcacgcatctgtaatcccagctactccagaggttgaggcgggagaatcacttgaacccaggaggctgaggttgcggttagctgacatcgcaccattgcactccagcctgggcaacaggagtgaaagtctgtctcaataacaacaaaaaataataaataaaaatattactgtttatgcatgtgtctctctattatagttgagataagttaggagtatatagaatgttgaaccaagtgatgatggtttatattactcattccaatacccaacaaagtctatttatgaataatgtaaaagcattttctttgtgtctgctaacattttaatttacatcgtattttcctatttaagaaaaatacatgctgtaatttggtgagcatgaaggagactctgctttatttatatacagcgcatataaataaaagggacaaagaaaatgaaatctctgggggaactggttcactttagcatttacatgcttgggcttttggcgctgttggcttgtgcagtttatttataaaaatagtattgccaagtggcacatggttgaaaatgcacaaagaagtaaagatctttaaatttaaactaaagttatcttcttcaaaaatattgttggtactaactctgcatgaaaactaagttattatttaaaaaaaaactatcaaagagagcccttttgttataatgatgattgctggaatttcaggcagtataaacatagatatttaattttctgaaaggcgtttaaagcataatacctatattgtaactagtgaaacattattcttactaaaagaatttttcctttggtgaaatctttctattacacaaatgctttgatttatgcatttgacacaaacattttttgatttgggtggagtttcaggtaagtaaaaggtacttgaatatggaagaaaagggattgtgccttcttcattggtttactgtacaactctatatagtctaggtagaataatgtctttttacaatacaggaaaatttttctcttggcaagtgaataaaatctgctttgagatatttcaaggagacttgactttgtaggtaggggtaatttatataactccctgcacttggaagatcatagtgctcttcataagtggtccttaaagtcttgacagattggtcctgttgctttgagtctcgtatttaggagcagggaggggaagggtgaaacaaagagaggatgggtaattaagggaaatggcaaatgtggggaaggaaatgcctttagcagctggtgcttaaaggaatatatagatcagaaggagtcagtaaatcctaccatcaccaaggcagcaaggactatattatctacctgacttttgattgtagttttgcttttctttgactttttccccccagctttattgaggtatgtttggcaaataaaaattgtatacgtttaaagtgtacaacatgtttttacatatgtatacattgtgaaatgattactaaaatcaggctaattaacatacccatcacttcacatagtagggtggtaagaacatttaagatctactctcttaacaaatttggcctacacaatacagttgttgttgttgttttgaaacaagatatggctcaattgcctaggctggagtgcggtggcacaatcttggctcactgcaacctctgcttccctggctcaagccaccctcccaccacagccttccaagtagctaggaccacaggcgtgcaccatcatgcccagctaatttttgtatcttttgttgagatggggttttgccatgttgcccaggcatgtcttgaacttgtgaactcaagccacctgcccgcctcagccttccaaagtgctggaattacaggcgtgagccaccacacccagcccagtattgttatctgtagtcacaatgctgtatgttagatctccagagcttattcatcctgcataactgaaactttgtaccttttggccaacatcttcccatttcccccacccaccagcccctggcaacctccattctactttttactctctgatcctgagtttgactttttttctaagatttcgcatgtaaatgagatcatgctgtatttgtctttctgtgcctggcttatttaacttagcatgatgtcttccaggttcatccatgttattacaaagacaggatttcctttctttttaaggctgaataatattcctgtgtgtgtgggcatgtgcgtataactctcacattttctttatgtatatgttcattgttggcccctttgttgattccttatcttggattatgtgaatactgttgcaatgaacataggaatgcagatatctcttcaagatactggctttatttattttggctgtatccccagaagtgggattgctggatcatatgatcgttctatttttaattttttgaggaacttccatgctgttttccataatgactgtaccaatttacattcccactaatagtttacaagagttctcttttttccacatcctcaataacacttgctttcatttatctttttggtaatagccatgccgacaggtatgaggtgatatctcattgtggctttcgtttgtatttctctgatgattagtggtattgagcatgttttcatatacttgttggccatttggatgtctttttaaaaatgtttattcaggtcctttgcccattttttaattggattgttttcttgctattacattgtttgggttccttgtatattttggatattaactccttatcagatgtatggtttgcagatatttttctttcatttcataggtagtcccttcactctgttaattgtttattttgctctgtgggagctttttggtttgatgcaatctcatttgttttatttttgcttttgttgctagtgcttttagaattatacatttaaaaaatcattgcccagaccaatgtcaagaatcctttttcatgttttctcctagtatttttattatttagttcttatgtttaagtctttaatccatttcgagttgatttttcaatatggtatgagataagggtctccagtgtcattattttgcctttgaatatccagttttcccataaccatttattgaagagactatcctttacttattgttgtttctggcacctttgccaagaattaattaattggacataatgtgggaatttatttctgggctctctgtttcattggtatatatgtctgtttttatgccagtaccatattgttataattactatagctttttttttttttttttttttttgagatggagtctcgttctgttgctcaggctggagtgcagtggcccgatcttggctcactgcaagctccgcctcccaggttcacgccattctcctccctcagcctcccaagtagctgggactacaggcgcccgccaccacgcccagctaatttttttgtatttttagtagagacggggtttcactgtcttagccaggatggtctcgatctcctgacctcgtgatctgccagcctcggcctcccaaagtgctgggattacaggcatgagccaccgtgcctggcctataattactaaagctttgtaatatattttgaaatcagataatatgatgcctccagttttgtttttcttacccaagatagctttggctattcagaatcttttgtgatttcatatgagttttagggtctttttccctttgtttaaggattgcattgaatttgtagttcattttgggtgatatggatattttggccgtattaattcttccaatccataaacataggatatctttctatttatttgtgtcttcagtttctttcaccaatgttgtatagttttcaatgtatagatctttcactttcttggttaaatttttttctaagttttttttttttagtgtgatactgttgtaaatgggatttttttctaatttcttttttggatagttgttagcatatagaaacacaagtgatttttgaataatgattttgtatcctgcagctttactgaattagtttattagttctaacagttctatggtgaagtcttttctttttttgagacagagtcttgctctgttgcccaggctggagtgcagtggcgccatctgggctcactgcaaactccgcctcccgggttatgccattctcctgcctcagcctcctgagtagctgggactacaggtgcctgccaccaaacccggctaatttttttgtatttttagtagaggcggggtttcactgtgttagccaggatggtctcgatctcctaaccttgtgatccgcccgccttggcctctcaaagtgctgggattacaggcgtgagccactgcgcccagcctatggtgaagtctttagggttttctagatacaagatcatgtcatctactaacagagacaatttcttttcctatttggatgcctttccttctttgttttctttcttcccctgcctcccttccctcccttccttttctctttccttttcccttcccttcccttcccttccctcccctcccctctcctcccctctcctccctcccctcccctttctgtgtccagtccctcccctgccctcctctcccctcttgccccttccccctcccctccccttccctttcctttccttttgcataatttctctagataggacttccagtattatcaatacatggaatagtagttgagagaatgggcatccttatcttgttcctggtcttagaggaaaagctttcaggttttcatcactgagtatggtgttagctatgggtttgtcgtgtatggcctttattatgttgaggtacgttccttttatatgtaatttgttaaattttattttatcatgaaagcatgttgattttttaaagcaaattctttcagatcttgaagcatgttgaatgttgtcacatgttctttccatatctattgagacgattatattgtttttatccttcagtctgttaatgtggcatatcattgattgatttgcatatattgaatcatccttgcatctcaaagataaatcccacttcatcatgatgtatgatccttttagtgtgctgttgaacatggcttgctagtattttgttgaggatttttgcatccatgtccatcaggggtactggcctgtgattttcttacctcgtgtgttcttgtttggttttggtatcatggtaatactggcctcataaaatgagtttggaaatgttctctcctctacatttctttagaagtattagagaaggattggtattaattcttccttcaatatttggtagaatttactagtgaagtcagcaggcccttggctttagttcattgagagtttttgtttgtttgagacagtcttgctctgtcacccaggctggagtgcagtggcatgaactcggctcactgcaattttcgcctccagggttaagtgattctcctgcctcagcctcctgagcagttgggactacaggcactcaccaccatgcctggctaatttttgtatttttagtagagatgaagtttcgtcatgttggccaggctagtctggaactcctgacctcagttgatctgcccgcctcggcctcccaaagtgctgggattacagatgtgagccctcgtgcctggccgacagtttctgattactgattcagtgttctttcttgttattggtttgttgaacttttctatttttttcatgattcagtcttggtatgtttctaggaagttatccatttcttctaggttattcaatttgttagtgtataattgtttatagtagtccttaatgattctttgcatttctgtggtattaaatctgatttctcctctttcatttataattttattgatttgagtcttttttcttaatttagctaaaagattgtgaattttgttttcatttcaacaaaaaactcttcattgatcttttctattgttttttagtgtctaattcatttatttctgctctgatctttgttattttcttccttctgctaactttgggttagttcttctttttctacttccttgaggtgtaaagtttggttgtttatttgagatcttttttttttctttgtcgtagttgtttattaccataagattccctcttggatttgcttttgctttatcccgtaagttttgatatgttgtgtttccatttttgtttgtctcaacatatttttctattcctcttttgatttctttgacccattggttgttcaggagtttgttgtttaatttctacctatttgtcaattttccaattttccttcttttttttttttttttgacatggagtctcgctctgtcacccaggctggagcgcagtggcgcaatctctgctcactgcaagctccgcctcccgggttcagccattctcctgcctcagcctcctgagtagctggtactacaggcgcccgccactacgcctggctaattttttgtattttttagtagagatggggtttcattgtgttagccaggatggtctcaatttccttctgatttccttctgatttctagttatacagttgccaaaatatcatacttggtattatttcagtcttcttaaatttgttaagtaagacttgttttgtggcctaacatatgatctaaactagagaatgttctgtctgtgcttgaaaagagtatatattctgctgctgtcagaatgttctatatatgtctgttaggtccatttggtctgaagtgttattcaaatccattgtttttttaattgatattctgatgatctatccattgttgaaaatggagtgttgaagtcccctatattaccgtctgttttttcctttagttctattaatatttggttcatttacttaggtgctttgatattgggagtacatacatttactatgtatacaacctcttgataaatcaacaaaccctttattattatataaagaccttctttgtcttgtgatagttgttatttttttacttttttttttttttttgagacagaatcttactctgttacccaggctgctggtgtgcaccagtactatcacagctcactgcagtgtcaactacttgggctccagcagtaccactgcttcagcctcctgagtagctgggactataggtgtgtgccacctcttgtgacagtttttgatttaacatctattttgtctgatgtaagtatagccagctctgtcctttttggttgccatttccatggaatatctcttttcatttcttcacttatggcttacatgcatcctttttatttttttgagacaggttcttattctgttgcccaggctggagtgcagtggtgcaatcactgctcactacagccttgacctgccagactcaagcaatcttcccacctcagtctcctgagtagttaggactacaggcatgcacccccatacccagctaattttggtattgtttgtagagatgaggtctccctatgttgcctaggctggtcttgaacttctgggctcaagtgacctgcctgccttggcctctcaaagtgctgggattacaggtgtgagccactatgcctggctatatgcatccttaaagctaaagtgattttcttgtgggcaacatagagttggttcttggttttctattcattcagccactctatatcattttactgggtattgataggtaaggatttactgttaaccattttgttaatgttttctgactgttttatagtccttttgttacttcctctcttgctctcttcctctgtgatttgctggttttttgtagtggtatgctttgattcctttttctttatcttttgtgttatctatactacagatttttctttgtgattatcatggggcttacataaaacacaagtcttttttaagctggtaatagttttaacttcggctatatgtaaaatctctacactttacactttttattgatactacagttaacatcttttcatattgtgtatcccttaagaaattattttatatatagcttttttttttttttttgagacagagtcttgctctgtcatccaggctggagtgcagtggcacagtcttggctcactgcaaccttggctcactgcaacctcctcctcccaggtttgaatgattctcctgccttagcctcccaagtagctgggattacaggcacctgccaccacacctggctaatcttttgtgtgtgtgtgtgtgtgtgtgtgtgtgtgtgtgtgtgtgtatatatatataattttttttttttttttttttttttagtagagacagggtttcatcatgttggccaggctggtctcaaactcttgacctcaagtgatccgcccacctcggccctccaaagtgctgggattagtagtgtgagtcaccatgcacagccaaaattattttatatatagttatttttaatgcctttttaacttttatactagcattaaaagtgttttgcataccactgttacagtattagagcattctgaatatgactgttcttatttttacacagtgaattttatactttcatgtttttcttttcttttttttttggagatggagtctcactctctcgcccaggctggagtgcagtggcgtgatctcagctcactgcaactccacctcccgggttcaagcgattctcctgcctcagcctcctgagtagctgagattacaggtgaccaccaccacgccctgctaatttttgtatttttagtaaagacagtgtttcaccatgttggcccggctagtctcaaactcctgacctcaggtgatccacctacctcagcctcgaaaagtgctgggattacaggcgtgagccacaccgctcccccccaacccatatgttttcatgctgttagttagcatcctttcatttcaacttgaagaactcccattaacatttcttgtgaagcagtcctactggtgatgaactccctcagcttttgttttctgggagtcttttttgttttcccttaagagagagggtctcactgtgttactcaggctggtcttgaactcctgagcttaagcaatcttcccagttcagtcctcttgagtagctggaactactgatgtgcatcatcatgcccaacttaggaaagcttttatttatttttttcatttgtgaaggacagctggcttgctggatatggtgttctttgtagggtattgtttttgtttttttctctgagacagggtcttaactcttgctcaggctagagtgcaatggcgtgatcctagcttactgcaccctcaatctcctgggctcaagcaatccttccacctcagcctcccaagtagctgaggtgtatgccaccacacccagctaatttttgtattttttttgtagagatggggttttaccatgttacccaggctggtcttatactcctgggctgaagcattttacctgccttggcctcccagagtgctggaattacttgcatgagccaccatgcccagcccagtggttttttttctttcagcactttgaatatgttatctcactctcttctagccttcaaggtttctgctgagaaaaccactgacagtcttatgagagtttcattgtatatgacaagttgcttttctcttgctgctttcaaaagtctgtttgtctttgactttccagaatttgattataatgtgtcttagtgaagttttttttttttttttaagacgaagtcttgccactctgtcgcccaggctggagtgcagtggcaccatcttgactcactgcaacctctgcctcctgggttcaagtgattctcctgcctcagcctcctgagtagctgggattaccgacacccaccatacctagctaatttttgtatttttagtagagacggggtttcaccatgttggtcaggctggtcttgaactcctgacctcaggtgatctgccccatcggcctcccaaagtgctgggattacaggtgtgagccaccgcgcccggcctgtcattattactttaaataagctttctgcccctttctctttctttactcttttcactattcctataatgtgcatttcattttgcttgatggtgtcctataaatcctgtaggctttctttattctttttcattcctttttctttttgttcctctaactggataatttcaaatgacctgtcttggagctcactgcttctttcttctgtttgatcaagtcttctgttgaattgccctatggaatatttcagtttagtccttgtgttcttcagctctagattgcatttggttgtctatgttctcttgttgctcactgagcttctttaagacaattattttgaattctttgttaggaagttcatagatctgcattattttggatcagttgctggtgcttaattttcttcctttgctagtgtcatttgtccctgattatttgtgatccttgtggcctttaattggtgtctatacatttaaacatgtggactcctcttccagtctttatagactggctttgccaaggaaagcccttcacttgtcaggtcatctagaggttctgggtgggcttgctgaagggctctgcaggcaagtttgctcctggagtccttgggtaggctggcctattgctggagtcagcagccaggtgggtctgaggcttgggtctgtagaggtcatcctggtgcctggtactgtggaagcaggcctggagcctggatcatttggggtcagtctgaaacctgggtccataggagctgaaccggcagtggggtgggctttgagtctgaatccacgagaacttacctggcacctgtatctgtgggagtggacttggtcctgactccacaggcaccagcgtggcatgggggtctcttggggcaggcctgtcaactaggactgtgggtgtgagcctggagtccaggactccagggatgggtgggccctgagcctaggtctgcagctgctggcttggtgctggggtagacctgtaaccaggttctgctggggctagcttgggtccatgggaaccattttggagcttggggccatacttttctttgacctttaactccactctaaattcatccttgatctcttgacttcattccttctggatgtgttgagagataaggaggtctgtgaagggagatcacatggttaattgatcgccatttttattttctcatccctttgactctcacagggaggcagaactagtcacatgtcacattttcttcccttgacccttgtaggagaagccttatttattagcatgttgctcttacataacaggacagtggctttatacattagcaggcatttggcagggtcaagttctcttcttggacctatttgacaattatcccaaatttgtggatggcatttaattcattcactttcagttgacttgaagtaaaacccttttggttaatattatttggacagttctcacaaatgttaatgagcagcatgctttcaccacaaaattgtgttaattttgtggtattatttggactttattcacatttgctagtaaaattttctccttttcctagaagagctaaacaagtgactttaaagatgcaaaagtgagttactggtgagaaacaggaagaaattctttgtagcaaaagagtaaggatagctatagtttcttcagtgctagtttagggtggattgattggtttaatttatagctgacagtttacaaaggtccttttgtgatgactagctcccttgatgctgtttcttggcacttggctacaacagttcacgagcctacaaagtttcaggaaaggtgcaaaatggagttttagtctcttttctggattggctcccaaattttaatagagccttttctgtggacaggctacaactgtttggggtcatgaaattacatgattgtaaggctaagaatgggctcacagaatgagaatttattttgtaattttcactaaacatcttcacagttgactttaccagcttattgacagtagtctgtactaaccagagatgtgtgattgaaattttaggcagtaaatgtggtatttgttactttttttggtaatcatgtcagatagcaatgagttagattagtatgatgatctatcacatgaaaagaaaagggaaaggccttaataggaaatgttgcattaaacaacatcatgaatttgttttaaaaaattttgagtgcctacttttgtggcaggcactgtgtatattaggtactggctatacagagatgaaaaaagtagacatctttatcttcatggaatttagtgttaagtgggtttatttactgttatgatttcttaatcttttaacatgtctgtgtactgtgatttggcaagagagatatgcaggatgagagattttaaaacttacctgactacagaattcacttcgggtaaaaccatatctcacggtaacagtgttcttcagaatctagtttgagaaatatttaatgaccctagattcaagaccagtgatcttggggcataatttttttcattctgtttgatcattgatagtctctgtattgaaaggtggatggtggctgagcatggtaattcatgcccgtaatctcagcactttgggaggctgaaatgggaagattgcttgagcccaagttcgagaccaccctgggcaacatagggagactcctgtctctacaaaaaatacaaaaattagcccagtgtagtggtatgtgcctgtagccctagctactcaggaggctgaggtgggaggattgcttgagccggggaggtcgaggctgcagtgagttgtgatcatgctgctgcattccagcctgggtgacagagcaagtcacagtcccaagaaaggtggatggctttaggcaacaaattcagagagagagagagagagagagagagagagtgtgtgtgtgtgtgtatttttgtgatggtgaatttatggtgtatgctattagaaaatgttattgtattaagtcaaagaaaactgatggcttttaaatacttctgggaaaaaggctggatgcctataggtaataaaactgtaatttgggtgggacagaagaaataaaaaaatcttcatgattctttaaacttaacatgaaatatatgcaggaaaaaatctattcagatcatttaattaggcacaagaaaagtgggaagcccctgagacaccttgagttgtggggcctgacttagtcccagctgtgccaaatcatgtcaagtctccatgagcattttagttcgtataaatggagctaacaacctccttcctaactagggacagtgatttgccagagatccaggccccttgcagagaggcaaaggtagttactatctaagggagtatatcaaataaagtatccaggaggatggtatgtgtgtatatatgtgtgtgtgtgtgtgtgtgtgtgtgtgtgtacacacacagctgaggaagctgtgtataaaattttttcccttatgctttgggctgggataggcttaagtgtggaacacccaattactgacattgataggaaggtgggagtgttttggttggtgcatctgcctgtgttgaggtgttcacagtcaaactagggtaatcttgtgagccagtaatttttgcttacctagtgtaacaagggccttttatttatttatttatttattgagacagaatcttgctgttgttgcccaggttggagtgcagtggtatgatctcgtctcactgcactccacctcccaggttcaagtcttctcctgcctcagcctcctgagtagctgggattacaggtgggcgccaccacacccagctgatttttgtatttttagtagagatggtttcgccatgttggacaggctggtcttgaattcctgacctcgtgatctacccacctcagcctcccaaagtgctgggattacaggcatgagccaccgtgcctggccatgagggcctttttatttatttatttttgtatttttagtagagatggggtttcatcgtgtgagccaggatagtctcaatctcctgacctcctgatccgcccgcctcggcctcccaaagtgctgggattacaggcatgagccaccgtgcctggccacaagggcctttttaaaggccatttctgttggcaacatatggcccttgcatcttttccaaaactaggttgataactagaacaaaataaatcctatcatttgaaaagaaacataagcacaaataaataggccaaagccattgctttattctaatatagtttttaaaaattagacttctagaaatgattgtgtcactcaacttgtgcatcattttttaagaagagcctaaggggccaggtgcggtggctcacacctgtaatcccagcgctttgggaggccgtggcgggtggatcatgaggtcaggagatcgaaaccatcctggctaacatggtgaaaccctgtctctactaaaaaatagaaaaaattagccaggcgtggtggtgggcgcctgtagtcccagctactcaggaagttgaggcaggagaatggtgtgaacctgggaggcggagcttgcagtgagccaagatcgtgccactgcactccagcctgggcgacggagcaagactccatctcaaaaaaaaaagaagagcctaagggtcaccatcacactgcttgctgttttgttttaaactaccacgtgtacactaataaaatgctgttaataccagcagtgctacaaaagcttgccttaactgttgctcagaaatcattctgctttccaaattgattcttttttttaaagtcatgtttattgtggtataattttcacacagtaaaattcacccctcttacagtgtacacttctatgagttttgacaaatcatgtaatcaccactaataccaaatagtttgatcacccccgaaaattccctcttctattttattttattttattttattttattttattgagatggagtcttgctcttgttgtccaggctgtggtgcaatggcacgctcttggctcactgcaacctctgcctcctgggttcaagcgattctcctgcctcagcttcctgagtagcggggattacaggcacccaccaccatgcccggctaatttttgtatttttagtagagatgaggtttcgccatgtgggccaggctggtctcgaactcctgatctcaggtgatccgcccaccttggcctcccaaagtcctgggattacaggcatgagccaccgcacccggccccttatattcttttatagtcatcccttttctccactgccaatccctggcaaccactgtccatataggttgctttttccagaatagtatataaatggaagcatgctcctgattcattctttgtctggagaaaacttagttcctcaaagcaaacatatcatcaccttcttatgttttcaggaaggaaaaattacctttttacttatggccaatgctgcccaagttttcctggttaccttaggtttggattgtgtacattcttcgcacagcccattccgtcttgttcatgtacctagcgttaatgatctggagtacatcagaggtggccattctctgagggtattttagatttataggtcattcaatactgggtctgaccaacagttctagcaactcagaattaagtattttctgaaacttcctattaggaaaatacccccttcttaaacagtgacgttaatacaaatagctttcaataaaatattaactggaataggcatataagttttttatctgatagccagtgtgagaaccgtcatcttttatacttttccaaaagaagtggtgtgacaggtaggaagaaaactaatgctgccacatagaattctgcctagtagaacaccatcatagaagtgtatacagctgggctaggcatggtggctcatgcctgtaatcccagcactttcagaggctgaggccagaggactgcttgtgaacccaggagtttgagaccagcctggcaacatagtgagacctctgtctctacaaaatttttttttttttttttttttttttggagacagagtgagcgtctcattctgttgcccaggctggagtgctgcggcacaatctcggctcactgcaacatccgcctcctgagttcaagtgattctcatgtctgtgcctcccgagtagctgggattgcaggcgtgcaccaccacgccctggctaatttttgtgttttttagtagagacgattttgccatgttggccaggttggtctcaaactcctgacctcaagtgatctacctatctcagcctcccaaagtgctgggattacaggtgtgagccaccacgcctggcctacaaaaaattttttaaaaattaaaataaaagaaaaatatttaaaaaaaaagaagtatacatagctttctgtctgagatgtttcagatacaaatattagaaggaagacatttaaaaatcatagtttatgtatctaagtaccattatctgatggtacttttgatattcctatagctgtcctgtaattgttctcttaatcctgtttgaagataataaaaatagtatcgtatactaacttataaaaactaaaaagaaacccaaggaagatgaacagtgtagttatctatgtttattaatctcggaatgttttatgagttagagatttacatattaaaagttctcttatagacctggtttattatctttgacatgccaatgatgttttcagatgcaaggaaatataccaagttacaaatagaaggggtcttttcatttgttctgattgatttattgaaatttatggagcttaaaaattgcgggacctttttttaaggctatgaaaatgattctgtagaagacctgaaggaggtgacttcaatatcttcacggaagagaggtaaaagaagatacttctgggagtatagtgaacaacttacaccatcacagcaagagaggatgctgagaccatctgagtggaaccgagatactttgccaagtaatatgtatcagaaaaatggcttacatcatggtaagaggggattgcagtcagatatttagtgtcactttaatcaagttgagctactaatccataatgtttactccgtgtacctaggcattcagcccttcctagcaaactggagatggggactgtagagctgctacatttgtgtgactactcttcgtcactcacaaatagcttttaccagtgttaagagtcctcacctaagtggagaggaaggactgtgtaaacattatttcatttctagtcccttcttaatctacctaccccattcaggaaatgactaggaggctgctggtttctgacctgtcacagttggtataaccagaagggttgaggagaaagtgaacgggctctcttgcattcttgtgtaatccccagatgtaaatggggggactggaattcaaacggtaatggggataaaagggcaaggaaagaaaagaaagggaggatggttatggagaaaaggagttgtagagaagagttgaatacctgtagcaggaatcagaagtttataatcttaggtaggtcaggccgtgtgctgcagctcatggttgtaatcctagcactttgggaggatcacttgagtccaggagttagagtctgcagtgaattgtgattatgctactgcactccatcctgggcgatagagtgagatcctgtctctaaaaaaattttaaaaatgacagtcttaggtaggtcaaattttttattgtgaactcaggaagctgtgattaagtagaatttattctgcacaaatgttatttttaaattaatccatagtttctagttcttctgctctgaataaaaaaaattaatacaaagtctttactgaaaaaagtggggaggggaactactagtaagtgtgatggtcagtaaacaggttattcactcatcgtacgaatgtgagttgcaaaggatttttgaggacaagaattccatctgatgtatgtttgtgtctcattttccttttccactagcaaccaggtgtactatattgtctctcagtaaataattaccaagcttttgccttcagataagttttctactagaaatgaaacattaagtccagtcaataatcccaagtagcatatgaatactaggaaagttgtaggagttcagaggacagagccatcccttttgcctggagtgatagaccaagaccccttgagtcttctataatgttatttatcaaagcaacaaaagaagagcttttaaacaaggttatgcttacttgttggattttcaagttcaatacaaaaatgtgtatgtctgacagttttcagacgtagcatcagaaacatcttggtttgtgtaaaatctccaagctctcttccgactatgtattataccctagtcctgattttggtgtttagttgaactcatactcatcctgagatttgagatgcttagtatgccatgcaaataatgaagaatctgtcatgctggaactagaagcctagggtagggaagaacttggaaaaagttagaactctgccatatcacccccatttcctgcagccacaagatgggaaggagaggaggccagcccttctaggatagattgttaaacatgctaagacttctgaaacatgccaagacttctgaaaagaaaaggtagtggtgggaagtggttaaaaatgtggccgtgaaaaacgtgtctcttgttaattaaagtgatctgacttaaacttcttttaaactgtttataggaaaatatgcagtaaagaagtcacggagaactgatgtagaagacctgactccaaatcctaaaaaactcctccagataggcaatgaacttcggaaactgaataaggtgattagtgacctgactccagtcagtgagcttcccttaacagcccgaccaaggtcaaggaaggaaaaaaataagctggcttccaggtaaatgctaataatgttcactcatgtgaagaaagtttaggaggtgaggttagtccctaagtgagtttttatagaaggacaacaaagaaattgtatttttcttgtataaatactacaatgagaatattataatttttcttttgaaagtagaagacggtatttttgttttatggaaaaagtttttaagaggggagagatgaatggactctggtgcattatgttgtataacaataaaaaattttttcatagctttattttttgtttgcttttttagtaagtcagagttattgagctataacttatagtaaaatgtataccttttaatgtatacttttatgagttttgacaaacatatccaatcatacaaccaccaccacaatcaagatattgaacattttcatcatcttaaaaagtttccttatgtctctttgtaaaagcaaaccccttcctgcacccatcgcccctcaaaactactgatctgttttctgtctccgtagttttgccttttccagaatgtcatgtacatggaatatactgtatgtatgtagcctttgattgaacctgtcttcctttttttttttgagacagagtctcactctgtcacacaggcagtggcctgatctcagctcactgcaacctctgcctccagggctcaagggatcttcccgcctcagccccctaagtagctgggattatagatgtgacccaccatgcccagctaatttttgtattttttgtagagatggggtttcaccatgttgcccaggcctcccaaagtgctgggattacaggcgtgagccagtgcgcccagctgaatctgtattctttcactcaacatgacacatttgagattcatccatattgttgcctggagtaataatttgttccttttggttgctgagttgtattcctttgggtggggatatactacagtttatccattcaccagttgaagggcatttgggttgcctccagtttttggcaattttgaataaaaccaccatcaatgttcacttacaaatgtttgtgtgaatatatttccatttctcttagataaatatccaagcatatatgcttataagaaactgccaaactattctccaaagtagctatatgtgctgttttactttcctgctagcaacacatgagggttccacttgcttcacatcctgtacaacttttggtattatcagtttttgtttgtttttatttttgttttttagccactttaataggtgtgtgctgatatagctttatttttaaatgtgtgctaaatttttaaaaatcaatttgcataaatgattatgttgtgttttctggtaactcagttatttgttaaatgtcagtaggcagcagttttggattgctattagaaaatgaaagatgaaaattcacttaaaaaagaaagcaggctgggcatggtgcctcatgcctataatcccagcactttaggaggccaaaaagggaggatcacttgcagctaggagttggagagtagcctgggcaacatagcgagaccccttctccgtaattaaaaataataaaattaaaattaagaaaaagaaagtgaactaactgctccttcctttcacagagcttgtcggttaaagaagaaagcccagtatgaagctaataaagtgaaattatggggcctcaacacagaatatggtaaacctaaagttttaagaagttgattaaccacctattgatttgctgaccactctctcttttctttggtttgtgatttgctttcgctgtattctgcctagtttttggctagcctcctatttgtttatctgttcagtaagccacatgctcactttccttcagtcttgtccaccttttaatataagtttctgtactgctgacttcccaatccacatctcatctttacactaacaagctgatccacattgtgaccatgataatttgtttatttttttctataaaagatgtgaaaagttttacaagtaaattaagaataggcagcaaaaacaacctgcacttctcgaaagatcacaataatttcttctattttataattgtgttactggattagccagttttgttgactgattttaatattttccctaaattgaataatgatattttaggcttcgtatgaataattcagacctgtgtttttcagatttgattgctcattggaattgtctgtgtacttggttaaaatacacatttctaggcttctctgcagatcttctgaattagattgtgtacaagtagaactcaagaatccatatttttaacacttctcagatcattctctttttgtgtgtgtgagacaggatcttactctgttgcccaggctagagtgcagtagtttgatcacagctcactgcagcctccaccttctgggctcaggtgatcctcccactgcagcctcctgggtatctgggaatacaggagtgcactaccacgcctggctgattttttgcatttttcatagaggtggagtttctactgtgttgcccaggctggtcccaattttgtgggctcaagcaatctgcccacctcaacctcccaaagtgctgggattacaggcatgagccgctgcacccagccaagattattctttttttttttttcttctttttgagacggagtctcgccctgttgcccaggatggagtgcagtggcacgatctcggctcactgcaacctctgcttcccaggttcaagcagttctcttgcctcagcctcctgaatagctgggactacaggcccacgcaccacaccttgctaatttttgtatttttagtagagacagtgtttcaccacgttggcaaggctggtttcgaactcctgacctcaggtgatccacctgcctaggcctcccaaagtgctgagattacaggcatgagtcactgcacccgggcccaagattattcttaatggaaccattctagcacttattcaggaactactggctttgatctaaaccaaagtgcttctcagcatttcacattgtagcacatgtagaaaattatcatctctgaggcatcacggaatataacaagagtaggctgctcatgggaggaggtccccatgagctgaggggataattatcttacacatctagaacccttttacagcacttcaggggtatgggaagctctggttttgatcttctgtgataagaacacctcctttctcccttattttgtttaagcctggtgttataagagtgtattcctttgcctcaaaaattgtcctcttcgatgtgtagttcttttgggcaagttgaatctgaaagtgaaacagtgtgaacaatgaccaattatttgtttctagaggttttcttaagtttagcatgtctggcacataggtgttcaataaactgtgcagattttcttaatcttttatcttgattattttgtttcctttggtgagggcagaaaaagaatttccaactgtaaagttttcaacttatgaaatgaacttaatgttttatttaatagccactcagtaaatgaattagataaaataattgttggtgtgttgaaatgcaaagctatccattttcctattgttctttcttactattgaaacattttggccttgagctctgttagtggtgccctggccgcctcctagatatctggaagtcactctgttacttctttgtggaacacttattatccattacctatcagcccaatagtttctagaatttgtgatttacaatttgaaaaatattttgagacttgagaacataggcttaccaactttatattttgccaagtgagaacaataaaaagaacatcatctactattactataatttcatataaggaaggatattttagtattaaaaatttgagaagggcataatctcataatagaaaataaatttagctttatgaaaaatgtactctgttgtctttatcatttttaatatgtcatgaactggcattgttccagggactagcttcaggggcccactatactactcatctcatcctatcccaccaaacttccttctattgattcctcctgacaaagctcactggagactgctgtgtgaatcctgtggaaacttgttgactcagaatgagaaatagaactgttagctcttcactctgactgacgtattttgtccctaaggaaagctatatggaaacattaaaaccagaaaatcccttgatgaatatggcatcagaggaggaggatctgtttatgagttgaatgtttggactcaatttctgagagccaggtgcttctattttctaaaccagaggtttgcggtagcatgagagccctttcccttttctctccctgccccgtaatgtgtttggacactgtcaaggcttgagaagaactattctgctcagttttactttagattttatagtgttttttctttttcttttctttttctttttttttttttttgagacagagtttcactcttgttgcccgggctggagtgcaatggcgcgatctcggctcaccgcaacctctgcctcctgggttcaagcgattctgttgccttaagcctcccgagtagctaggattacaggcatgcaccactactcctggctaattttgtatttttagtagagacagggtttcttcatgttggtcaggctggtgtcgaactcccgacctcaggtaatctgcctgcctcggcctcccaaagtgctgggattacaggcatgagccactgtgtctgactgtgttttctcttttaaaagtaactttatttacttttaacctgttgaatatgggagaaccccattgttttccctaagtctagcctttatgcaaatatccttgagtaagtagtcttctctttcaattattcatggagaagaaacatagattttttgtttcaagtgatataggaggttagctctacttccttgttcagtgacacattttacatatattggccctgaatgtagttttgctttgttttttttttgagacggagtctcgctctgtcgcccaagctggagtgcagtggtgcaatctcagctcactgcaagctccgcctcccagtagctgggactacaggcacccgccaccacgcccggctaattttatttttttgtatttttagtagagatggtgtttcaccgtattagccaggatggtcttgatctcctgacctcgtgatccgcccgcctcggcctcccaaagtgctgggattacaggcatgagccaccgcgcccggcccctgaatgtagttttaaattgtccctctcactttcctcttcaactgcagtttagattggccccttctcagtattgctagatgaagaataacaaatcactggtttttacaccaggcattgtggcatgcttctgtaatcccagttactcaggaggctgaggtgggaggattgtttgagactagcctggatgatagagaaataccccatctctttaaaaacagaacaaaaacctcaaatcaccaaggcagtctctgaagaggtagagattaatttcagactgtaggaatcctgtgtgctgaaataaaaaatgtgttttccttacagctttaccgaggtataattgaagtacagtacctacacattgaaagagtataattcgattggtttacatatacgcatacatatgtgaaacaatcaagataatgaatatttccattacctccaaaagattcctagtgcccctttgtaagtcattctgctctccactcctatccctggatagcctcaatctgctttctgtcactatagagtaatttacatttttctaagatcttacattgatggaatcacaatatgtttacatttttgcctggctactttcactcagcataattatttaaaaattcctccatgttgttacctgtatcaatagttagatcctttttattgctaactagtattccattgtatggatgtactacaatttgtttatctcttcaccttttgatggatacttaggttgtttcaagtttttggctataaccacggggctatgagtatttgtgtacaagtatttgggtagacatatgttttaatttctcttggttaaatacctagatgtagaatgattgattcataagataagtgtatatttacttctataagaaactgctaaactgttttcccaactgactgtgccattttgcattcttaaaaacagtgtaggagggttctagttggtccacagccttgccaacatatggcaaggcctatattcttatttttacaaatctaatgggtgtgtgatggtatctcattgtggtcttaacttttcatttctctgattaataacattgagcctctttcctgtgcttattggctgttcatatgttttcttttgtgaagtgtctgttcaaatattttgccatttaaaaaaattggtttctcttctaaaggttctttattctgggccggtcgcagtggctcatacctgtaatcttagcactttgggaggctgatatgggtcaatcacccgaggtcaggagttcgagaccagcctggccaacatagtgaaatcccatttctactaaaaatacaaaaaattagccaggcttggtggtgagcacctgtaatcctagctactcgtgaggctgagggaggagaatcacttaaacccgggaggtatgggtgcagtgagctgagattgtgccattgcactccagcctgggcaacaagagtgaaactctgtctcaaaaaaaaaaaaaaataagtaagtaaataaataaacgttctttattctggatataagttctttggcttggctttttgctttcctcattggcatcttttcctttccttttcctttttcctttcctttttgccttcccttccctcccctcccctctcctcttcccttcccctcccctcttcctccctccctccctccctccctccttccttccttccttccttccatccctccctccctccctcactccctccctccctccttctctcctctctctctctctctctctttctttttctctctctctctctctcctcctcttccctccctctccttccatctttctatctttcttgtctttcctcgctctgttgtccaggctggagtccagtggtgcgatctcagctcactgcaacctctgcctcccaggttcaagcgattctcgtgcctcagcctcccaagtagctgggattacaggtgtgcaccaccacacctgactgattttttttttttttgagacgaagtctcactctgttgcccaggctggagtgcagtggcgcaatcttggctcactgcaagctccatctcctgggttcacgccattatcctgcctcagcctcccaagtagctgggactacaggagtctgccaccacgcccagctaatttttttgtatttttagtagagacagggtttcaccatgttagccaggatggtctcgatctcctgaccttatgatccgcctgcctcggcctcccaaagtgctgggattacaggcgtgagccacggtgcctggcctgatttttgtaattttagtagagacagggttatgccatgttggccaggctggtttcgaactcctggcctcaagtgatccacccgcctcggcctcccaaagtgctggatgggattacaggcatgagccaccatgcctggccctcactggcatctttcaaagatcaaacatttttaattttgatgaatcaatttgtcagtttttttaatatttcatgatgttttgtgttgtaagaaacctttgccaactccagcatttacaaatcttttcttgtattttttttttcttagcatttacgtagttttaggttttgcatttaggcttatgatcttttttaggtcaatttttgcatatggtataaggtaaaagatgatgttcatattttcccatataaatatctggttgatcaggcaccatacattgaaaagactttcccttccccattgaattgtttttgcacctttgttcagtcaatagaccacatatttatgggtttacttctagatattgtattctgtttcattgatacatttatcttcctttatgtggatacaaaacttttttttttttttttaaatagagacagggctgggcatggtggctcatgcctgtaatcctagcactttgggaggtcaattgggagtattgcttgaggccaagagttcaagaccaacctggccaacatagtgagacccttgtctctatttaaaattatttttaaaaaagaaaaaaagattaaaaaaaaacatagatggggtctcgctgtcttgcctcgaactcctgggctcaagcgatcatcccatcttggcctcccaaagagctgggattacaggcatgagccattgcacccagtcatgtagatagaaaattgtcttgatcactgtacagaactgtcttgattactgtaaatctttaagtcaggtagggctagttcttgttagacctccaattttgctctttttgtttaaatctgttttggctattacaggtcttttgcatgtctatatagattttcaaattactttatcatcttttacagaaaagcttactggaattttaattgggattgctttgaatctttagatctatttagagagaattactatcttaaaatggagttttccgatccatggacctggtatctctctctacctagctaagtcttctttagtttctctctgtcatcttttacagtgttcagtgtagagtgcttgaacatcttttattagatgtagtcctgagtattttatgttttttagtgcttctgtaaatggaattgcttttgaaattttatatttgagttctttggtattaatatataaaacatatttttgtgtattactcttagttccagtagtaggtatgtagattccctgggattttctgctgacacagtcatcatctgcaaataggaatggttttatttattcctttctgatctttatggcttttgtttttctgccttatcaaaatgtctagaacagccacaatattaaatagagtggtgattgccttgtttacaatctcaggggaaaccttttatctttaggtatgatgtttgtgttgtacttttttgtagatgagatgccctttatcattttgagaaaatttcctgctatttctagttttgtttattatgaatgggtgttgatgatttttttgcatctattggaacaatcatgtattgttctcttttattctgttaatacatcacatattcatctgttaaagtggcaaattacatttgttaatatttggatgttaagccaaccttgcattcttggaataaacgctacttggttatgatatatcttcctttttatattggaatctattgctaatatttcatattattctattctaatattatatgttggattccattgttaatgctttgttaaggattttgtgtctacattcaagaggaatattggtctatgatttttattttcttttttttaaaaggttttagtaccagggctatactggccttatagaattaattggaccatgatctctctttcttttttgtttgacaaagttttataagatcaattttatttcttcattgtatctatgatagaatttgctattaaaaccttctgggttctttttttggggaagatacttggtaatttcaattcttttactagaaaaagctattcagatgctttatttcttcttgtatggattttctttttctttctttctttcttttttttttttgagacagtatctcactctgttgctcaggctggagtgcagtggcacgatctcagctcactgcaacctctgcctcccgggttcaagcaattctcatgcctcagtctcctgagtagctgggattacaggcatacaccaccatgcctggctaattatttttatttttagtatagatggggtttcactgtgttggccaggctggtctggaacacctggcctcaagtgatccacccatctcggcctcccaaagtgctgggattacagatgtgagccaccgtgcctgagcctctttttttttttttttttttttttttttttgagatggagtcttgcttgttgcccaggctggagtgcagtggtgcaatcacagctcactgtaacctccgcctcccagcttcaagcgattttcttgcctcagcctcctgagtagctgggattacaggcacctgccaccaagcccagctaatttttatattttattagacatggggtttcgtcatgttggctaggctggtcttgaacttctgatctggggtgattcacccgcctcagcctcccaaagtactgggattacaggcacgagccaccgcgtccggccttcctggcttcttatgtggattttaaattgtgttttcaagaaatttgttcatttcacccaagttgttaaatttgttagcaccatattttcttattatccttttaatatctgtagattctaaagtgataacaacacctttttcgttactgatatgagtgattggtgttgtctcttatttttcatgatggatctacctgggtagggggttgtcagtgttattgatcatttcaaggaaccagcttttggctttgttaattttccttattgtatattttctgttacatacatttctgctctttattatttccctcctttacttactttgagttaacttgcttttttttttttgagttggagtcttgctctgttgtccaggctggagtgcagtggcgcagtctcggctcactgcaagctccgcctcctgagttcatgctattctcctgcctcagcctcctgagtagctgggactacaggcacctgccaccacgcccaactaattttttgtatttttagtagagacagggtttcaccgtgttagccaggttggtctctatctcctgaccccgtgatccgcccgccttggcctcccaaagtgctgggattacaggtgtgagccaccacgcctggccttaacttgctttttgttctgttttgttttaaagcttttcaaggtggggaaatctgtttttaaagcttttgtttttgagggacttggtttgatttatttaataaacatttactaaggtcctgtgattcgatatagcaggcactatcaggtcttaaagcaatgaagacaagtagggcaagttgcttacaggttagtggacatcgatgcatgtctacagtgtgttgtcttttttccttgccattttttttagttggagatggggtctcactgtggtacctaggctggagcacagcggctattcacagtcaccatcctagtgcaactgcctgcaactcctgggctaaagccattcccctgcctcagcctcccaagtagctgggactgcaggtgcacaccaccacacctggctacagtgtgttatcaaaagtgcatacccagtaatcttgagggttttgttgttgttgttgttgtttgctgctgttgttgttgttgttttttgagagggagtcttgctctgttagcccaggctggagtgcagtggcaagatcttggttcactgcaacctccacctcctgggttcaggtaattctcctgcctcagcctctggaatagctgtgactataggcacatgccaccacacctggctaattttcgtggttttattagacacagggtttcaccgtttggccaggctggtctcgaactcctgacctcatgcagtccacctgccttggtctcccaaagtgttgggattataggcgtgagccactgcacctggctaatcttgagatatttttaaaaaacaagtgccacatcatttgaaatcagtttctttgtataggagctgcttataatcattactgcttaatgctttcttacacattctccatttctttttttttttgagcatagaattttttttatttgttggtgtcatctattatttcttttattattattattattattattattattattattattattattatactttaagttttagggtacatgtgcacaatgtgccagttagttacatatgtatacatgtgccatgctggtgtgctgcacccattaactcgtcatttagcattaggtatatctcctaatgctatccctcccccctccccccaccccacaacagtccccagagtgtgatgttccccttcctgtgtccatgtgttctcattgttcaattcccatctatgagtgagaacatgcggtgtttggttttttgtccttgcgatagtttactgagaatgatgatttccaatttcatccatgtccctacaaaggacatgaactcatcattttttatggctgcatagtattccatggtgtatatgtgccacattttcttaatccagtccatttcttaattatctgttattacataattaaaaggaaagtctttcatggtagtgacatattccaagtgttttgttctgtcttacagataatttattgtttgtaatcaactccatcaagcaagagattgtaaaccgggtacagaatccaagagatgagagaggacccaacatggggcagaagcttgaaatcctcattaaagatactctcggtaagaagaatgcgagataaattcataacaattaataatatgtgtaagatgtatgatttaaggggatattaaaagttcttttagtttaaggaaaaactcaagtgctctcattgtaattactctcctttatgagtagttttatcttttgagatttagtgttcataaacatgtgttgcaggtgaccacaacttgtaatttagacttaatcatgaaactattttaacatttaagaaaaacaaacttctagcaactttaacctttcatggaggacaaaaggtcccagagctgtcaagcctgcagtttgcactttagtgtagagattcttacttgttttactcagtaatgcatttcacaggattcccacaaacttggctctctggtttcccatccctgaacagattgcacaatgtggggaggatcagagggcagggatctagacgtcaggccaactgagagctgacagggaagagagagctagctagtatagacatagacatgagaatcagctcagctgctgtaggagaaagtcactgacagacagtagcatccaaggcatccagcgttatatgacccacgaaaacccccaaaattaaatatacacaataaaaggtcaaatgtttttcttgaacaaaagtatatttatattgaaaacaatcaggtgaagagtagaccctaatcgccagtattttcctcagcaatcacttacctcctgcttccatatggattaattctgtgcttgactttttcttcaaatgggttgatgctattttaattttttatgtattctttcatagcatttctttcttttctttccttttatttttaaaagcatttttattcttcctttattagctacagggggaaatttaacattacaagaaaaagttatttttacctttttattttttaatataaacatctatatgtttggtaagcttatgtactcctttacacttgaaagtcagttttaccaggtataaaatcctcaactcgtattttctttccttgagtatcttgaatatgagtctccattttcttttggcataaagtgttgctatagaaaagctaatactggctgggcttggtggctcatgcctgtaatcccaacactttgggaggccaaggcgggcagatcacttgaggtcaggagttcgagaccagcctggccaacatggtaaaaccctgtctctactaaacatacaaaaattagctgggcgtggtggcaggtgcctgtaatcccaggtacttgggaggctgaggcaggagaatcgcttgaatgcaggaggggtggaggttacagtgagccaagattagaccactgcactctagcctgggtgacagagcaaaactctgtctcaaaaaaaaaaaaaaaaaaagaaaaaagaaaagccaatattgactaattattttttccttataagtactttgctgtttttgcttaggtgccaaaaggattttttctttaaataccagtgattttgctaagttatatcttagagttggtcatttttagttgacatttttatgtttatactgtgttctttcaatatgtactttcaaatgtttttagtgtttgatctgttcccttgctttgcttttcttctgtagggactcttattatctatagattggctctttttggcccatctttagtattcgtctgtctttcttttctcttttcttcttctttcttccttcttcttctttcttcttcttctttttttttttttttttgagacagtgttttgctctgtcacccaggcagtagtgcagtggcacaatcttagctcactgcagcctccacctcccaggttcaggtgattctcctgcctcagcctcctgagtagctgggattacaggcacccaccaccacacctggctaatttttgtattttttagtagaggtggggtttcaccatgttggccaggctggtctcgaactcctgacttcaaatgatcttcctgccttgtgtcactttttcttgaatcatttttatctcttcatttttaacattatttctcctttttaccttctgtttctcttaaagcattatttgctgtcattacttgctgatcttaggttccttttactttcaggaattttcccctgtatttctaattattttctgaattctgtcaccttatttcttagttattctatttctgatttatgttctttcatgtatcgtgccattttctttaatgtcttttattctcttttttcttagaaaaagttgtgggattctgaccttgatacttctctgttgttcatatatgtgtgaaattagttcctctgaacttttaaaagaaggtttggttcagaatagcttttcttttttcacagagtctccgcttttcagttaacatttaaaaacatggcatccgggcacggtggctcacgcctgtaatcccagcactttgggaggccgaggcaggcagatcacgaggtcaggagatcgagatcatcctggctaacatggtgaaaccccgtctctactaaaaatacaaaaaaaaagctgggtgtggtggcacgcgccggtagtcccagctacttgggaggctgaggcaggagaattgcttgaacccaggaggcagaggttacagtgagccaagattgtgccactgcgctcccgcctgggcgacagagcgagactccttttcaaaaaaacaaaacaaaacaaaaaaacatggcacgccaggtttggtggctttttcctgtaatcccagtcacttggaaggctgaggcaggaggatcatgtgaggtcaagagttctagaccagcctgggcaacatggcaacccatctctgaaacaaaaacaaaaaaatggcacctgtctttctgagatttcttgttctgcttccctccctcattttatttggaccatctctgtttcatatctttagttcctttcttgctcaatgttaatttcaaccccagggttttttgttttgttttgagacagagtctcactctgtcgcccaggctggagtgcagtggcgtgatcttggctccctgcagcctctgcctcccaggttcaagcgattttcctgcctcagcctccccagtagctgggattacaggtgcacaccaccacgcccggctgatttttgtgtttttactggggatggggtttcaccatgttggccaggctagtatcaaactcctgacatcaagtgatctgcccgccttggcctcccaaagtattgggattacaggcctgagccactgcacctggccagttttttttgttttatcacggcttgctcctgtcctgcaagagtcctggctggtccattttcagagttcacagaggctcaactgtgggccccttcacttctgactgtgggctccttgtactcaccttgtattcaatattgggttggagaaaatccctcacagcgttagctgcagttctcaagttgactctgctgtacttgccagtgggtaacctattcgctatatggaaatttttttttgttctcatgtccattacttccttttggcccatccacataaatattgataaatattgataatgctgttgccatacatgtcttaaagcttttggtagtttgttcctaccttcttgaatgttcctagggataccttatcacttgtaaatgttttccatgggtttatggttttgccatttagttgctctgtttttatatggggaaatgaagattaaaaatctatgtggtggctgagcacagtggctcatgcctgtaatcccaacactttgggaggctgaggtgggaggatcgattgaggtcaggagctcaagaccagcctgaacctggaaggtcaaggcttcaatgagcagggtgattgcaccactgcactccagcctgggcaacagagtgagaccctttctcaaaaacaacaataacaacaactatacagctgtcttcccagaatttgcctctggaccagtttaaatgggttggagtttctttttcttttttttttttttttttttgagacagtctccctctgtcacccaggctagagtgcagtggcactatcttgactcactgcaacctccgcctcctgggttcaagtggttcttatgcctcagccttctgagtagcatgttccaccatgtgcagctaatttttgtatttttaatggagacggggtttcaccaccttggccaggatggtctcaaagtcctgacctcaagtgatcttcccgcctcagcctctcaaagtgctatagtcatgagccactgagcctagctgagtttctttttcttttcttttttttttttttttgagatggggtctcgctgtgtcacccaggatagagtgcagttgcacgatctcggcttactgcaacctctgcctcccagattcaagcgattctcctgcctcagcctcccaagtagctgggactacaggcgcatgccaccgcgcccggctaatttttgtatttttagtagagatggggtttcaccatcttggccaggctggtctcaaactcctaacctcgtgatccacccacctcagcctcccaaagtgctgggattacaggcgtgagccactgcgcctggcctgagtttatttttcttaaaggtaatttctctgtcaggttacaaattcttctggagtcatttttgataatttacgtattcctgaaaaattacttcctcctgggcctcaaatttattaaaagtgagcaaagcatttttgtttgatttttgatttcttctatatctgttgttactgttccattttcatttattattttgtgtctgttctcccttatttcttgattcattataggttattctactttctcccccccaaaaccagctcttaacttaccaattctaatttcttgagttgttagatgcttaatttttttctttttattctttcttgaccattcatataaataacagcctttgaattttcttcttagagctactttagctgattaaaattctgacataagttctgatttgtcatttttattgttttctgaatactttgaaattttaggtttgatttactctttaacccaagaattctttgagagagatttaaaatttcccccagcaggtagggattattgttttctagttttattactgacctccagttttttgtggatttattgagattttcttggctacctaatataagattacaatttttaatgttctgcgggagttttaaaagaagatgtattttctgttttataataagattcccacatatcgactaggtatttttaataaagttttttcctttttttttttggtgtggcagtccatttactctgtgtagaactgagaaaagttcccagtaatgtatttcagtttcatctcatattttctgtgtttttgcttctgaatgtcaggatgtttgaatagtatttattagtactaaatctgcattatgaactacagtttttatcatcacgaagtacacttcttgtctggtattatcacgaatgcagctttcttattatatttgtttggtattgtttctaatcttattatttatatttgtttggtattcctttgtctactcttttattttcaatccttctgaatcattttattttattttattttatttatttatttttgagacggagtctcgctctgtaccccaggctggagtgcagtggctcgatctcggctcaccttatgctccgcctcccgggctcacaccattctcctgcctcagccgccggagtagctgggactacaggtgcccgccaccatgcccggcgaattttttgtatttttagtggagatggggtttcaccatgttagccaggatggtctcgatctcctgacctcgtgatccacccgcctcggcctcccatagtgctgggattacaggcgtgagccaccgtgcccggcctctgaatcattttatattagttacatcttttttttttttttttttttttttttttgagacggagtctcgctctattgcccaggctggagtgcagtggcgcgatctcggctcactgcaaactccacctcccgggttcaagcgattctcctgcctcagcctcccgagtagctgggactacaggcacctgccactgcgcccggctaattttttgtatttttagtagagacgaggtttcaccgtgtcagccaggatggtcttgatctcctgacctcgtgatccaccagcctcggcctcccaaagtgctgggattacaggcatgagccaccgcgcccggccagttacatctttttaaaacattttagccaggtgcagtggcttacagctataatctcaacattttgggagaccaaggcaggaggatcacttgagcccaagagttcgaagccagcttgggcaacataaggagaccccatttctagaaaaaaaatacaaaaagttagccaggcatggtgatgcgagcctgtaatcccagcttctcaggagactgaggcgagaggatcgcttttgcccaggagatggaggctgcagtgagccaagatcgtgccattgtactccagcctgagtgacagacctcatctcaaaaaaaaaaaaaaaaaaaatacacacacacaaaacattttagttaaattaaaatgtaacttaattttaattcagatatcagaaaattttttcttagatttttttgtttgtttgttttttgtttttgagacagagtctcgctctgtcgcccagactggagtgtaatggagtgatctcagttcactgcacctctgcctcccaggttcaagcgattctcctgcctcagcctcctgagtagctgggattacaggcacatgccaccacgcctggctaatttttgtattttagtagagacggggtttcaccatgttgttcaggctggcctcaaactcctgaccttgtgatccacccacctcggcctcccagagtgctgggattacaggcgtgagccaccacgctcggcctagatttttttatgtagcatgtatttggattttttttgttatttattctggaggttgtactttaataggtgagtttagctcatttttaaaaaaattgatctatgtttggttttagtgctgtcatcaaaagatctgctagagtttgtttatgtggccttttttttgcctttacatgatccattatggtttcacttttgtttgtatcctctgataattttcaaagctttgtgtttttaccttgtggattggcttttaactgtaacataaaatgtatacttattttgtctgtcaacttttcatttaagattttaatcctatagaaaaggagaaagaattgtacgatgaacatatatgtttcgttcaactggatttaccagttgttttcactgttctttaaaattcattgctttttttttttttagaaaccagtctcgctctgtcacccaggctggaatgcagtggtgctatcatagctcactgcagcctccaactcctggactcaagtgatctttcagcaccaactcccaagtagctaggactacagatgtgcgccaccatgtccagctaatttatttatttttatttttatttttatttttatttttgaaatggagtctcactctgtctcccaggctggagtgcagtggcgtgatcttggctcactgcaacctctgcctagcagatttaaatgattctcctgcctcagctgactcccaagtcactggtcgtacaccaccatgcctggctaatgtttttgcatttttagtagagacagggtttcaccatgttggccaggctggtctcaaactcctgaccccaagtgatccgcccaccttggccacccaaagtgctgggattacgggcatgagccagctcacgtggccagcagcaaacttatttttatgtttgtagagacgggttcttgctgtgttgcccaggctaagctcaagtgatccttccgcctcagcttcccaaagcactgggattataggcatgagccaccccacccagccctcaccagttgttaatattttgctacatttgctttatttctacctctatctacatgtgtattttggacagggaatatttgaaaataactcgtaaaaatcatgattctttgtctctaactattttagcctgtattgcttgaaaacaaggacattctcttagccacaacgccagtgtcacatcctagtgcttcaacattgatataatatctaatatggaatccattttcccagttgtctcaataatgtccattatagcatttttttgtgtgtgtgatccagtcgaggatcatgcattgcatttagtcatatctcttcttttgttttctttagtctacatcagtctccccatcttattttatttttatgaaaaatccaggtcttgtaaaatgtctcaacatttggatttatctgtttcctcatgactaaatgcagttagattttctggtaagaatacatcatacaaccttttcattccatcagtcaagaggcacataatatcagattgtctcattatttgtcatgctaagtttgatcacatggttaagcttgtatatatgtatacacacacacacacacacacacacacacacacacacttttttttgtttgtttttggagacggagtcttgctctgtcaccctggctggagtgcagtagtgcaatctcagctcactgcaacctctgcctcctaggttcaagtggttctcctatctcagcctcctaagtagctggcattacaggtgcctgccaccatgcccagctaatttttgtatttttagtaaaggcagggtttcaacttgttggccaggctggtctcaaactcctgacctgtgctctgcccacttcggcctcctaaagtgctgagatgacaggcctgagccaccatgcccggccagtattttttatgatatcttttgacttcttcctatgagcaatgacaaatatatttctttttttttttttttttgagatggagtttcactcttgttgcccaggctggagtgcggtggcacaatcttgactcattgcagtctctgcctcctgggttcaagcaattttcctgcctcagcctcctgagtagctgggattacaggtacccgccaccatgcccagctaattttttgtatttttcgtagagacaggatttcaccatgttggccaggctggtctcaaactcctgacctcaggtgatctgcctgccttggcctcccaaagcgttggtattacaggcgtgagccactgcgcccagccgacaaattctttttcctttccctcccctcccctcccctcccctcccctcccctcccctcccctccccccctcccctcccctcccctccccctcccctccccctcccctccctctttcctccccctcccctccctctttcctccccctcccctccctctttcctccccctccccctccccctccccctccccctccccctcccctcccgttcctttcctttttttttttttgaggcagagtttcactcttgttgcccaggctggggtgcagtggcatgatcttggctggccccaacctccaccccccgggttcaagcagttctcctgcgtcagcctcccgagtagctgggattatagacatgtgccaccacacctgggtaattttgtgttttcagtagagacagggtttctccatgttggtcaggctggtcttgaacttccgacctcaggtgatctgccgacctcaggtgatccgccaacctcaggtgatccgcctgcctcagcctcccaaagtgctaggattacaggcctgagccaccgtgcctagctgacaaatatatttctatttccatcctttttatttttcttaatacttaaaaaaatgtacttatacctctgttatttgatttagtgattttatcttttggtcttactatggaagatgaggaagatgagaaaatctacatacttatgctgctcccacctttctccctcttctcttccaacatttcttattcgttcattcacttttttaaatgaagaaaaggaaacttaaactgtatccagtaattataaaaatgacccaaaacatccttcaggtctatattttcagtttcatgggtgaaacctacccatggaacttggtgagtttagagtaattggaagagactggctgagagaacagggaaaaaccagggcgtgggaagcagtgcctgtcggcagcctttgggtttgggtttggactgttatttggactgttacacttgtcatctacctcactttaaatgttggtttatgatttttcatggctatccttggtttgacttttctaatcttaaaattttagacagtaatatgaagggtagcattgttttctgagctgcaataacaagtgccagggaattcatttgggaccagtatcaagctgagggccacacctgaacctcagtttttaccagctccttcccttcccttcatggccttccatttttgtgtctagatgtgccttttattcttctcttcaggtctaccagttgctgggcaaacctcagaatttgttaaccaagtgttagagaagactgcagaagggaatcccactggaggccttgtaggattaaggataccaacatcaaaggtgtaatcagcctcattggaccactggtcagaaatgtctgcgttttgtcacgttatccattgtaaattttcattctgttttgcatgtcagttagcattatgtaaacatttacaattaggttacattgttttaagaactaagtagcataagtgaagcatgatccaaaatacttgattattgcattttcagagcataaaccatgattaaaactgctactggcatcagaattgaaaatcatatgtttaagtaaatgttaggtacagattacaaaaatctgttaaagcaaaacattttggaggagtgaaatagtaaaatgccaagtattgtggcagatttatgctctgaaccacacaaaaaaattgaggaagcatttttttaaacagtcggtttaaattgtttttagaattattgctttttgttctaattttccacaaccattaatctcacttgtatatggcacacccagcacttgtgcctgtgggccatattagatgttcattgtcagagctcaagatgatatatataaatatatatatatatatatatatatacacacacacacacaaatgtctgtgcaagtaagaaaaaaaaagcatattctttgtgccttgtattttggggaaactctaaaactggtaatattttgtatgatgaaaaccctaatgagaaaaaacaagatatatagatggaaaaattatggggtttaaatgtttttttgttccaactctttttcagattttttgaatgtatataggactatgttgaaatgtagatatatgccacagagtctgtgtattgtataaaaaacaaaacaaaaaacaacaaaaaaaagatggctctagaaaactcatatttcggtacttgaccggaagaagacaaatacttgcacattattgcgattgttttattttttgtaccaaagacaaatgcaactgatatggcaaactgccagtctaagtaaagttttgcacagcttacatgatactgtatgaatgtatgaaaaaaaaggagaaaaaaaagaaaaaaaaaggtcagggttagggatcttactgaactgtgaattttatttctgtttgggtccaattatctacagaaggagcatccatacatacaaatattattttgctgttcctctagttcgcttccatagtagataagttggtggccatttagatgtcttttatttctgcacttattgtaggaaattttaatatatttcattttagtaagctattgataaaatagtttttgactttgaaaattaaaatgtttatttagcttattgtagtatacttccaccagacaacaaaatagattatttttattgtattatgtatatatatatatgtaaagaaagaaaaaagctaaaaatatctaattctttagttgccacttttccgattgatgtattattgtgcatgtaatattttcaaagatcaacacaggctaaaacaaaaacaatttatagatttttatatttttgtacaggtattttcaaactagcttcttcaaacttaacatgtgacttattcttctatagtttctagaattgagaaacattaacacatttagtttttaggtgctcttttttgctcatataaaacagcttcattagtcagtgttttaactgtgttcaagctttacctcttgatgagaaatttcttatgtcaaggcagcattataaaccttcccccacagatttttccatcctgtctctcttactgttttattctcaaatcttgtgctttgaactctgaaaactggtggcttaaaaactaaaaaaagaaaaaaagcatatttagcaaggaaaaaaataccaaaaatttcaggcatagctgctggaaaaattatctatttctccattacccactgtaggatttcttttttaattatactttgactataaagtgtcaaagtataatttgttcttttcttttactttgttaccccatttgtaagctatagcatatgaagctatatatatagcttgtgaaggtttgatctagaacacccagtaacaaatgaacaatgttgcttacctgcttctttgacatcttaaaaaagaaatccaaggaggattgtaaggattgtcttaccaccttagctgaactgtgatgcacaagatttttctatgtgtttggtggaaatgtacctggtttgtacattcacgctaaacagatgataagctcaagtctgatggtttaatagaatgtaagttcatcgtttaaagcttttcctttttaggttggagaaggcaaaacacaggcttgcaagttggaagtatatgaagtcttgacagagtgtgtctggtaaattgaaaagtgtttcaaactatggcagttttgcaatcaggtgaaaatcacctcatgatattcagctgataaggtttataaaattgcccctttctagctgctctgttaggaattctggtttttgatacttttttcctgtctgcaaaccagaatttgattttttggtcttgcatttcaaaaaaaaaaagactttgaatctgtttagtagattccatatctttgagtttcagtgttttatatgtactacttaagttaaatagttaaaagcttttaaatagttgagctttttaatgttgacactttattttgtacctatttatatatgtatgtatatcttagaaaagcactttgttaaaaaaaaattgcattttatatgattcctgccatttgctgctaaatctgggctggtcagaatgctgcagcgatacttgatctatataaaaacctggcagtaaaatgtagagtgaaagttaaatcctcttgctgttttaactttatcataaagatgacataggcaagctgtgcagctttacattttaaccaggggactctgtggcatttaaaaccgtctagaaatggttgtactttaatgccagtaataatctgcttcctctattgtcattaaaatatatacgtttagtgtatcacacaaaccaatcttataagggtaatgtaaaaaccccaacaattgtacatgttctgtttttgaaaattgtggcatgtatttttgggtgaagatcattagagaagagttctctaaaggttttctgtgttcatacatggtatacagatagctcataatgaagtccagaatcttacttttaagtgaaggcattgtgaattcacctcaagtaaacccattgttccaaagcaattataaactttgactctagtactactatgatttaaaaaaaaaaaaaaccaacaaaaaccttttttcctagtttcagatacactggattctttatagagtttgtctccatatgaaagcatgctgtccagtcgctcttgttaagatcttgtctgagttttgaattgggtgccacacttttccagtcaatataattgcttgttctactgtaccatgtatgattcttgtcctttcctatatccttcatgacagattatgatgtggctttatattgtgccttacttgtacatttaaaactaaacgtcttcattcccttccacttcctacatctttaactttgacctttttggtaagagaatcagaactattacaaaagcatcatgaaggatttcagatgggtatggtttcaaattccctctctttatagttattttatatttgtatgaaagaccagttttggatggtctttgaatataggggggaaagattagcagtaatttcactacatcccttttctctgactttcatgcatttctcatacatcttctttctgatgcttgactttatttgcttcctagcaatagtctgcatttaaagaaaggtgtgttcaattcatcagcttgaaattgactatttcatttttccaggattttttaggagaagagtacccattttgttttataaaaacagatgacaagtctctttaaaagaaacagaagtacagtacttttgaaatacaatgctgttagtttggatttctttttatatatatatataatattcatacaatgatctgatgtttgccttcattaataaagctgttagtttattcaccaaaatgtcaagaatggatgtgcttttctttattccacacatttaaaaaaatttagctgctaagatttaatgttataagaaatgaattcaagttgccttcagcaagaattaacaaaaacttatgttccctttctttatatagtttcctaaaattctgttcaagtattttctagttaattatgtaacagaatgttagcatctctccatatcttgaaacttgaattttgagaatgcattgaattatgctttcagtgttaaagtaaaaggtttcaattatccttctagtgaagtctgttgtggaataccatttcccatggaactgaggccatttccacaactttgcacagaactgcagtcttgttcttcccttggatcatgacaaataagtctcacacagtgccgtaatacttgtggattcttttgtaatctttgtaatcttaataagggcattatgagaagacgactccatgtttttttaatacttcaaacacattgggatgtaacaatgaatgtcaactgtaggaatggtggtttcgttttaaggaataagcatgttggggaaagatgatgaaaatgtactactgaaagttatacacttccataggcaaatgggattatgtgttgaagcatagtcctcatgcttaataaactgactgaaatcgtagaaattacacctaggaactgagctaggccaaattgccatttttgtttagagagttttggaggtagtagtgaggggacagagccttaaaactacttccaaacagtattttggaattgaagacttggtaactagtgaagaacatcaaagttgggtatttcaatgtgccaagtttgggtgaactaggttcggtttgcctctttcataacaatgtaaacacaatggtgtagttaattaaattctgggtggataggagcaggactgattactatgtcttgcccttcgccctttgtttttttcagaaccaaataacagaaatgtgtatgtgtgtactgtatctgcctttccaccacatttttatgacactgtattccactgcctgcttttttaccttctttccctaggatttgtcctacagcttagtattgtggttgacagcgatactagggctgacagcacagaagtcacaagagaagagtggaagggcaagaattcaaagcatttgttcatacaatgtggcaacctcttttgcatagttgcgtaggatcctgtttgtaatgctatcataaatattctgtagttttttttttttctctcccaactggagctatgacactttttattggattcagtcttgtctcttgtctagaaagaactttatcttgttgacgcatgagctgtttaaaaattatcctattaaatgttggttaatagttgtgcagtttttcatttcagatggaaaggcaatgcaaattttgcctttgttttctgtcaccttccaacccctgagcacttctagtcagatacagattcatcagtgtatgcaacatcctttgtaatttaaaataaaaaaagatgaaaagaaaacgtt

SEQ ID NO: 2468 - DNA, 139582 bp, Homo sapiens
ggctcagggcagcgcggagccgctagcgtctcccggcgcggctgcccgaggccggcgaagccatgggcgccgggaccccgccgccgccgccgccgccgccgtctggccccaggtagggacaatcccccgccccgcgcgcgcaaagagggctttagtcctgcggaacttggctttggggcgagctttcccccacttctctccgagtcgcctacttttaagtttaatttcttgatttgcttttgccctgaaaaaaaaaattagagacgcaattcaaagtttgatgacttcgggaaaagtcacgtaattcaacaaaggggctctaaaaggggcaaaactcgggtggggggaggcggacttttacagattcccaaaaccaaagaccaaggcgtttgtaaagcttggcgtttaattggttgtgtgaaacatttttgcttttaaatccctaactaatgaactttcaacggtgcatgcgaacttgaaaaaactgcaagagattttaccttagatctgtgccctcctcccccattttaagtatgttttttaataaaaaggaaatggaatgtgacctctgctgtttctttgaaatgcccttgggtcccggtatttgccccccaggggtgctggcggcctgggcagtgggtaggggtgggggaagaggtcagggtgccaggaggcctcacgtagtgaaaagagggtgccaggtgcaaacagttaaatagtcacaaactgtttgctaaatatttaataattaggcaagcatctcccagcttggttacttaggttgcattgaccttggcagccctgatgaggcgagattttcacaaagtactggtgaagaatttttccggtgataaaaggcaaggatcaatgctttttaccccagcatggcaattgaccttaaaaacaaaattaaaactccctgtgatgacttagtacattttatgttactttccatggcagcatagatacctgccccatgatggatatttgccctgtgaatttagagaaagtttgtgctccagaggtggttcaaatcattgaagaatagggcgtttattttcttcctgtcactatttatgggaaagaattacggatggtccttcttgccctggtttgtggatgtccttggtggttgcaatcaagcaagctcttatgaggaataatatctggagaaaagaagagaagcatttgagagttgaatgagaaagaaatggaaagcggttactgcttttaaacataatagagtctatatttgttgcctacccctcccccttccccatttaatccttcagttgatactattttaggaaggataagacagatgttaaagatcatagaccaccttactggtcccagctgtgaaacactgtcaggaggcagataattgaaacaaggtacataattgaaacaatttgaagctcaaaggtaaagttaagttctggagttatttgtatttccctaaagtgtgaagagtcagctaacagcaagctgcctgggtcactgagcagaaatggaacagatgctgagacaggaagggaaggtgtggcttacttctcttcttggcccattctgtgtctatcctctgatcctgctccgtgcatttattcagcaagtatgatcttggtcctcaatggctccggagatttagataaataatgatacctaaagagaaatagggccaatctttcctgtgtttcaaagagctttttggatatctgggattgaagacaaaaccttgcataccaactcaacacgttccattatcctaaacatggaatgattcccttgacgtcccacccagaccctctctgagccggaaatacaacctggctaagctccggccagaatccatttgcagcccaagggcagagcacaggtagggccggcccctttcctcctagaacagcccgctcttggtgcccggaagcccattcacggtgcttcttggaatagacgccagtttccaaataattgaataccagccttccagtagctaggtttcctctccctagactgtgtttcacattcccctagttacacaatttttctggtaaccctgaatcttgggatcttttacagtcttggttaaatagtaactagtacctatgtcctgcttttctttcttggtcattaggcagattttctttttggtcattctttttggtcattagattacatgcttacagagagactttgtaggtgtgtagaaaagagttgagttaaaggggtcatcctaggggaagccgacttggagtcttcacctatgtgcaggtcagatgtagtctttctcgagtgcctgctcttaaccattgagccatcctgtgtctccagttgtagcctttcttactctgactgctatttaagagaataaactgaaaatgaaatcgctcatctacttgtacccttttcacccgagaatatcatagtcccacagaggttagttaaaatcttcaggactgtagattatcaaataatcctttcctaaaacatacgtaaaacaccaagccaatgaatacgtgtcctgaaacagaaaattaaaactctgactcagtgttgtcaggcattgtagaaaagatgttccagagctgcaatgaatattaacaaatgacaaaaggaatattgtatctcactcaaactttatcagaagtgctgaactctgttctgttcagtgtacaagtggttctacaaaatttaataaaaccctgacctggccttggagacatcatgtgcgtagacccagagacaccagagagtcgatgagtttctggggacacagtccttgtcttcagagatcccaatatcttgggagaaaccattgaaggatcttaagcacagcagatctctattttagagagttcatgcaggctgcaatgagaatgaaacaggaaagatacaaccaagaccaaaggcagctgcggcaaaaatttaaattagaggagagagagaagtgaactgattcgaaagatagttaaagaagcactggtatttaagattttaactgtaagaacccattaattgacttgaatctctgacgtcaatttacatgtcatttcaaaatacattttctctaggtagataaatgtaagccacatttcattgcaatgttcatgtggattctagttcctctagagctcctcatggtttttaatcacagaaaaaggtttctgataaatagccaattatatttcacattttcaacaacctagtgcttctttctacagacttaaatatctacatctgaaggcaaagctgaagtaaactgttgccctcatattatatacacattctctgatttagcttaactccttctgggagtaaaaacaccctgacatttgattgtttaacactagtggaaatggacagtagaacagcctttcttttttattgttttcagttgaccacaacatggcctgctgtatgtcacagagaggactgtattatatttgtaagagtattagtgacgtgtgagaggctatacataatgcctgtgaacaaacaaaagtcaccttggttattgactcattgccgcatgcatagctttttaatacaatgtgtatttggatgtattttaaatttattcacttgatcactagttgtggagtagatgtctacacacaggagttttgaaatttgattttggtgttgttttccctcatttgataactgagtatcatatatcttggttattaacgtgcaataaatacaaagatttgattctgtatagctgtgaaatagtactgcttttatttggtcagattgtcaacaaccttagtcctccagaatatgtattgtaacctagaaatgcataaaagaagtccacctgcaccttcaaattgttgttaagagtcacatacttaagattcccactagaacttatttggcattatttcatttctgattcctaatgagcttggctacctgggttcctggtccacagcaagatctactttatagtttcaatgtacagctcttgtgataagtatgaaatgtggttacagccaaatgctaggcagcaaagacaatacagtgaaggtggtctgtgattaaaccctaagtctacaagaaaaacattaaattgtgttcaaaactatctgttagaaaggaagaagtactgccttttggtaaaaaggacccttgatcctttttagagctggaaaagaaccttaaaagttacttggtctaaccaccttaatttacaggtgaggaaactgagtctcaaagaggttaattgatttgtccaaagtcatacagctgcccattggaaaaactgctgggactggaatctcagagtcccaattcctggtttagtcatgttcctacttctgactaaaaagcacaaatgttagtactatgaaaaactcattctatattaagtataatattgtccaaaacatagccactgtttattgagaaattacttatatattcagtatcagttatctattgctgtgtaacaaatcaccccacacgtaatggcttaaaataaccaccatttattgagcttgtgcttctgtagataagcagtttgggtgggcttgggtgggcaaattacgttcttttccagtttcctccatgcatctgtggacaccaaggcagctctgcctctgagtattggcggaccatcggccatgtcacgtggggagcagctgagcctcacgtctttcatgatttagcagcctagcctgggttcatcacatgttggctcaacttggttgcaagagagaatggaagcaacgccccttgaggcctaaattcaagctgacacaactcacttctactccagtctatttcaaaagcaactcgagaagccagctcagattcaaggggtggagaaatagaccccactttttaatgggaggaactgcaacgttacattagaaaatggcatggattcagggagggatggagaatcatggcctttttcacaatttataatatacacctcgtaccttatgtaacttgtctaacttaattctcacaatagcactgaaggttaaggcaaaattcctattttacaggtgaagaaactgagaaccagacatgttagtctggattaggcaggacagatggtgagtgatgaatccaacactgggacttgggtgtgtctgactccaaagcctgtgctcagtaccacgacggagctctgcctccctacataatgctgcagtgaagggtggtggtattactaagtattatacggctcagagttttgcgtgaaaaaaaaatcaaactttagtaaaactttttcatgatttatatgctaagagaaatatcaaacatgattatgccctcaaagaacatatggtctcatttatatatggttgcagtgtgcacacatgttatttaagcaataaaattccaagtaaagagaagtaagactggataatcagagaagcttaatagaggatgaagtgatgagttcaggggagccaagagaaagccctatttagaatagtatctgttaatatctcaaaagatcctcacgtcatttatataaattaagtaatattcccattatacaagggaagttatttgcccttagtcacacagctaaaacctaatcaagatgacatttaaacccatgtccatgtatctcaaaaaactattccttttccatttttttccaataagccagtaagctttggtcctcgaagtgaggtccatggaccagcagcatcataaccatctgggagcttgttggaaatgcagagtcctgacttcacctccagtctactgaatcagaacctgcattttaacaggatctcccagatgattgcataaccacagtaaatgcagagccctgcactaaagggagcttggagaaatgacttgtattaagataggtgaaggagggtggaagagctttctttcttttttttttttttttagcttggtttttttttttaattttattttattttaagttccaggatacatgtgcagaacgtgcaggtttgttacataggtaaacatgtgccatggtggtttgctgcacctgtcaacccatcacctagatattaagccctgcatgcattagctatttatcctgatactctcctccccctgccctccctacagccccggtgtgtgttgttcccctccctgtgttcatgtgttctcattgttcaactcccacttatgagtgagaacatgtggtgtttggttttctgctcctgtgttagtttgctgaggatgatggtttccagcattatccatgtccctacagaagacatgatcatgcttcttttttatggctgtatagtattctgtggtgtatatgtgccacatttgctttatccagtctgtcactgatggacatttgggttgattccacgtctttgctattgtgaatagtgccgcaataaatatacatgtgcatgtatctttataatagaattatttatattcctttgggtatatacccaataatgagattgctgggttgaatggtatttctggttctagatccttgaggaattgccacactgtcttccacaatggtggaactaatttacattcccaccaccagtgttaaagtgttcctatttctccacagccttgccagcatctactgtttcttgactttttaataatcaccattctgactggtatgctgtggaatctcattgtggttttgatttgcatttgtctaatgatcagtgatgagctttttttatatgtttgttggtcacataaatctcctcttttgagaagtgtctgttcatgtcctttacccactttttgatggagttgtttggtctttttcttgtaaatttgtttaagttccttataaattctggaaattagacctttgtcaggtgggtagattgcaaaaattttcctccattctataggttgcctgttcactctgatgatagtttcttttgctgtgcagaagctctttagtttaattagatcccatttgtcaattttggtttttgttgcaattatttttgacgatttcatcataaaatctttgcccatgcctatgtcctgagtggtattgcctagattctcttctggggtttttatggttttgggttttacatttaagtctttaatccatcttgagttaatttttctatgtggtttaaggaaggggtgcagtttcagttttctgcatatggctagccagttttcccagcaccacatattaaatagggaattctttccccattgcttgtttttgtcaggtttattgaagatcagatggttgtagatgtgtggtcttatttctgaggtctctatatctgtgttggtaccagtaccatgctgtgttggttactgtagccttgtaatataatttgaagtcaggtagcgtgatgcctccacctttgttctttctgctgaggattgtcttggctgtatggactcttttttggttccatattaattttaaattagctttttttctaattttgtgaataatgtcaatggtggtttgatgggaatagcattgaatctataaattactttgggcaatatggctattttcaagatattgatccttcctatccatgaggatggaatgtttttctgtttgtttgtgtcctctcttatttccttaagcagtggtttctagttcttcttgaagaggtcctttacatgagggtggaggagctttctaggcagggagaacagtgaaagcttggacgctgggctggaatcaatgccacaggtatgaaagcaagtggagggattgctggactagagtaggggtgcgtttttggcagtaaaaggaagttatgtgagactgatggaatcgctgtggagcctgatgaagtctgcttgttagaaaggttaatcgggcagtactgaggctggcctggcagcagtgaccctggttgttgcttaggctttgctgtcctttagctgtcctgtgaagagaactcagaccaaggaaaagatggaggaaatagaggagaaggatgcaatctgggaggcatttcaaagcaccttccatgggactcgatgccagatcttctaagggaataaagagagaatgtgaacatgattctggactgtcaagttctgaactgtgcttcccaaccttcaggctgggatgttatctttgcaattctttgctactgtaaaagaaggatactttttggtgattgtggttttgttgtttgtttaaaggcagcttcccccattccttttcattatagcagtttttcagcttttgctaagaggtaattcaaacatttaaattccaaatctgtatgtccatgtaaatagtggggaaatttttttggcaggcaattatttgtaatgaaatagttctttatgtagttctgtttattaggccttcccaacaaccctgtgatatctatgtaggtaggattatgatgatcatttcatagttaaggacacagacttggagatgtgattcagccaaaacttgaacccaggcctgctggctccaagcacaattctctatctgtccaactaaagcactttgcaggttttctatttggtctttggaggagattatcaaactgatcagtctttggtttactttggtttgacttttttcatatacactgtgccaaattcagaacgatgcttcaaagtttatattggtggtttgaagtaattatttcatggaaaattgaaaatgcctcattaaaaactgatttcctcccctgcctgattttcttattttattgaatccatatgttgatcccaatggcaacaaaccacacttcaaatttcaaatgatgtgagcaattttgccgtccattcctttgtttctttgaatgatgaaaagatttttattttttttcaattcaatttctaagcctatttcttaagcaactaagctgaggctttaaaaatgtccatagatgaggtcaggagatcgaggccatcctggctaacacagtgaaaccccatctctactaaaaaaatacaaaaaattagccgggcttggtggcaggtgcctgtagtcccagctactcgggaggctgaggcaggggtatggcatgaacctggactgcactccagcctaggtgacagagcgagactcagtatcaaaaaaaaaaaaaaaaaaaaaagtccgtagatgacagaatcatgacctggaaggggtcttcagtggtccaaacccctcattttatggataagaaaactgaggcctaaagagagaatgggacctcttaaaggatctcccataagttggaggttgttgtagggctgggacccatgtctataaccttcctgtcctgtgctttttcactcaaccacttcagagctgttcctttccctgtggcagcgtctcccagccactggtgagcagtgtagggaagttgaaagagttcacattttaaagccgccattacctgggtttgaatcctggtttgctggctacctggcatgtgacaaacgcatttaatgctatagtcatttccaaagagaataataaaacagagttaattggctagaccgtcaagattgcagttacaatttatctgcattctcttttaaacttgacaagacaagttttatgatgctcaccaggatttggttttggcaaaggaagccaagtgttctaggggtggacatagtaaaaatggaagagatccactgcagcccaggcagaggccccaccaagcctgatccccctgctgtaaaatgagttcaggcactactgttgatgccatgcattctctgttggaagataaaacacaagtatttcctggtgctgcagcacagggctaaattgtggcgctggggaggtgagcctgaaaacaaaggcagatagagaagtcacagctcactggtgagggagctagagagttgttttcttaataccctctgcctttgaatctgcctagattcaaagatttaatggggcaaaaggagtgttacttttatataaccaaaaaaaaaaaaaactaaaatagctttagagaataaaattactgaaactgcaacccttgacaggcaattgccctttaagagttaactagacaaacaagcaaaacaagctaacaaatacaaactcaagaatccacggctggagcacatcgcaggtcccctaatggcaggtatgactaggcgaggcacaagtacacccgcgcccataagtcagaaattatgagattcatcctcccaaacacagatgacagcatcatatgcacatttgtttgcattaaatcagtactcacctctgcaggtgcttaccctctattcagtttaagtgagccctttggaaagaaactgggtgtgggggttgtattttcttccatcactaagccatttgttccactgtacttcttgtgtaagtctcaaaagaggagaagctatggcccacttggagtcaggcctggctgccccagaagagacggtaatgagggctggactctcatcgggtttgaattttggctctgccatttgttgtgggacctcagaaatacttaaaattcctggatttcagtttcctcatctgtaaaactgggacgctaactactcctggatttcagttttctcatctgtaaaactgggacgctaactacttcctctaatgtgtgtctacctagcacagcccgcccttagtaaatgtttaaataatctgagtctcagcctctatggcctcccattttctcaaatgtaaaatacatctggactagagcagaatgggaggtacaggatggaaagaaagaatgagggaggggctcaaactacacacaccttctcctggctcccctcgtcttgaccttatataaaagccacacgaaatagcaggaagctttcaagcttaaactcttgggatttcccctgaatttctaactagagatgtaaatttcctcattatgaaattgtctacttaaatatctgtccagggatagtttcaaatgtttctaaatataccccaagcatgtaaagaacttgttagggtaaaacctataatcaattccatgtttgtattagtgtgaggcagagaggatgccaaggactgaatttgaggaaaggaagcaacagtggagttcacagagaaagcagaacttatttacatgctgaaatgatcacagtataagtagggagactaaagaaaactgtaaaatatggagaaattaaagctcaagaacgtgaccttttcttgattctcagttccatgaagagttttcaaaataacaaaggtggcatttataacatttaaaagagagggccgtggcctcacttttcatatttagtatattctccattcttcattttgtgaattggagttttgaaaaaatattactgtaaaatgttcttatactggagggcccattccaattagtgaacctagtgccacaaaaagctttttttttttctatcaatgtgtagaataaaacctaaatacccttttattgaacaagcatctgcggaggtcaagcaccgtgccaggtggtgaggatacaaaggtgaacaaaatggacctggacacaatcttggtgggagacaggtattgatgcaataaccatactggtgtggatggcttccctgaggaagggatgtccagctgggatccacaggatgagtggactcttacccggcaaagggagccccagagaggggagggcgaagggcatgctgatatggcttggggggatggtgttctgagaaatgtcttgagcacgaggagtaccaagagaagtagacagtagcttcatcctgcaggccttgcagaccacatgctaaaaaccaacctcagctaacctggtccttcatatctaccaggtccctctcagtggatgttaaaaactccagaatttggaggtgggtgaggataaagaaaccatcctcacagcctcaacacttggtctcgggttcgattcaccctcacaatccaagtttgattagtaagcaggaataaaaacaatcatacatcctgtcctgtaagcttggtgaggcccctccttctattcttttggtttctccaactgtatcttcatggaaagttcatgaaagacaaatgtgacactcttctagaagaagagttgaggtcacctaagagcttaatttaagcagcaagaatgctttgaaccggccactgaatgagccatttctcagaaacaagcactaggaacattgggaagggtaaaagatactggattgctgtaatcacattgttgatgcaagagtgggagtgcctctcactacactatttctagccagtccacactcatacaaaactgatttcaccaaggaaaaataacttctaacatccattttgcaaactcataaagtcctttgtgttgagtggaaataatgaggctagcatacctgtacaagccatctctgccttctgattatatttcgtttctgaaatattatatttatattttgaaatatatctgaaatattaatgaaatataatatctgaaatatatttcatttctgaatatatattcctgttggggcaactcatttaatctacatcctaaagcacagattaaaagcacactcataaattccaaactgtctacgctgacataccataaattagcaaattgcagacaatacaaccttatagttggtggtctttattttaagaacagtgagaagctattgaaggttttaaactgaggagtaataagatttgcatccctggctgctgtgtaggaagaaggcaagactgggagagaagagatcaattaagggactattgcagaagaagatgttgattctcctcttgaataaagtagaggcaattatagagtgagaagtggatgggttcctaggatagtcaataagatcaccagtacctggtaatgggataggaaatgggaagtgagggaagaggtgtcaagattgaatattaggacttgggtatacaagttttcttgcagtattgtttgtgatgaaaaaaatccatatatcatcaacatatacaatatgtaggccaagcacgctggcttatacctgtaatcccagcactttgggaggccaaggtgggcagatcacctgagttcagaagttcaagacaagcctgatcaacatggtgaaaccccatctctactaaaaatacaaaaattagctgggcatggtggtgggcacctgtaatcccagctacttgggaggccgaggcaggagaatcgcttcaacccgggaggcagaggttgcagtgagccaagatcatgccattgcactccagcctgggtgacacagtgagactccatctcagaaaaagaagtacagtatgtagatacagtgcagtactctgcactgatttaaaaatgagatgtatgtgtaatgacatgacagaaatattcaggatatagtcttaagtttttaaaaacttgttgaagaaaaatgcacttagtgtttcattttaataaaataggaatgattataattagctcttaacagaaaatagctggaagaataaattttaaacaaataacagtgaagattataggggcatttacaaactatatttgacatttctgtactcgagtttttgcaactctcatgtttacttttgtagtcagggaaagcagactttgcagaagagcaaactgcccttcttctatcatagaatcttctgatcctctgtcctaaaatgattgctccctcttccgaatatcttctagattgttagagccaaaaagggctttagagatcatttagttctacgtcttcatttcacacatgaggaaactgaggtctagaaggactaatggggtggccaaagtcacataaccctaaattaagagcaagaccaagactagaaccaagggatatactggcttgtggtctagaattctttctcctacaagcaaagtctcctctagcactcactgtatctgtgaataatttggctttacttggaaggcctcataaataaatatgtctttctcctccagtaaatttgtgcttgaactcagagtcagtgtccagtatcacgttcatgcattgtgaaacatgcagtacaacaattgacaggcttcagttagatttcagatctgaggcaacactaaaatttggggaaaagaaagactcccatttgtggtttgtacttacacagcactctcaggagctcgctcatgttctctctctgtctttcacacatacagtaggaataagttagttgcctaattggttatgctggggaaatgaactttgggttcagggcatgtcagtaggtaccttcccacttgcaacaaaataccaatatcccgaacttccggaaggaaatggcatggccgttcaactttaatctgttgataatgtcagtaatttcccacaactatattcaacactttctggtcctacaattctcataggtccttttcacacagtgtgtctcagggactgtttcatatctcacagagacacagccaaccctggcttgactatgggcgtggagcagtgtttcacattgtcaacccctcatgttgtggggttcagccagatggaggcttttgaatcactgttcagtgatataaacctcctcctttgaccgaaatgagaaatgatggctactttgtcccttgccttgtagctccccaggggcaattagggagttgccccagcctgcaaagggctgtgttaggatctcacctctggtgcctcgtccttttcttctcctcccctgaagctaatcatgacacttttgtctctactgagctccacttggcatctggtgttcatcgtctaaatgagctgctatctctaggaaactattctgctctctgcctcccattttgcaaatttggtgtgtttgtttccagtgttttattaatttatttcaactgaacattttccatatcctaaacattgacattatttacgttaccatctgcttgatgttttagactctgtatacccccccacacacatatgtttgtgtaagattcagttctaaagtctttcaaaccagttttcttttccaatagttaattctgtgcgggttcacaatgccttaaatatttaagtatccatgtaatgcatttatattttttatcttaaaattcggaaaaaacgttaagcctcataactatgatattcctttaaattgtattaaactaggattttgatatacagtcatgtacctcataacaacgtttgggtcatatacctcttatacaatgttggtgccttaagattataataccgtatttttactgtacatttactatgtttagatatgtttacaattgcctacagtattcagtagtatagtcacatgcggtacagatttgtagcctaggagcaacaggttgtaccatctagcctagctgtgtagtaggctctaccatctaggtttgtataagtacactctgatgtttgcacaaaaacaaaatcacctagcgacacctttcttggaacatattcccattattaagcaatgaatgactaaatgatatagggagaaatttaaagcactaattattttctcctcagtcagctgtaagtctgcctttcagtaagcttacattgttcttttcgcaaatgcagaaatttatttctcaataagcttcttgaataccaacttcacatagagactgtgtagtagtcaaggagagaaagcgtggaagagcagccagtagaccctcattgcaagtagaacaggaaggaatgtgactgaaccacaccccagtggatcttagaatcagaaaattacaagacaacacatagaaaattccaagatgacaagattgttgtgccctggagggttattaaaagagttggtattatctctatataacccagacctggactgtatatgtgcaccctcagaagtacctggaaaattttatgtttctcatttcgttcagctatgcccagaccaagcaataatctatcggacttatattattcttggtatgacatatagttactgaattttctagtgaaatgcaaaatatgttggatggacaacaggatgagctatttgagtcagtctgctctgaaactcaaaggttgatgttctccataacttgacccttccatatctgcacacagacccattatctgctttgccacaagaacgctgatcatattctcttccaaatggataaggcaaagcatttttatgccaatactatgacactttgggagatacagtttgtatgcataaacattgggacattttgatattcactgattcagtgataaattattattcactcaacaaatatgtattgaacatctcccaaattaaaactgccatgaaagagttagaacatagcatctgtagatataattaagagctactaccggggaacttgtttatgtttcttaatatctacaaccaacagattagtactttctagccatttgttttttgattcataaagttttgagagtaaagaaatgtaagaaaaaaatcaattacctcacaatcaactgagactgttttcctgctagaaattcccagttggaactgattaagaaatgtgtgtttctgataaaggtacaggtggagccaaaggataaaagggtgctgtgtctttaaatttaaagatattttataattgtccttgaagtttctattttcatttgtttgctttgggtgggacatggaaaatatttgcctactgtatggtactaatcttcatgcatgtgtttgcaaattaccttccctgtgaaaagggtggaggcatttcattggtgatggcttttcttattaaatacttgcaaatgcatgaattttctgcaccaaaagttggtgagttcattttatatctgaaagtcgggtttaagagaagatggctcagaagcttcaaaagtgtgaaactttaggaattaaacattgggttctctagttataaattatcaccggagctaccttagttatatgcttagtattttcattgtaagccagttattttcaaagttttggtgaaccctaatatttattctaaattacattgtttgaagaatcttattttgcttacctaagaagttttttttgagatgtagaaaagatctttaaattattttgagtggctatgtgtggttttcttccataaattaaaacttcgatagttcagaaattattattcactcaacaaatatgtattcaacatctcccatatactaggaagaaagtatgtcagccttcctgaaagcccacagcatatttttcacaaacagagaactttaatttgcaaataaaattattgaattctatactcccacaccacgtacctgatgtttctaaaagaaaaacattaactaaatttcgcagtttatttgagcaaagaaccattcatgaattgggtagcactcagaaccaaaagagattccaagttctgctccacagtgagcagtgagcttacattggctaaacttggaagtaaaatacagaaataacttgattggttacagctaggtatttgccatagttgagtatggtctggtcagttggctgcatctgattggctgaaacccagctatttgttacaaaaaatattctcctaagttttcatttgtttatatactaaattagcttacagtttgttatacaggaattcaaagcacagagacagcctcagtcttttgaccccctgcttattttgctttaacagtatgtaaatgtattctagaatgaatataatttcatatataaacgtaattttattgagcactaactacaagctaagcattatactctgggatggtcaggatacagaagtgaacagaatccctgtaatatctactgggaaagaggaacattaaataatccttaaataaaaatagaatttaaattgtggaacaacaaaggaaagatcaaagaggtatataatatccttaaatgggatcctgtttaaatgatttaaatgggagaggggagggaagggagaaggcaaggaaggcttttcagagaaagtgaagtgctaaaagtagaagaatgaagaaaagttggccaggggaaaaggtggagaaaattggctatatacaattttaaaaaataaagggagacttcattctgggggcaagaaacctggtttctagcttaagagatgctagcaactgcccttgagcctgtcttaacctctggcctcattttctttaagtgagaaatctgagttggatagaaggatctaggatttcttctcttatttgatctgtgattaatatgtatggctaccttatggggaagctctccagtggctccgtctgggctggttcctggagctgtcatcatcttagtccacattctttcggttcttggaaatggggaagctgcatactgcgtgtgcccctggcaggcattggctaggacttgcgacagtcatgcagttaggcttgagcgacttcagcctcctgccctacccatgtccacaaatttatctacatctgcatcagtcctttcctcattctcttcattctcagaggataaggtgttccttttcctgttcaaggccaactttttcatgtggacttaacttttatcttccatcctctgggatattgcttcaccaattaattctgtctttgtcctgaatctatcaactctaaccaaataaaagtgggggtaaggggtgttgaaaaaatttatttcttacaagataaatatgtcttcctttgagcctgttggctactgccccatctctgtttcccttatttaaaaataaaataatataaaataaaatgtcctaaagagttcttgagtaattgctgcctttaactgcaattcccattccagttcactcaacatattgctatttggttttagtccacatcgtgacatgaaaacatcactgatcaattctaatggtcatatttcacccctttaatttaaaaacctccttgctacatttcaagctattgatcttgaggatgtcttcctttttgaaattctccctttcctttgatgcttttatgctattacatttcttattcctgattcttctcctacttctatgaccagtccctatttttctatcatctattatcaagtttgaccctgaggttttcatgatgcagaatccagttgtatgttctatactatctatgagttatgtctgcaaggaagagtgtgcaaagaattctgagtaggattaaatggtaaccatattcattgattcaggtcaactggcaaggtaatctgtggaaggttacagaatcaaagatgacttgagaattagataacaagtaatttaaatcttggggacttagatgagaagactgaacccttcgtaaagtatagagtgtccgttcaagtatacatagggaaaattagatcctaaatcccaggctaacttgctagtgaaaatgcgctaagaaggtaaccccaaattttgggggaaagcaaaattatttccttataatatagtgttctaaccatgggaaaacttaaaatttaagtgtaaatatgatggactaaataaaataaaaatatttatacttttagataagtttggggaaaagtctttaatattttagatattcattatgtttaagataatgtgttaatatgattagccttgtgatttctaatctaaaatatgtcattggatgattgatttagactttgtattttcaagttaaaaatgttaagataattttgctgtatttaatgctatattgaaatgtttaatgtctactactttaaccaagttaaaagatcactcttcagaagattgacagagtttagagaatgttaaatagaatataagatttatagttgatctcaattcaaggaaaatacatttttggatttgttattttaatattaattttaaaaaccgaagtacctgcagataatgcttttgagggttgtaggggacacccagaaaatctccttgctatctcccattcccaagcagtagtgtgtccctggtctttcttctcaccccacagttcttcccagtcttctaggctccctgaccaacctctggcagtgtcagaatatatgcaccactcatagctcaaacatacatgatacccaaatgcctttctccagccctgcccccctacacagctacagatccattaaaaactacttccggtagggcatatctgcttgcatatccccagaccccatccaactcaactcacctgaaatgcagtctatcggtgctccaccttcaagcccactgatgtgctctcctttctgctattgtctcagctgatgacatcatcaagtgctctttcctctctagggcaaagactggcttggacattgctatggtttgaatgtgtcccccaaatttcatgtgtttgaaatttaatcctcaatgcaacagttttgagaggtgggatcctaaagaggtgattaggtcacaagtgccctgccatcatgaatggattaatgccattaccttgggagtgggttcctgataaaaggaagagttctggccctcttcccttctttctttctcacgggtttctctcttgcctttctaccttctgccatgggatgttgcagcaggaaggacctcatataaaataaaagtccccctgacctcgaacttcccaaccctcaggactgtaataaatctctgttatttataaattactcagtctcaggttgctatagcagcacaaagcaggctaagacacttgtcaacgttgcctctctttgaccccctcagtgcctactacctggcaactgtaggtacgcaaaaactcagttgataaatatgaagcccaaataaaagagggaatgacatgaatacctgctttaggatgagtggaaagggaagactccattatcattttggtactagctaatggtttctttgtcaaaagggtaggaatagctaacattcattgagcacctactatgtactaggtactttaggtgatttgtgcacattaactgaaagggttgggctcagagaagttaagtcattcaggatgatgaagctagtaagtgacagagatggtacttagcgaaggtctgtgtaactccagaacctcttcagtgttcccacctctcctcagaatagctattttcacattaaattagatttcctctgactgatgtttttatgcagtggtattactgatataattatgaagatcaagtggcatgtatgcaaaaactcagaatttagggtgtttataaaaaattagtagatttttttcatttccttataaaagacttcacattttcagtcaaaataccagggcttgatcatttcaaagatgaatactgtcagttatggaaggtacatcagcagaatcagctctgctaactttcttgcttgacctactgatggtttaggaaaaagccttctcgagttttccagatactgttagaccaagaaggatgcattttaatcaaactgaacacaaaaggttgggtttggaggaaatgcaaccacaagagtgccttttaagaaataaaattgagaaatcatccttctaacatttcctccttccctcccctttatacagttcatagaaacaatgctccttttttttcctgtggagcacttcaaccccagcacaaaattaataaaagtggtaaaactggaactgctatcttagctacatccaccccaccccatcaccatgaagaataaaccctttaaatacaggctgccaggtacaagctaaagattgagataatgatcctttgcttcaaaataaacattttttaaaaatgagtattctagtctatatatctcattcatgaattaactctgtcacacttaaaactaccctgtttcttttaagatttgtaatgttacaggaaattttgtctagtttctcttcaggaaattataaaattataccacttttagcaacatttatgaattagttatttagaatatcagtcctcttgagctattttgtttaattaggtcacatatacaaatttgaaaattggaaatatcctagataaagatgtaagaattatatatgcagtattacaggatagatttctagaaaggggttctagtgagcagtagcttttgactaataatgtttaactagggcataaggaatttgaattcccagaactgctttttactgtggccaaaattcaaaataatttttatttttgtgaaataatttttcttcaactacaaggaagagaaaggaaaaaaactaaaatatgtattttattttaaaatacattatttaaaataattattttattttacaatacattatttaaaatatattatttaaaataattattattttattttaaaatgcattattttaatcacaaaaactaaaataatgtatctggctctattttgattttgctaaaatcacaaaaactaaaataatgtatctagctgtattaggataatatgatcaatcattcaagagaaactggtctcgttcttgcaagtgtaaggaccaaaaggtaaatatatttagcacatggtttggttctatttatcatcactaatgttctcattttccaaatggaaggataaaaatgataacttacccaaagcagtgaagcagatgtgggactgtttaatctcagctcttcctttaaattgctctatagtcacagaaatcacttctctgttctttagtctattaacagataacatcttgcctattgctgtaatccaaagccatatcccttcagcatcttcataatcattactagatgctttaaatccacatatttcaaataccttcattctcccatcttatctgctcatgtttatgcaggcacctagtagctgttgaaacaggataacactgtggctaaaagcatgtgcttttagaacccctgggttcaaatcccagccctagaacttcttaacctctgtgagcctccatttctttgtctgtaaaacaggaataatcattgtgctaaaacatagatgggatcgttgttggtttagaagctaggaatcaaatcagtatatacatgtgaagaaattttgtatgttaacctctatgagttctgtattaaaaataatttttaataaaacatgttaaaaataatgaatttttgaaaattaccttgcctgcagcaggtaccacagcaggtgtaccacttcatgacggccacccactgggatagctgtaatcagacagatggacaataacaagtgttggcaaggaagtggagaaactgcaaccttaatacactgctggtgggaatgtaatatggtgcatccatgttgggaaacagtcttgcaattccttaaaagtttaaacacagaattacagtattcatcaattctcctaggtaaatatccaaggaaaaaaacatacgtttatgtcacagaaagacttgtacacaaatgtttacagcagcattattcataatatcccaaaagtagaaacaacctaaagttcactgactgatgagtagaaaataatacgtgatacatccatagagtagactattgttcagccgtaaaaaggaacagagtactgataacatgctacaacatgaatgaaccttggaaacatcattctaagggaaagaaaccagacacaaaaggctgcatattgtatgattccatttatatgcaaggtcaagattagtcatacagagatggaaagtagattggtgattgcctaaggctggggagagcaaggggattgggcaagatggctaaagttgatggctatgggatatcttttggcagtgataaaaatgtgctaaaatttattgtggtaacggtggcacaactctgaatatgcaaaaaaaattgaaatactttatttaaatgggtgaattataaggcacatgaattgtatctcaatatagctgttaaaaataataataaagtggcagacttctaaggaatttcggtaaccttctaaacttaaaagtttttagacaagagatcaatagacatctgttaattaccccatcacagatatgccaaccaatccctaggctttgacttcccagtagcttttgtttgggaatttaccttgcctacagtagcagtcttcctgtgggtaaaaacaagaaacttcaaccctggtctttgtttaatagttaggtttttttctaattctaaaatatgtacagattgggaaaaacccagaaaaaatatgagttcaaagcataaattaaagacataaattatcctgtgatctgcgagcagtatccctccctggctccttttcaggttggaaaatctgattttagaacttaggttttagagaaccgagttcttacaccaagtacatacaaaaactgcatctttacaaaatcgtctctaaattgatcacttggacctgaagagctcatctttccaaaggcgatttccagtcttgtatggattggagaatgcccaaatgtactaatttttttatttttattttaaaaacacccccccccaccgccacttactttgtgctgccattagtgatctcccctaccctgccccacaatttacacaatgtttttcttcctatgttacctttggaccaggttatggtcttctttattatttatctagttccaatttccctagcctagacacagccctctgaaaataatggctgataagggaaatggtgcccggatctctaggcccggagccagttcactgggaatcatactctcccaaggctcttaatgtaggtctgacttgatgtgacaagtgaatatagtagcctattctttgttagaaaaaaaaatggattaattatttggctgaagtccgccaaacagaggttggcccttaaaggaacaaatacttcccgttgttttagatcgtccttcaagcaaggaactaaaataatgtaaatataactcagataaagagactctttacgcttctgtttgttcacaggggaaatgcttatttacaatgtgccttttaaaattattttcctgagttggtcttttggtcaaggaaattaaattgataacaagacgtgctgttgtccatagggaatccatttctacaaagacaaataactacaagcaatctcatcccattaactctgtggccactttctgcctcccccctctcaatatttgttacttcttttatcaatgattattttttcatgggaaggtgtcttcttttctcaaatggctataaatttttaagtatgtcccgtaaacatcttgtcatcccccacagtaccttaagtcaagtcttaaatatatcctgattaattatttgccaataggcataggtagcctttcttccttcagtattggcattagtagtctaattacttagtcttatggctttctcaagttaaaatcagaattacactgtctacagcaaagcagaaaatgtcatatctacagagcagcattttcagagcaccatcaaaacattaaacaggctgactaatgggatatgcctgttcatggtactagtctttcaagtcttttctgggtttgaaagttttcaaaatcaaaagatttttaagaaattaaacatctaatttcatctccagaacttagatgcaatattaatatctcttctatattcagcttttcagatgggttctttatttcaaaggatgctaatttatagcaaataactacatgttcctaaggacccaaaaccttttttctttactcttgctcattttatttttttttgtaaaattttttcacattgtgtttcagataggccctccccaaactttcataaattaatgagtattccacagacatggagtttttagtctagaagagttagattcaagaattaatgaaataatcacacaaacgcaaattttcagtaggaacaagtataatatgaatcaatagtagaaagatttgatccaataaggaaagtaaaggaagatttatctgagggaggcagtgggcgctaaccaggcaggaggcacagcatgtgcaaaggctcggtggcaggcagcagcaacacagtgtgaggttgattacaagaagacctatgaatttggagcccaaagaggaagatagttcaagatgagagcttgaaggaatgggtagaaattttttcttctcatcctggaagcaaagggaatctactgaaagatctttaaaaacaagaagctgttataatcagacctaaacttagacaagattacttcatttgtgctgtggagaactcactggaaggcatccaataggcagatcagtcagaaaggttttgcagtagactaagcaagagacataggcaatttggtcattttggtagaaagaagtgaattaattcatgaagtatttataaaataaaagtgttaggcaatgttacagttcaagtttcagtggggaatcagatagaattgaatgattcaaggaatctttaaaagagaaagtcatcagaaattggcagtgcattagaaatgaaaagaggaaagggaggtcgtaagagttaaagaggaaggaaacacgaaacacagctggcaattaaagacaggttttctttagttaaaacctgagaggaggccaggtgccgtggctcacgcctgtaatcccagcactttgggaggccaaggcgggtggatcacttaagatcaggagttcgagaccagcctgaccaacatagtgaaacctcgtctctactaaaaatgcaaaaattagccgggtatgctggcacgtgcctgtgatcccagttacctgggagactgaagcaggagaattgcttgaacccgggaggcggagattgcagtcagctgagatcgctccgctgcactccagcctgagcagagaagcgagactccattaaaaacaaaaaacaaacaaacaaaaaaaactgagaggggctcctagccaatgcggtcaggagcactttctcttacagactaagagtatatatttgttttagggtgagggggcttgtcacaagcttggaatgtttctgtgtgtggagaagttcatggcagggttggaatctctctgggtggaggattattttggggcagacatctttccagcccagaggtgggttatcttaggctagcatcttcccgccccaagggggctttatctcggggctagaatgtctctgggaagggaggagtttggaatgtttctggttggaaatgttatttgtggtttacggtcatgctgaccttagccattaggctgatgccttttggatttaggcagttttttattaaggtgaactttagaataagaggcttatccaagatgatgatgctcctgctctgtcagaggtgtcaaggatgacaccgggtcatataaatcatgctaataatgtgcacgtcagcacattaaaggctctgaggagtcctacagcaaagtaacctggctagctatctaatccagcatttccccaaattatttgaacctagattacccttttctttttctggcaacaattactaacttcctcaaaatatacatgagacaactgagttagcctaagatgggctttttttatttaaaacaatttcaaattttttcacatttttgtttgaaaccctgtgttagtcggctagggccgggtggatcacgaggtcaagagatcaagactatcctggccaacattgtgaaaccctgtctctactaaaaaaaaaatacaaaccttagctggacatgatggcgtgcacctgtagtcccagctacttgggaggctgacgcaggagaatcgcttgaacccaggaggtggaggctgcagtgagccaagatcgcaccactgcactccagcctaggcaacagagcaagacctgtctccaaaaaaaaaaaaaaaaaaaaaaaaaaaaaaaaaaaagaagtccaagatcaaggtatcagcaggtttggattctcctgaggcctctctccttggcttgcagatggccacccttttgccgactcttcacatggttatccctcatactgtgtgttgtctgcatgttctaatctcctctttttataaagacatcaggttggtttaagacctatcctaatggctttgttttactttcatttcctctttgaaggctctatcctcaaatacatttactttctaaggagctgcagattagggctgtgatatggtttggctgtgtcgccacccaaatgtcatcttgaattgtagttcccataatccccacgtgtcatggaaaggacccggtggcaggtaatttaatcatgggggcagtttcccttatgctattctcataatagtgagtaagttctcatgagatctgatggttttataaggggtttccccctttgcttggctctcattcgccttccttctgccatgtgaggaaggaaatgtttactttcctttctgccatgattgtaagtttctggaggcttccccagccaagctgaactgtgagtccattaaatctctttctctttgtaaattacccatctttggtatgtctttattagcagtgttagaataaactaatacagcaaattgatacggggtagtgaggtactgctgtaaagatactaaaaaatgtggaagcaactttggaactgggtaacaggcagacgttggaacagtttggagggctcaggagaagacagaaaaatgtgggaaagttgggaacttcctagagatttgttgaatggctttggtcaaaatgctgttaatgatatggataataaagtccaggccgaggtggtttccaatggagatgaagaacttgttgggaactggagtaaaggtcactcttgctatgcaaagagactggttgcattttgcccctgccctggagacctgtggaactttgaacttgaaagagataatttagagtatctggcagaagaaaattctaagcaggaaagcattcaagagaaagcagagcataaaagtttggaaaatttgcagcctggtgatgcaatagaaaagaaaaccctttttctggggagaaagtcaagccagctgcagaaatttgcataaataataaggagccaaatgttaatcaccaagacaatgaggacaatgtctgcaggccatgtcagagaccttaatggcagcccctcccatcataggcctgaaggtgtaggagggaaaattgttttcatgggctggacctgggcccaggctcacctgctctgtgcagcctcaggacatggtgccctgtatctcagctgcttagttccagccatggctaaaaggggccaacatacagcttagactgttgcttcagctggaatgagttaagactttgagggactattggaaaggcatgattgtgttttgaaatgtgaggacatgagatttgggaggggccaggggaagaatgatatggtttggctgtgtccccacccaaatctcatcccgaattgtagttcccataatccccatgtgtcatgggaggggcccagtgggagataattgaatcatgggggcagtttccccatgctattcttgtgatagtgagtaagttcttatgagatctgttggttttataaagggcttcccccttcacttggctctcattcttcttcctgacaccatgtgaagaaggacaagtttgcttccccttctttcatgattgtaagtttcccaaggccttcccagacaggctgaactgtgagtcaattaaacctcttttctttataaattacccagtctcggatatgtctttattagcagcgtgacaatggactaataaaggctgcaacatatgaattttgtggggacatcatttagcccatcaccaccctagaggcataaacctcttttctagagccagtgccatctttgttcctccacaccctacaccacaggcaaggtctggtggtccagtgtcatgaagagtcatcttatgtctccatcctcagcactcttcatggtgagtcccaatacatgctacggcaagatttctattacttagattcgctattagtaaacctgtaacataccaacaaggataaggaaaaaggagccaacagtattcctgatcacccctatacgcagatatcaaagatggaggtgttagtggaagagaggcagtgcttctggattttttttcctaatgatatgaaaccagcatttcaccttgaagcagaagagcacctaagtccaggtgaacaccactctgctctgcttccctgtgccagcagtccagaagtccagcatccacagagccaggtctcatctatgtgggctgggaggtgagcagtttgtgagatgcatgggaactaaagttcaaattcttacaccaccctccactcagaatgtaagtcatttgacttttctctgtttcttttcctgggaggatggctgagaggattatgttcatggatcattctgcttttaaaaacaaaactgaaacactcttcccacataaaagtaagatcttcactcatcccattaccagctgactagtaaagtaatggtatggtctgaatgtctgtgtctgcccgaaatttatatgttgaaatcctaacccacaagatgatggtattgggagtgtattagttcatttacatgctgctgataaagatatacttgagactgggtaatttataaagaaaaagaggtttaatggactcaccgttccacatggctgtggttccacaatcacgacagaaggtgaaaggcacatcttacatggcagcaaagagagagaatgagaaccaagcaaaaagggaaaccccttataaaaccatcagatctcatgagacttattcactaccacgagaacagtattggggaaaccatccccatgattcaattacctcccacggggttcctcccacaacacatgggaattatgggagctacaattcaagatgagatttgggtgaggacacagccaaaccatatcaaggagatagggcctttgtggggagcatatcatgatatgccagctcccctttgccttcccttatgattatcagcttcctgaggccctccccagaagcagatgctggaaccatgcttctaacagcctgcggaactgtgagctaattacatctcttttctgtataaattaccaagactccagtatttctttatagcaatgaaaaaatggcctcataaaagagacctcagagagttagctagccccttccaccatgtgaggacacaatgagaaggcaccatctgtaaaccagagagtaagagctcaccagacatcagatctgctgatactttgatcttggacttcccaacctccataactgtgaggaataaatttgtcttgttcatcagccacccagtttatggtattttgttaaagtagcctgaacagattaagaaaagtggttagagagtcaaaacagtatggatgtgttatatccacaactcataaattcaatctaagaagtgaatattttatttattatgttgcatgctattttatattctgtattctccactagccccaaagtgattggaactttgacttcaggtttcctatgtttctagtttcagctagtcttttaaatatcatcacatgatctttattggagttaagtcccaaatgaataacaaaccaatgaaaacttcctgcttgttttctgatcaggtattgtttatgttaaggaaggtgctatggtttgcatgtgtcccccaaagttcatgagttagacacttaatccccagagccacagtgttgagaggtggggcctttaggaagtcattaggtcatgaaagctctgccctcatgaatgaattaatgccattatcttgggagtgggttcgttatcttgggatttctgataaagggatgagtttggctcccttcccttctctgtcacaggtgctctcttgcccttccaccttcccccatggaatgacacagcaagaaggccctcatcagatgggggccccttgaccttgacttcccagcctccagaactttaagaaataaatctctggtctttataaatgacccagtctcaggtattctgttgtagcagcacaaacaaagacaggaagagccagaatttttttttttcctcttaaatcctattaagcctcagaatctgcatactgctttttggaacctgaataccaccaattgagtcattttatgaaatgtgtccactgtcttattctaacataatggtcaaaagatgtttagtttgcatgtcagtcagctacttcccaagaagatattgtttgacctggcttttctacaagctcactgtcctgtcctaatagcaggacagggatccatgaaaatagaaggaactgagcagatttccctgaacttggtaggcatgggttattacagctagtctagctctggcaggttccccctgtacatagccagtagttaagcaccgtatcatgaatcaggtttgaattatcgcctctattcatagcacagaataagttaatttgagacggatatgtctttgttcaaggtagacttattgccttattttttcctagtagatatttactaaactcatatgttctttctagtgctgccacgtctataccattgctcctgaaatcttagttcaaatccaacttctgccactttagcaccttgtcattttatccatctaagctgaaattcaaagcctctaactcctactcttaggtgaagatttttttttccctgatctcttctcacatgtgagactttgtgggtatcaggagccatggggactaggcagcctggtaattacattgtttacttcctagtttcacacaaaaccaagtcaatcctgggcctgccaccaagcaccctttagggaaatatatttcaaaaagcttcactgaaaccacttatttattgacattcagagacagttaatcattctgccgagcaagaaacacttagaccaaacaagaaacagcccaacctttcaagcaccgagcctttgtcaaaggtttattgagaaaagaaaggcacaaaagaaccagcgttgccaaactcgggcagccattgtcaaccctttgccaagtgatagtatcatatggcatcagacatgagcttaagaaagagaaaaaaggaggaaggaataagctttctttccatatataaatcagattgaagttactgttcctttttgggactttcagtgtttatcctctttctggaatatattttccttcttcttgcttcagctcaccatccccaaaacatacacatgcacacacatgcacattgtcccataccttcataatatatttgaatgatacagtctgctaaaattactgtcacagacattatcttcatcttggacacctgtttgttctagttcctggctgcctggaagttctgaaaacgtgactcagcctagagctttttgttaaaccataaggaaagctactaatttctctacacagagatagcatgtataaagtaatcaccactgtgatccagaaatggtgatgtctacactgggagtgattgatggtggttattactggggtggagatggtacgagtgacatcttaagatacatttattaaaatgggccaagaaccacatgaaatgctttgcttgttttgaagtaggtttctttgcccaaaggttaaggaaatatttcaaaaaggcaaaaagagattgacccccacacactctcttattttctgtatgaacattttcaagctacagaaaagttgaaagaattgtacatgaactacactcaccacctgaaatctacaactaaaatttttcatatttgcctgatcacatatgtaaccatctaaccatccctctatcaagtaatgtatctttttatttaactgtatttcagagcaagttgcaaacatcagttcatttcaccccagcacttcaatatgcattgcattaactgtaagttttttttatggttatcttctttcccttcttcatcctaccctggtataatttacatacagtgaaatatacaaatttaagtgtattatttgggagttttaactgtataactcaaatttccatcaagatatatagaaaacattatcattacccaggaaaaccctcttgctgtttccaatcaatccttgtccccagccccatggagtcaatgactgttctaatttttaaaaatcaccacagattaatttagcctgttcaaaacttcatattcatgaatcatacatttatatcacacatttgtatgattacatatatacatatgtcctcctttgtgtaaggcttcttttactcagcctggttttgtgttttgttgatgttgcatgtttctttttcttttttattgctcagtagtataatattttattgctcattcttttttattgcttagtagtatttcattgtatgactacaccacagtgttttttactattgttggacatttggattatttcagtttggggctattatgaataaagctaatatcaagactcctgtaccagtctttatgtgcacttttgtgtaaatatctaggagtggaaaattgctaggtcatagagttgttccatagccttcacatccaggccctgttgggcttaaattttcttggaagagcaatttccaaatcctttcaagtccagaatatttttttcacacagcaatagtaaaataagacaataatagttaatttttaggtccaaaatgtatttattttccatatgcttaaaggcagtgtatttcctaaaagactagtttcaaaccagtgtattaagacacattggcatatgaattagtgggagaatcaagatttggaacattgtaggcaactcgagcttgtcacatgatagctggtggccccacagtcatgccatgtgataaatccatgtaggcaacaacaacaaaaaaacccaaacggcctgcattctgcctcttgacatccacaaagcacttggatattggaacactgctaacaaaaacctgtgggtctacataggcttgccaacagaagcagcagaagtagccagagtataacctctgccttacttccttctacctttctcttcttgcattctactgtctgaatctaagtcagtgtgggaactctcctgccagagcacctgggaaatctggatgaagataccagcatcagtctaccttattcctcacctatctcccctcccatgctcacaaatcctgttccatcacctctggcctgctgatagaccttcttcaagtgattatctccccgctttcctccgtctttaacctctaccttttcttccatctcctatcaacataacctaacaacttgactcttccagtgtaaacctcccttagtcctccagttgacccttgaacaacacaggttcaaatgcatgggtccacttataagtgggtttttttcaaccaaacccatttaaaaaacacagtgttactaggatgtgaaacccacgtatataccaaaggccagcttctcctaagcggtttcctaagtggttcctcaggccacctgtgataattgagtatgcatggattttggtatacgcagaggtcctggaagattgccggggcttaggggaagaaggaaatggggattgctgttcaatgggtataaagtttcaattatgcaagatgaataagttctagaaatctgctgtataatatgatgtctgtagttaacaatactgtattgtgcacttaaaatttaagaatgtagatctcctgttaagtgctcttactacaaggaaataaaagtcatgtataagaaattctataatttttcatacactaaattcttatgtatgctatggtctcattttgggggaaggagagaaagatttgctctatatcattgttatgtctctgtttttttgccctagcttttggggagattttagccatagatagcttaccaccctaaaatagcacattcctaggatgatagtcttcttaattaatttttcaaatgtgaattacacatacaataatataacattccacttcatatagtcatttaattataaaagttttagcataaacacaaaaattagaaaaataaggttacatttttgggtgagagaattgtgggtgactctgaggtatggttctgcaacttatgtaaggagcacaccaatgtatttttctgtctttaatgcaaaaagtatttattgagcaccttctctgtgtgccagttgttgttgaagacctgggatgacaaaaaataaataagtttccctaaaccaatgattagactccttgacttgacactagcagggtttttccagcacagataaatctggcaagcaaaggaaagctttagtgtcagatccaaaatgttagtgcaaatgaatgtaacctgagattgtcctaaatgggattgctgtagccaacgcataatatgttctttgaccttctgagattgactgaaccaaatttgtcatgagaaattgtctcctcttagatctcctatcattcttaacactagattacataacttaaaaaaaaagaaaagaaagaggatagaaaaaaagagtgtcatgaatcaatctaagattcttgtgaatcaaattatattctttgtatctatttttagagaaggtaattgaaactcaattttcagcactgtatactcagttttcattgctctcctgtatgttaatgcataattctcataacaaccatatggaataggtattaatatcccccaatttatgggtgaggaaccataggaatagattaactgacttacacaaagtcgtaaagttagtaacaggaggtttgaacccagcaatcttaatcaacccggcatttttctcttaaatgtagagaccccttcccctactttcatattggtatttttaaaagactagactcatgttcttccttttcatgtactagaaacgtgtaggagtgacttggccaatgctaccaagaagagcgttgactttaatgcaaacgtctacccgcgtttgtagtagtttcctttctttgtcccctgccaggttctcaagcagagcttaactcatggagacaggtaaatattaacttttaggtcagcatcaccatacgtcacacacaagagtctaaacagaagggtactttggtctctcccggcttctcctctcacctggacagaggaagatagaaatgcagcctcctttgtttctctaaaaatcagaagatggctttgccaccttcatttgatgggatcagattgtgtttttgcatgtgtgtgtataatacataccaaattttaatgatcaaaataatcaggggactctactcccagttaccagatttctgtgtgtttgtgttcaaaagtacagacacatgtacaaagaaatacaataaacaaatgtagagttcaagggacattagaaattagtacaattctatttatcaaaagggaaagggagtacccccaaaattgtttaccaaaatcacatagattctattttgataaagtctttactttttagctctatttatactattacactttaaatcattttttaaattttatcaaagttatatactagaatataaagagcctgcagatttcataaggttccttaaggaaaagagcagtcctcagccagccagcctacttccaatccaccttcctcaaaccactttccactctttgcctggtatttacttcctgacaccttaatgtcaagtgttcctcctgatttttttacttgggatattgtacattgactttccgctatggaagatgatggcttagctctttattctctctgtccacaccacaggcagttaattcccatcctcatgatataattatatctcgatttcaattagaaaaatattcaatttacattattcacattattatgactatatgtgatattcagaaatggggcatatgctcaactatatttttgtgggaacacaatatccctggagttagtttttttacttgtttgtatggttttatctgtttttcttgtgcatttttttaacgtacttagctttcattaataatatttgccaattgttaatattctttcaagatgttcagtgagtccagcagtttcctaccaggtaccttatcaattcttatcaggtatcttatcctatgttgtaaaatttcacaatgatatcccttggtgtgagtttatttccatctactgggcactcagtggtcctttgaatctagaaaatctaccctccagtttgggggaattttcttgaattattttcttgatgttttcttctgtgggtttttattttgttttatttcactttctagatcttctagaattattggattatctgcctttatctgtcctcttatccatttatttgttttttcactctaatttctttattttaatttacattcctttgatggaggtttttatataatgctatcatgtttttcctttctaagaggtccttttttattctctgaatggcctttttgtagaagcattattttcttgcttcattaagcaaatatggacacaggtctatatttttatctttgtgaattattttttcttttttttttctttaggtggagtcttgctctttctaccaggctggagtgcagtggcgtgatcttggttcactgcaacctccgcctcccaggttcaagtgattctcctacctcagcctcccaagtagctgggattacaggtgtgcgccaccactgaattttttaacaatcatctttaaatttttcttttacctccatagtttctggtccctccagattgtttttggctttccccggctacctgatagtcattggcgttctgctcatatataagagcaagggactaaaactgaaattctgaacatcttctgagacaggagcatggcatctggtctgaggaggtgctcagcctcactgatggtgattctcactggaatgatctggctgagccagttgttagggagcttccaatgtcagtgtcttcaggtacttctgcatagttggttggatcctgtaacaaagctcttccaaacacttgcctggaaggtatggaccttgctgccaggaggtgaaggatgaaggtgaaaaggagacttgggtaatctccctatgcttcgggcatatttacttaatcctcctatcttacatagtatcccacgttggatatgcctggtacatctcccaattcagaaaccttctggtttggccctcaccaaaggataaacttccagacttctgctgaggtagagcaggtgtacttgcccaggtgactgcagtaagggaagactaagcatgtcagctgcttcttaaacacagttcagccactcctcattttggcctcagcctcctactctgcctgaggtacctgctgctgccaccgatcctagtgccttttgaagaccctctgctgtaaattggtgccactgccagccctggttcagctttctcaggtccactgagtgaccactcatctgcctacttcctagcttccaaaatgctgttactgtcatctctcctagttattgatatgtgtgtgtgtatgtgtgtatgtatgtatatgtgtatagatatatatatgtatatgcgtctatatatgtatatatgtatttatgtgtatatatgtagatgtatgtatgtatataccttaaatctgtaattattctgcttttaataagattcaggaagaggccaaacttgctgagtctgttcaatccactgtctttacctggtgtttcaccaagacacatttaaatagagacagtatttaccaacatatctacacagaggtccaacaacatgtaattatctgttctaattcatggtgaattacagtatttaataatattttttaaaattatcataaaaagctaattcatttgtgaacacaaatttttcttaattcccacttcatgacgtattagttttatgatcacgttaggcttactccacaaacatttattggtatctgctttatccatggagtcacagcaggtgatagaggatttgtaaccctctcccctttccctgccactccactgagaagcagatatcatggcatgaatgattaaataggagactatatttcatttataaaatggcttaggaacttttacagatgaaagaaactgttcttgaaactgccaataatatcaggaaagtgaatactaggtcttatttgttctttttaatgattttttcatacccattaaccattctcacccccacctccccatcctccatggccccactacccttctcagcctctggtaaccatccttctactctctgtgtccatgagtagtttagatttttagctcccacaaataggtgacgacatgtgaagtttgtctttctgtgcgtggcttatttcacttaaaataatgatctccagttccatccctgttgttgcaaatgacaggatctcattcttttatggctgaatagtattttgttatgtttatgtaccacattttctttatccattcatctgttgatggaaacttaggtcgcttccaaatcatagctgttgtgaatagtgctgcaataaacatgggaaattaggtatctctttgatatcctaatttcctttctttggggtatataactagcagtgggattgctggattgcacggtagctctatttttaggtttgtttgtttaacttttattttaagtacatgtagaggtttgttatatgcaggtaaagtggtgtcatgggggtttgttgtacagattattttgtcacccagatattaagcctggtacccattagttatttttcctgatcctcccttctaccctgcaccctccagtagtcctccatgtctgtttttgctctctatgtatccatgcattctcatcatttagctcccacttataagtgataacatgcaatatttggttttctgttcctgtgttagtttgctaagggtgatgccctccagctccatgatccttcaaaggacatgatattgttcctttttacacttgcataatattccatagtgtatatgtaccaattttctttatccagtctgccactgatgggcatttaggttgattccatgtctttgctattatgaacagtgctgcagtgaacatatgtgtgcatatgtctttatgatagaacgatttatattcctttgggtatatacccagtaatgggactcctgggtcgattggtagttctgtttttaggtctttgaggaattgccacactgttttccacaatggctgaactaatttacactcctatcaacagtgtataagccttcgcttttctccgcaacctcaccagcacctgtcatttttttgacttttaataatagccattctgactggtgcaagatggtatctcattatggttttgatttgcatttctttaatgatcagtaatattgggctttttttcatatgtttgttgggtgaacatatgtcttctttgaaaagtgtctgttcagcaacctacagaatgggagaaaatttttgcaatctatcgatctgacaaagggctaatatccagaatctatagagagcttaaacaaatttacaagaaaaaaaaaaccccatcaaaaagtgggcaaaggatatgaacagacacttctcaaaagagaacattcatgcggccaacaaacatatgaaaaaaagctcatcgtcactggtcattagagaaatgcaaatcaaaatcacaatgagataccatctcacgccagttagaatggcgatcattcttaaaaagtcaggaaataacagaagctggagaggatgtggagaaataggaacacttttacactgttggtgggagtgtaaattagttcagccattgtagaagacagtatggagattcctcaaggatctagaaccagaaatagcatttgacccagcaatcccattactgggtatatacccaaaggattataaatcattctataaatacacatgcacatatatgtttattgcactgacttggaaccaacccaaatgtccatcagtgatagactggataaaaaatatagcacatatacaccatggaatactacgcagccctaaaaaagatgagttcatgtcctttgcagggacatggatgaagctggaaaccatcattctcagcaaactaacacagaaacagaaaaccaaacaccacatgttctcactcataagtgggagttcaacagttagaacacacggacacagggaggggaacatcacacaccgggcctatcggggttgggggcaaggggagggatagcattaggagaaatatctaaagtagatgatgggttgatgggtgcagcaaaccaccatggcaagtgtatacctatgtaacaaacctgcacattctgcacatgtatcccagaacttaaagtataatttaagaaaaaaaaaagtgtctgttcatgtcctctgccaactttttaatggggttgtttatttttctttttttcttgtagatttaagttccttatagatgctgaatgttagacctttgtcagatgcattgtcagatgcatagttggcaaaaaaattttttttacctggtgttctatagacaatccataacctatagacaaccattctatagattgtctgcttactctgctgatagtttctttagctgtgcagaagctcttttgtttaattagacttcatttgtcaacctttgcttttgttgcgattacttttggcatcttccttataaaatctttgcctgttcctatgtccaaaatggtattgcctaggttgtctttagggtttttatagttttgagttttacatttaagtcttcaatcccatttgagttgatttttgtatgtggcataaggaattttctgcatatggcaagccagttttcccatcaccatttattgactagggaatcctttccccattgcatgtttttgtcagctttatcaaagatcatatggttgtaggtggatggccttatttctgggctatgtattctgttccattggtctgtgtgtctgcttttgtaccagtaccatgctgttttggttattgtagccctttagtagagtttgactttgggtagcgtgattcctccaggtttgttctttttgcataggattgccttggccatttgggctctttttgggttccacatgaattttaaaatagttttttctagttctgtgaagaatgtcattggtagtttgacaggaatagcattgaatctataaattgctttggacagtatggccattttattggttcttcctatccatgagcatggaatgtttttccatttgtttgtgtaatctctgatttctctgagcagttttttatagttttcattgtagagatctttcacctccctgatcatctgtattcctaggtattttattctttttgtggccgttgtgaatgggagttcatttctgatttggctcttggtttgatggttgttggtgtataggaatactagtgattttttttattttatttttccataagttattggggtacaagtggtatttggttacatgagtaagttctttagtggtgatttgtgagatcctggtgcacccatcacctgagcagtatactctgcaccacaaatattatcttttatccctcattctgtcccactcttccctccaagtccccaaagtccattgtatcattcttatgcctttgggtcctcatagcttagctcccacatatcactgagaacatatgatgtttggttttacattcctgagttacttcacttagaatactagtctccagtctcatccaggtcatcacaaatgctgttaatttattcctttttatggttgggtactattccatcatatatatatataccacagtttccttatccactcgttgattgatgggcatttgggttggttccacgattttgcaattgtgaattgtgttgctataaacatgcgtgtgcaagtatctttttcgaataatgacttcttttctactgggtagatacccagtagtgggattgctggatcaaataaactagtttacattcccaccagcagtgtagaggtgttccctgatcgctgcatccatgccaacatctactgttttttatttttttgattgtagccattcttgcaggagtaaggtggtatcgcattgtggctttgatttgcatttgcctgatcattggtgatgttgagcattttttcatgtgtttgttggccatttgtatatcttcttttgagaattgtctattcatgtccttagcccactttttgatgggattgtttgtttttttcttactgatttgtttgagttcactgtagattctggatgttagtccttttcagatatatagattgtgaagattttctcccactctgtgggttgtctgtttactctgctgactgttccttttgccatgcaaaagctgtttagtttaattaggtcacagctatttatctttgttgttattgcattagcttttgggtttttggtcacgaaatccttgcctaagccaatgtctagaagggtttttgtctagacattgtctagacaatgtctagaatattatgttctagaatttttatagtttcaggtcttaggtttaagtccttcatcatccatcttgagttgatttttgtataaggttagagatgaagatccagtgtcatcctcctacatgtggctagccaattatccaagcaccatttgttgaaagggagtcctttccccattttatgtttttgtttgccttgtcaaagatcagttggctataagtatttgggtttatttatgggatctctattctgttccactggtctatgtgcctgtttttataccagtaccatgctgttttggtgactatggccttatagtttcaaatcaagtagtgtgatgcctccagatttgttatttttgcttagtcttgctttggctgtgtgggatctcttttggttccatatgaattttagaattgttttttctaactctgtgaagaatgatgatggtattttggtggggattgcattgaatttgtagattgcttttggcagtatggtcatttccataatattgatcctatccatccatgagcacgggatatgttttcatttgtttgtgttgtctatgatttctttcagcagtgttttgtagttttccttacaaatgtcttttgactcctttgttaggtatattcctaaatattttattttttgcagctatcgtttgttgattttgtatcctgacagtttgctgaagttgtttatcagcttaaggagcttttggactgagactgtggggttttctagatatagaagcatgccatttgcaaacagggatagtttgaccttcttcctatttggatactctttatttctctcttccctgattgctctggccaggatttccaatattatgttgaatatgagtggtgagagaagacatccttgtcttgtgccagtttccaaggggaatgcttccagcttttgcccatttggtacaatgttggttgtggatttgtaatagatggctcttattattttgaagtatgttccttcaatgcctagtttattgagagtttttaaaatgaaggggcgttgaattttatcaaaagccatttcagcatctattgagaggatcatattgtttttgtctttagttctgtttatgtgatgaatcacatttattgaattgcatatgttgaaccaaccttgcatcccagggataaagcctacttggtcatggtgcataagctttttgctatgctgctggattgggtttgccagtattttgttgaggatttttacaccagtgtttaccaaagatattggcctgaagtttttttttgttgagcctctgccagcttttggtagcaggatgatgctggcctcatagaatgaattagggaggagtccctttggaatagtttcagtaggaatgctaccagctcttctttgtacatctcataaaattcgtctgtgaatctgtctggtcctgggctttttctcattggtaggctatatatttctgattcaattttggagctcattggccttttaagggattcaatttcttcctggttcagtcttgagaggctgtgtccaggaatttatcaatttcttttagattttctagttcgtgtacatagaggtgttcataatattctctgatggttattttatttctgtgtggtcagtggtaatatcccattgtcttttctatttatgtatatttgtgtcttctctcttttttcatttttagtctagctactggtctgtgtattttattatttttttcaaaaaaacacacttctagattcattgacattttgaatggtttttcatctctcaatcttcttcagttcagctttgattttggttatttcttgtcttctgctacctttgaggttactttgctcttgattttctggttctttcagttgtgatgttaagttgttaaactgaggtcttcctaacttttttttttttttttttttttgagatggagtctctctctgtcacccagacttgagtccagtggcacgatctcggctcactgcaagctccgcttcctgggttcatgccattctcctgcctcagcctcccgagtagctgggactataggcgcccgccaccatgcccggctaattttttttgcatttttagtagagacagggtttcactgtgttagccaggatggtcttgatctgctgacctcgtgatctgtccgcctcagcctcccaaagtgctgggattacaggtgtgagccaccgtgcccagccaagtctttctaactttttgatgtaagtgtttagtgctgtaaatttccctcttaacactgccttagcagtatgcctgagattctggtacgttgtatctttgttctcatcagtttcaaagagcttcttgatttctgccttagtttcattacttacccaaaagtccttcaggagcaggttattcagtttccatgtaattatatgattttgagtgaatttctcagtcttgatctctaattttattgtgttatggtctgagagagtagttgttatgatttcagttattttgcacttgctgaagggtgtttcatatctgattatgtgattgattttagagtatgtgccatgtggcaatgagaggaatgtatattctgttgtttggtggtggagagttctgtagatatttatcaggcccatttgatccagtgctgagttcaggtcccaaattatctttgttaattttctgccttgatggtctgtctgatactgtcagtggggtattgaagtctcccagtattattgtgtgggaatctaagtctatttgaatgtccttaagaacttgctttatgaatctgggttctccgatgttgtgtgtccatatatttaggatagtttcttgttgaattgaaccctttaccattatgtaatgcccttctttgtctttttaaatctttcttgttttaaaatctgtttggcctgaaattaggactgcagccccttatttttttctgttttcatttgcttggtagatttttctccatccctttattttgagcctatgagtgtcgttacatgtcagatgggtctcttgaagacagtataccactgggtcttgcttccttctccagcttgccactctgtgccttttaattggggcatttagcccatttacattcaagattagtattcatatgtgaggatttgatcctgtcatcatgatgtcagccagttattatgtgatttgtttgtgtggttgctttatagcaggggtccccaacccacaggccatggatcagtactggtccatggcctgttaggaaccgggccacacagcaggaagtgagtggtgggcaggtgagcgagcattaccacctgagctccacctcctgtcagaccaacaggggcatcagattctcataagagtgtgaaccttattgtgaactacacatgcgagggatctaggttgtgtgctccttttgagaatctaactaatgcctgataacgtgaggtggaacagtttcatcccaaaaccatccctcacccctggttgtggaaaaattgtcttccacaaaaacagtcctttgtgccaaaaaggttggggttttatagtgtcactggtctgtgtactgaagtgtgtttctgtagtagctggtaatggtctttcctttacatatttagtatttccttcaggaactcttgtaaggcaggactggtggtaacaaattccctcagcattgcttgtctgaaaaaggtttcaatgtactcctgcatctcagtgatcttcattcctatccatatcctgaattctatttctgtcatttcagccatctcagcccagttcagaatccttgctggagaggtaatgtcatttggaggatagaaggcactctggttttttgagttgtcagagttcttgcagtggttctttctcatctttgtggggtggtgtttcctcaagctttgaagttgctgtttttgatgaccttgagggtttgactgtggtataaggtaggtttagtcaattggtttcatttctggaaggttttaggaggccaacactcagctcccatctcctagactgcatgccctaagggattcgtatcagaccccaactttgttctctggctcctcaacattaggaaaccactgggctgagggagacaaggtgtgcttggaccactaggcactacactctgatgggtggtgccagccaaagcctttcatagggtgatggcagcaggctccatcctcattcacacatgccagcatcagggacggcggcagtgcaacggggtgcatgacgcatgcctgtcgctatggtaggtgcaagcgggtgccgggggcctgcctccatgcaagtgttcacagcagtggcagaggcagcatggctcaggaaggtggaggccccccagttggcaactgtgcacacagttgtgctggtggtagtgttagcacgtgggtagggtgctggtggatgcaggtctgtgtgtgccctctgtggctactcagagttgggaagtctccagtgttttccactaccactctggtggtagtgttgatgcaggcacagggtgctggtgggggtggcaggccctgtgctcaccaaggctctaactgaaatggcaatacagcaggggatgggtggcagagtgcacttctgccagcaacagaggcagcacagggtgcgtgcgcacatgggtgctagcagggcaagaaaggcaaaatctaccctcatattcacgtaccgacacagcaatgtaagggggctacgggccagggagatgctgcagctgcaggagggagtaggcaggctggtgtgtagtcatgggtgcttccttgctggagctctctaccagtcaggcatggtccaccaacacaggagctatgatgcggcaccctagggcacccagggctgtattgcaagcagttatggccaggatgggaccccaagagaggccaggagaccaaggattgctgaggtcggactggccctgtctgatgggcaagaccaccctaaagagttcaggtccaacagtttccctagggctaaagtctcctatggaagcaagttgagcctggggaatgggcgtccctggccatactccactacagatgctcccacaccaaacactctgggctctgcatagctggtatgctgcccctaccacttctcttagcagctctccctgccaactgtagtgtctgtgatggccaaggggtctcctcctgccaggattccagaggcccattgtgagagcagattgctccttgccagttcaagtcactcattcccccagagtcattggaagccaggaaggagtcacagtgaggagttaccctgggcagaactctcagcttcctcccacctcagcttggcttcagtgtcttccttccaggcaccctcagtgccttccctctgaagctctgttaggagtgtgcccatcatcccagtccctcagtgacagctgttccacctgactgcatcaagtcagccatctcaccccaagccagcactgctaccccaccatctgccagggaatcctcagattctgggagcaacacacaccacctatttttagtttgttggggaacttccaaactgttccttatagtggttgtactagtttacattcctaccaacagcatactgatctccacatcctcaccagtatttgttattgcctctttttgatgaaagccattctaactggggtgagatgatatctcattgtgtttttgatttgcatttctctgatgatcaatgatgttgagcaccttttcatgtacctgtttctcatttgtatgtcttcttttgagaaatgtttgagatcttttgccgattttttaatcgaattcttagatttatttttttcctatggagttgtttcagcttcttatagtttctggttattaatcccttgccagatggggtagtttgcaaatatgttattctattctgtgggttgtctcttccctttgttgattatttcctttgctgtgcaaaagctttttaacttaatgtgatcccatttgtccatttttgctttgcttgcctgtgcttctgaggtattactttgtccagtccaatgtcctagagagtttccccaatgttttcttatagtagtttcacagtttgaggtcttagatttaaggctttgatccattttgatttgatttttgtatatggcaagagataggggtcttgtttcattcttttgcatatggctatccggttttccaagtaccattcattgccaacgtacactcttggcaactttatcaaaaatgagttcaatataggtgtatggatttatttctgggttctctattctgatccactggtctatgtgtctcattttatgccactatcatgctgttttgtactatagctctatagcttaatttgaagttagggaatgtgattcctccagttttgttcttttttgctcaggatagccttggctactctaggtcttttgtggtcccatataaattaaaatttttttttttccatttctgtgaagaatatcataggtattttgataaggattgcattgaatctgtagattgcattgggtagtatggacattttatcaatattgattcaatccatgaatatggaatacctttccattttgtgtgtgtgtcgttttccatttctttcaccaatgttttatagttttcattgtagagctctttcacttctttggctaattcctaggtattttattttatgtgtagctgttgtaaataggattactttcttaatttctttttagattgttcaccgttggcacacagaaatactactgattttttatgttgattttgtatcctgtaactttactgaatttgtttatcagatctaatagtttttggtggagtctttaaatttttccaaatataagatcatattatcttcaaataaggataatttgacttcttcctttcaaatctggatgccctttatttctttatcttgcctaatttctctggttagaacttgcagtactatgctgaacaatagtggtgaaagtgggcatccttgtcatgttccagatcttagaggaaaggctttcagtttttccccattcagtatgataccagctgtagctctgttgtatatggattttattatgctgaagtacattccctcaatacccagtttcttaagggttttcatcattaagggatgttgaattttatcaaatgcttttttggcaccaattgaaatgattacatctgtccttcgttctgttgatatgatgtatcacattggttaatttgcacattttaaaccatccttgcatccctggaatatattacacttggtcatgaagaatgatctttttaatgtgttgttgaatttggtttgctagtatttctttgaggatttttgcaccaatatttatcagtgatatgggcctgtcattttttttgttttttgtttttgatgtgtctttgtctggttttggtatcagagtaatactggccttgtagaatgaatttggaagttgtattagtccattttcatgctgctgataaagacatacctgagactgggcaatttacaaaagaaacaggtttaatcaggcttacagttccacatggctggggaggcctcacaatcatggtggaaggcaaggaggagcaagtcacgtcttacatggatggtgggaggcaaagagagagcttgctcagggaaactcccccttatattaccatcagatctcatgagactcattcactgtcatgagaacagcatgggaaagacctgcccccatgattcagttatctcccactgggtcccttccacaacacatgggaattaaagatgagatttgggtgggaacacagccaaaccatatcagaagtattccctcctccactattttttggaatagtttgagtaggattgttattagttcttctttaaatgtttggtacaattacagtagtaaagccatcaagtccatggcatttctgccctgggatactttttattacaactttgatctcattaatcgttattggtctgttcaggttttggatttcttcatggcttaatcttagtagagtgtatgagtctaggaatttatccatatcttctagatgttttaattcattggcatatagttgctaatagtagccactaataatcctttgaatttctgcagtaacagttgtaatgtctcctttttcatctttaattttatttatttgggtcttctccctacttttcttagtctggctaaaggtttgtcgattttgtttaaattttcaaaaatcaactttttgttttgtttatcttttgtatttttttcacttcaacttcatttatttctggtctgatctttattatttcttctaattttggggtggtttgctcttgcttttccagttctttaagacatattgttagcttatttatttgatgtttttcttttttgttgatgtaggtactcatagctataaactttcctcaaagtattgctttcattgtatcctatagcttttggtctgttgtgtttccattatcatttgtttcaagaagttttcaattttcttctgtgaattacttcattgaaacactggtcattcaggagtgtattgttgaatttccatgtgtttgtatagtttccaaaattacttttttttttttttacctatttctaattttatttaattgtggttagggaagatgcttgatattatttccattatttagaatgttttaagacctgttttgtcacctaacgtatggtttatccttgagaatgatccttgtgctaaggaaaagaatgtatattctgcagccattcagtgacatgttctgtaaatatctattgattccatttggtctataatgcagataaagcctgatgtttctttattgattttctatgtggaagatctgtccaatgctgaaagtgggtggttgaagtccccagttattattgtattggagtctatccctctctttagctctaataatatttgctttatatatctgggtgcttcagtcctaggtgcatatatatttataattactgtatcctcttgctgagtcaactcctttattattacataatgacctttgttgtctcttcttatcatttttgtcttgagatctattttgtctgctatgagtatagctactctggctatttttttgtttccattaacatgaaatatctttttccattcctttattttcagtctatttgtgtctttataaaagaattgtatttcttataggcaacagataattggatcttggtttttatccattcagccaatcaatgtcttttgattggagagtttagttcattgatatccaatgttattattgataaggacttagttgtgccattttgttatttcttttctggttgtttgatggcctgctgtttcttcttttcttccttcctgtcttccatttagtgaagctgattttctcaggtggcattatttcttgatttttattttttgtgtatccattgtatgttttttgactttaggttaccatctggtttgcaaatactgtcttataacccattagtctaagctgataacaacactagcataaacaaactaacaaaaagaaaagtaaccctaactctatattttaactttgttccccactttttaacttttcattttttctacttatatattattgtgcagtctgtggcttgaatagttgttgtagttactatttttgattggttcatcttttagtctttctgtctaaaaaaacatagtttgtacaccacagttacagttttataatattctgtatttttctgtgtgcttatgattaccaattagttttataccttcagatgatttattattgctcattagcatccttttctttctgattgaaatactccctttagcctttcttgttgaacaggtctggtattcatggaatccctcagcttttgtttttctgggaaagtaattttatttcttcttcatgtttgaaggatatttttgctggatatactattccagcataaaagttttattccttgagcaccttaaacatgtcatgccctctctcctagcctgtgaagtttcctctgaaaagtctactgctagatgtattgaagcacctttgtatgttatttgtttctgtttcttttctcttgctgctttcaggatctgtttttttatccttgacctttgggaaggatcttcccaaagatcctttgagagtttggttattaaatgccttgaggtagtattctttggggtaagtcttcttggcattctataaccttcttacacttggatattgataagtatctctaggtttaggaagttattatccctttgaataactcttctcccctatctctttctctacctcctctttaggaccaataacttttagatttgcccttttgaggctattttctagatctcgtaggtatgcttcattctttattcttttttcttttgtctcctttgactgtgtattttcaaatagcatgtcttcaagctcactaattctttcatctgtttgaccaattctgctattaaaagaccatgatgcattcttcagtatgttggttgcatttttttattcttaaactttttattatgaaaaatgtcaaatagtacaataaacatccacagacatataattatctagatttaacaattgtgaatattattgtgtttgcttcattcatctctttctcctcaccctcttctttttttttttgctgaatcttttttttagtatttattgatcattcttgggtgtttcttgcagagggggatttggcagggtcataggacaatagtggagggaaggtcagcagataaacaagtgaacaagggtctctggttttcctaggcagaggaccctgcggccttccgcagtgtttgtgtccctgggtacttgagattagggagtggtgatgactcttaaggagcatgctgccttcaagcatctgtttaacaaagcacatcttgcaccgcccttaatccatttaaccctgagtggacacagcacatgtttcagagagcagggggttgggggtaaggttatagattaacagcatcccaaggcagaagaatttttcttagtacagaacaaaatggagtctcctatgtctacttctttctacacagacacagcaacaatctgatttctctatctcttccccacatttcccccttttctattagacaaaactgccatcgtcatcatggcccattctcaatgagctgttgggtacacctcccagacggggtggcggccaggcagaggggctcctcacttcccagaaggggtggccaggcagaggcgccccccacctcccagacagggcggctgctgggcggaggggctcctcacttctcagacagggcggccgggcagagacgctgctcacctcccacatggggtcacggcagggcagaggcgttcctcacatcccagacggggcggcagggcagagatgctccccacatctcagacaatgggcggctgggcagagacgctcctcacttcctagacgggatggcagccgggaagaggcgctcctcacttcccagatgatgggtggccaggcagagatgatcctcacttcccagacggggtggcggccgggcagaggctgcaatctcggcactttgggaggccaaagcaggcggctgggaggtggaggttgtagcgagccgagatcacgccaccgcactccagcctgggcaacattgagcactgagtgaacgagactccatctgcaatcccagcacttcgcgaggccgaggctggcagatcactcgtggttaggagctgaagaccagcccggccaacacagcgaaaccccgtctccaccaaaaaaatacgaaaaccagtcaggcgtggcggcgcgcgcctgcaatcccaggcactctgcaggctgaggcagcagaatcaggcagggaggttgcagtgagccgagatggtggcagtacagtccagcttcggctgggcatcagagggagaccgtggagagagagggagcgggagaccgtgggagagggagagggagggggagggggagagggagagggagaggggttgcatttttaagctacagaatttccacttgcttctttttaattattttaatctctttgttaaatttatctgatagaattctgaattccttctctgcattatcttgaatttctttgagtttccttaaaacagctatttttaattctctgtgtgaatggccacatatctctatttctccaggattggttcctcgttccttatctagtttggtgaggtcatgtcttcctggatggtcttgatatttatggaagttcattggtgtctggacatggaagggttaagtatttattatagtctttgctataggggcttttttgtacccatcctccttgggaaggctttataggtattcagaaagatttggatgccgtgacctaatccatatctgcattaaggggcactgcaagcccaggatcactgtggttcttcctaactcgtactggtaccaccttggtggccctgaataagatccagaagaattctccacatttccaagcagagactcttgttctctcccctactttctcccaaacaaatggagtctttttctctctctgctgaaccacctggagctgaagatggtgtgacacagtgccccctgtgaccactaccactaggactgcactgggtcagacctgaagccagcacagccctggttctcacccaaggcctgctgtaaccactaccaggctactatatgctcaaggccttagggctctacaatcaacaggtgatgaaaccagttgggctcatgtccttcttttcaggttggcaagttcccctaggcacaatgtgggtccagagttaccatctggaagcctgggactggagtcaaaaaccttagagatctacctggtattctattctactgtggctgggctgtcactcaaaccaagtcacacagccattccccttcttccctcccctttcacaagcagaagagcctcaccccattgccaccaccaccacagacccacagggagtactaccagactaccaccaatattcagttaaggccaaagggctcttcagtcagcttgtggtgagtgctgccaagcctgggactcacccttcagggcagcggactttttctatcccagggcaggtccaagaatgccattcaagagccaaggcctggaatcaggggccctaagagcccacttgatattccaccccactgtgacagagatggtacctaaggtgacaaagtccacttttcttttccctctgctcttctcaagtggaaggagtctctccccaaagccaccactgctaggaatgtgctgcattacacctgataccagtatgtctgagtctcacccaaggcctgcagcataccacctgggtaccactgctggttcttcaaggcctaagagctctttagtcagtaggtaatggatcctgcctaaactgggtccttcccttcaaggtagtaggttcctttctggcccagagtatgtctagaaatttcatccaagggctaggtcccggaatgggagcctcacgactatgaccagtacgctatcatactgtggctgagctgctatccaagatgcaagacagttgtccttactcttccctctcttctcctcaagcagaaatcaagggtctcttttgaagatgcaagctatgctgcctggggttggtaggagggcatgatgtaggcactcccttagccaccctggctagtgtctagtaggccacatgccacccaagtccactggctcagagcccagctcagcactagttgggtagggtactggtcagagtcgtgaggaccccatttcacttgcagtcgttctggcctactgctcctaaagagaagcagtctagcgcccaagagcactcccagccacagtggcaagacttgctggaactcaagttctgaccactgggatgcacaattcccctctggctagggccagtccaaatattccctctgtagccgggcatcagctgagtacagcctggttttgatttccactctgacaggagtgagttcagtgcaaagccccacaatcactgtgctctccctctttcaagtgcacagattcttggtaccatgtggccactgctgaaggatgggggaatggtggtgtcagcaattcaagactgtctttcctaccctcttcactgcctctttcagagacatgaagtcaaaaccaggcacaggactaatctggtatttggttcctatgatggtgttccctttgtatagatagtgtcaaacttggtgttcctgtaggggatgaccaggggaaccctctgttcatccatcttgctccagcactccccaagcattacagtttgattagcacataagcattaaatggccttagtgtcctgtcactgagacactaaaaatcaagtccccacatttccaaatgtttcctgtgagggagtagctgccttacccagaaagtgttgatttcttttttttttttttttttgagacagagtctcactctggtgtcgccagcctggagtgcagtagcgtgatcttggtgcactgcaacctccgcctcctgggttcaagcaattctacctcatcctcccgaatagctgggactacaggcacgggccactaggcctagctaatttttttatatttttagtagagacggggtttctccatgttggccaggatggtctcaatctcctgacctcatgatccacccgcctcggccttcctaagtgctgggattacagacgtgagccaccgcgtctggccaaaggtgctgatttctaacacagcactttgtattacaaataaatctcatttcctgctggacgaggtggctcacgcctctaatcccagcaccttgggaggccgaagggggcagatcacctgaggtcgggagttcgagaccagcctaaccaacatggaaaaaccccatctctgctaaaaatacaaaatcagctgggcgtagtggcacacgcctgtaatcccagctactcaggaggctgaggtaggagaatcgcttgaacctgggaggcggagatttcagtgagccaaggtcatgccaattgcactccagcctgggcaaaaagagtgaaatgccatctcaaaaaaaaaaaagaaagaaagaaagaaagaaagaaatcccatttccattttacaacaaagatcacagagactctaagagattaaactccttatgcttattattagccggtcagtgctagcactgatttcaaaattaagtctaattccaaagcctgctctacttagcagcttctaggtgctaaaagaatttaaggaggttatgtagtcagctagggctgccatcacagaataccacagactgagtggcttaaacaatgggaataaattttcttactgttctggaaggtgagaagaccaagactcaggttctgacattgtttagtttctagtgaggattctcttcctggcttgtagatggcatattctactatgtcttcatgtggtctttccttgctgtgtgcatctgatgtttcttcctgcaaggacactaatcctatcagattggggccccacccttataacctcatttaaccttaattatctccataaaatgcccatctccaaatacagccatttgggtgttaggccgtgggtgttagggctgcaacatatgaactttgaagggacataaacattcagtctataacaaaagttgaggacagacaacaagtcattagatttggtgattgagatcacagactaactctgtacaaacagttttgatataatggtagggtcagaaattgtgtggagactaaataaggagtgatatttgaggaaaatgtcctgataattcatatctgtagggagtaaaggatggagggagatgggagagtccgtttagcgatcattcagagttgagaacctcataatcgaaaaatggtatattgagcactaaagtcaacacatcctagtaaacagaatgtttctgtctttattttgtgctgctgtaacagaacaccctgggactgcataatttataatgaacagaaattcattggcttatggtttaggaggctggaaagtcaaaacttatattgaattctttcagcacctgggagcagctaagtagaacaggctttagaattagacttaattttgaaaccaggtgctagcactgaccagctaatggtgagcataagatgccaatgttatctctcagagtctctgtgacctttgttgtaaaacagaaattagattttataacagcaccaatcctacccatacgatggagcactcctggcctaatcacctctcaaaggcccacctcttaatactgttacaatgtcagttatatttcaacatgagttttggtgaggacaaatattcaaaccatagcagtttctaactaaagatatctactttaactcaaggtatttattttaagatgatatatcttaagatttaagattatatctagtggcagagtagcattcactggatcgggataaaagaacaattctgaaatcctctctttccatgattttcccaatcccatactttgactgagacctacaaattaaaagaaatatattttatatcaacactatgagtacacacacatacaccccccacagactcctgaaacaaaattttaaaattatatggtatgatttctattgctgcatactaagccagcccaaaacttggttgcttgaaaacgaaacaaaaattgctcacaaatgtgggattcaggcaggacttataggtggtagggatagtatatctgatctctcctaccccacttggcattagctgaggcagctcagcagggactggaggatccatcctcaagatagctgatctacattgctggcagtttaatgttggctatcatttggtagctaagccagggctgtgggtcaaggtcctctccatggacttcttggtttcaaaagcaaaccttctaagaagagaaggtggaagtatgggcattttttatgatccaacctaagagaacacttcgtgtcacttttgccattgttatggactgaatgtttatgtctctccaaaatttgtatgtggaaatcctaacccttaatgtgatggtcttaggaggcagggccttagggaggtgattaggtcatgagagtaaaaccctcatgaatggtactagtgctcttataaaagggatcccagagagctttctcactctcttcctgccatataaagatataagaagacagtggtctgaaacctggccttgggtttcagaacccaaccatactggcaccctgatctcagacttccaacctccagaattgtgagaaatgcatttctgttgtttataagctacccaatctatggtactttattacagcagcccatgtcagccatattctattggttgaagtagtcacaaaggtccacccaagttttcagggaagagacaaagaccccccactcaataggtagagcatcaacatcacattgcaagaagaatacattgaatgggagaaactatcttgggtattcatagaaaatataatttgccacactctgcttaccttgtaccatactacactataccacactggtactatactacgggacaagcagtatattctgatatattgtagtctactgttttttatgctgatgattaccactgaactgtgttaacaatctagtggctccccatcctcagtttgaaaaacactgtcctgtacaattgtaaattgagacaatagtaaaaaatttcccttctacactggcagaatgctttaagaaaataaatacagggattactgaaatagatcagaaagattaaagtaaaaataactgagcaaaatgaagtttgccacttttactttctaatacctgtttataagagcaatgtttggcaatctcagatgagttcattttataactgagtcaaaatcttaacatacatcattgcttaggccaaaataaaacctctaattattatggcaaaccatgatacctctatacttttttttatatataaaatgcctttttcaagtcaattgtagaaaatgtgcataaccaactgattgtaacacaatcctttaacttgattcattctttacttattcatacaaactatttaggtatggaatttaagagttccttgaagtcatcatctttgtgacaagatctctaagcaagcaagtggctggcgccgtaaaggctaaaggaagagtgatctaaatcttgttcctctgaatgggtcctggggaccaatagtctgggtatcacctgagagcttgtagaaaagctcctgacaagtcagaatctgcattttaacaagataccccaggagattcctgaacccattcaggtttgaatagtactgaccgaaatcgatgttttccgaagtgtttagtttgtgcaacctatgagtaaaatatgtggcatgagtatatgtctatgtgtatctttgcataatacacatacactgctataatattttataaaccatatgatgcatcaaatagaaatttttaacagatgaggtaaacagatatcagtaggagttctaatccttctctctcactccctcactgtttcatcttaataagttccagaggtacaagcaccctgttttggagcccactggcctaaatcacaccacgagctcaaatagctttctcttgactaagtcacattgcccagaaacacatgaatactcttgtgacacgctgcagtaaaatgaacaatttataaagttccatgcatttaaaattccttcccctctttaaaagcaaatatgtgttgatatacttaacagatcattaaattttggcttcttagaaattaatcgcttattttaaggaactctgatccccagtattgcttgcaggaaatgagtaaacatatgtttgcatgtgagatgatacactggcataaacttttaatagcacactttaaaaatgatgcaaggtttctaaaaattataatctagccattaaaaattatacagtaggccaggcgctgtggctcacgcctgtaatccctgcactttgggaggcaggtggatcacctgaggtcaggagttcaagaccagcctgccaacatgaagaaaccctgtctctactaaaaatacaaaaaattagccaggcatggtggcaggcacctgtaatcccagctattcaggaggctgaggcaggagaatcacttgaacccgggaggcggaggttgcagtgagccgagatcatgccactgcacttcagcatgggcaacaagagtgaaactccatctcaaaaaatatatatatataaatatatatataaatatgtataaatataaatatatataaatatatatatagagagagagagcacctgtgtatatttttttgacacagaaaatacggtatatttttaagtgaaatctaaatgctagtggtaaccacagattattggggactgtgtttcaatggttctcattatgtttttgttttatttgtgttttctaattcttctgcaattaccatgttttatttgtgtaatgaattagtcactaacggtgacatcactggcatgccctgagcctggggtgcctaatgggttgaatcaattcttcacgtagttactggagtctgccagtcagttttcttttcttttttaattgtttttaattttttgtgggtacagatatttatggggtacatgagatgttgtgatacaggcatgcaatgtgaaataagcacatcatggagaatgggatatccatcccctcgagtatttatcctttgagttacaaacaatccaattacatttttaaaagtatttgaaaatgtacaactaagttattattgactatagtcaccctcttgtgctatcaaatattaggtcttattcatactttctaatttttttgtacccattaacaatccccatctctcgctcacattccatccccaactacccttcccagcccctgataaccatccttctatgctctgtctgtgagttcaattgttttgatttttagatcccacaaataagtgagaacatgtgatgtctgtctttctgtgcctggcttatttcacttaacataacgatctccagttccatctaagttgttgcaaattactgcatctcattcttttatggctgaatagtattcccttgtgtatatgtaccacattttcattatccattcatctgttgaaacttagattgatggccacttaggttgcttctaaatattagttattgtaaacagtgctgcaacaaacaggggtgcagatatctctttatatactgatttactttcttttgggtatgtacccagcagtgggattgctagatcgtatggtagctcaatttgtagttcattgaggaacctccaaaccattgtccatagtcgttgcactaatttacattcccaccaacagtgtatgcaggttcccttttctcaacatccacaccagcatttcttatcgcctgtcttttttatacaagccattttaactggggtgagatagtatctcattgtaattttgatttgcatttctctgatgatcagcgatgttaagcacctcttcatatgcctatttgccatttgtatgtcttcttttgagaaatgtctattcaaatcttttgcccgtttttgatcagattattagattttttcctatagagttgtttgaggtccttatatattctgattatgaatcccttgtcaaatgggtagtttgcaaatattttctcccattctgtgggttgtgtcttcactttgttcgttgtttcctttgctgtgcagagcattttaacttgatgtgatccaatttgtccatttttgtgttggttgcctgtgcttaggagtattgctcaaaacatttttgtccagaccaatgtgctgaaaattttccccaacgttttcctgtagtagtttcatagtttgaggtcttagatttaagtccttaatccattttgattgatttttgtatatggcaagagataaggatttagtttcactcttctgtatatggatatccagtcttcccaggaccatttattgaagggactgtcttttccccagtgtatgttcttggcacctttgtcaaaaatgagttcactgtaggtgtgtggatttgtttctgggttcttgattctgatccattggtctatctgtttgtttttatgccagtgtcatgttttggttactatggctctgtagtataacttgaagacagggaatatgatttctccagttttgttctttttgcttaggatagctctcgctattctgggtcttttgtggttccatataaatttttaggatttttttttttctgcttctgtgaagaatgtcattggtatttcgatacagattacattgaatctgtagattgctttgggtagtatggacattttaataatattcttccaatccacaaatatggaatatctttcctttttatatgtactcttcaatttctttcaccaatgttttatagttttcatttgagagatctttcacttctttggttaagctaatccctaggtatttacttgtttttgtagttattgtaaacaatattactttttgatttctttctcagattgttcactgttggcgtatgaaaatgctactaatttttgtatgctgattttgtatcctgctgcaactttactgaatttatcagttctgatagtttccttgtggagtccttaggtttttctaaatataacatcacaacatctgcaaacaaggataatttgacttcttacattccaatttggatgccctttatatctttctcttatttaatggctctagctaggacttccagtacttttttgagtaagtggtgaaagtgggcacccttgttgtattccagttcttagaagaaaggctttcacttttcgccattcaatatgatactagctgtgggtctgtcatatatggcttttattatgttgaggtataatccttctacccccagtatttttagggattttcatcattaagtgatgttgaatttcatcaaatgctttttcagtatcaattgacatgatcatatggtttttatccttcattctgttgatgtgatgtatcacattggttgatttgcatatgttgaaccatccttgcatcccagggataaatgccatgtgatcatgatgaatgatctttctaaggtattgttgaattcagtttgctagtattttgttgaggatttttgcctcaatatttatcagggatattggcttgtagttttctttttattgatgtgtctttggttttggtatcaaggtaatactggcctcataggatgagtttggaagtattcccttctgtattttttggaatagcttgagtagcgttggtattagttcttctttaaacatttggtagaattacagtagtgaagccatcaggtccctggcttttctttgctgggagactttttattacaactttgatctcgttacttgttattgttctgttcaggttttggatttcttcatggttcactcttggtagattgtatatatttgtctaggaatttatctgtttcctccaaattttccaattgattgacatatagttgctcatagtagccactattgaacctttgaatttttacagtatcagttgtaacatttatttttttttcatttttttattttttgagacggagtctcactctgttgcccaggctggagtgcaatggcctgatctcggctcactgcaagctctgcatcctggcttcccgccattctcctgcttcagcctcccgagtagctgggactacaggcacccaccaccatgcctggctaaatttttgtatttttagtagagacaggatttcagcatattagccaggatggtctcaatctcctgacctcgcaatccgcccgcctcagcctcccaaagtgctgggattacaggcgtgagccactgcgcccagcccttttttctcttttattttatttatttgggtattctcttttttatagttagtctggctaaaggtttgcaaattttgtttaacttttcaaaaacccaactttttgttttattgatattttgtatttttttatttcaatttcatttttttctcctctgatcttcattatttattttcttctactaattttggatttggtttgctcttgcttttctagctttttaagatgtatcattagattatttatttgaagtttctccattttttgctgcagggacttacagctataaacgtccctcttagtattgcttttgctggatcccataggtttttgtctcttgtggtctaggtgccacctcagccacagtgcagtagaacaccaggtagacatctaaggcttttgattctagtccttaactcccagatggcacctttgaacccacccagggcctgggagacctcactgcccttccattatcatttgtttcaagaaatttttcaatattcttctgaatcacttcattgacccactagtcattcaggagcatattgtttaatttccatgtatctgtatagtttccaaaattgctcttgttattcatttctatagttttattctattgtggtcacagaaggcttgatattatttctatttttttaaatgttttaagactcgtttcatgacctaacgtatggtctatccttaagaatgatccatgtgctggtgaaaataatgtgtattctgaagctgttggatgaaatgttctgtaaatatctgttagatccatttggtctagagtgcagaataagtctgatatttctttattgattttctgtctaaaagatctgtccaatgctgaaagcgggatgttgaagtctccagctattattgtattgggacctattcttctctttagcgctaataatatttgttttgtagatctggataccccagtgttaggtgcatatatatttaaaattgttatatcctgttatcaaattgacccctttatctttatgtagtgaccttctttgtctcttcttatagtttttgtcttaaactctgttttgtttgtatgagtatagtgactcctgcttttcttggattccattggtatctcatcccaagattccattgggtctcacccaaggcctatggccttggctcctgcatatgttcactcaaggccctggagctctacaatcagctggtggcaaagccagtcaggccagtgtccttttgttcagggcagcaaggtctttcaggccctgggtgggttcaaaggtgccatctggaagttaaggactagggtcaaaagccttagatatctacctggtgttctattgtactgtggctgaggtggcacctagaccacaagatatggttcttcccactcttccctcacctttccaaaggcagaggagcctcaccccatagccaccaccatctcagaccacaaagaatactgccagactaccgcccatgtttccttaagacccaagggctcttaagtcagcttgtggtgaatgctacctgtcctggaactcatccttcgggaaagtggactctggtatggccccgcacaggatcagaaatgccatctaacagtcaattcctggaatctgggaccccaagagcttcctgagtactctaccctctatggccatgctagtacctgaagcgagcaaatctcagaggctcacccaaggccctcaacatagtatctgggtatcactactgatcattcaggggccaggggctcttcagttagcaggtgatgaatgctgccaagactgggtgggtcctttccttcaagtcagcagtttcccttctgacctgggatgtctctagaaatgtcatctgggagcaaggacctggaacaggggcctcaggactctgacagctgccctatcatactgtggctgagctggtatccaaaatccaagactaagtcctttcaacccttctctctcctctcctcaagcagaaggaaagggtctgttttggagccaggagccatgcagcctgtagttaggggaagggtgatgccagcactcccttagtcaccccagcggatgtctcagtatgtcaggtgccccccaagtcctccatctctaattcaccattaggacttgcctaagagtttcagtccttatggcctagcctgcctttcaagtttactgggagacacagagcactttggccctcagtggcaaggtttatgagaactcaagttctgaccacaggggtcagtaattcccctctggctagggctggtttaaatgctccctctgtgggtaaaaactatcagctgagtttggtcctgttttcctttctgccctaacaaaatgcactgagttcagtgactcacagttgttgtgttctccttccccagatgcccagagatgctctctgcaccacgctgccattgctatggggagtgagagaagggtggtgttggtgattcaggacttttttttttttcctgtttcttcattgcctctttcagcaatggaagttaaaaccaggtactatgagggcacactgatttttggttcttatggtgttttttctgtgtaaatagttgttaaattggtgtccctgtagggagggatgactgttggagcctcctattctgccatcttgctccacctccagtttgccagtcagttttcatataaaccagagggaaggttatacgctgtctgttttttcctctgtaagtaatcagaaattacaccatctgtatgttatatacacatgtacataacattcctgtcttagtttgttcagtcggctatagcaagttaccatagactaggtggcttagaccacaaatattcatttctcacagttctggaggctgaaatccaagatcagggtgcgggccatcttcccagttatgtcctcacatggccttccttggtggtgcatacaagcagagagagcagaaatgatcttgtgtctcttcttctttctataagggcattaatccatcatgggaacttcactgtcatgacctaatcctctccagggcttcagctcctaataccattacactggggttagggcttcatcatatgaattggagagatacaaatctgtccatagcatttctttcacagctaaattggcatttacatttcaagaagagaaagtgtccaagagtaacaattgaagtataaagtgggttctttcttttaaacactttgtattatgttatctccatcatgaagccgtttaagaaaaggaactgcattctcagtgtattagttatctattgctgtataatctgtataagttaccccaaaactcagtgatttaaaacaatagtaaatatgtatcagcattgatagtttgtatggatcaggaatttgggagtgccctggttgggccttagtggcttggggactctcacaaggttgcagtcagattagactgtggccttagtcatggaggcttgattggggctgaggatatacttccaaggtgactcaagttggatactccccaccagggcctcaccacagggctcctcatgcatctccacagcatggcagctggcttcccccagggggagcaacgggagagacccttaacagaacctgcaatgcctttcctaacctgccttgagaatatcactccatctctctgccatattctattcgtctcaccacaaccctgattcactatgggaaggggattatacagggatctgatactagaggacaggaattattggggcccacttggggtacttaataaccaagagtggttattaggtgataatttcttatgtgatagtttcttatggtgtactgcttagtaaagacagtgcttttaaaatgaagtgtaggttaaatagacaccctcatcccaagtgcctctaaagcaaataactgaggtgatgttgagaaaggccaaagcggtaatcacttacggagagttcaagaagtgtaatgcgcacagtgggttctgggaggaccctgggtactagaaaagggaagggaagggaagggaaaaaccaaaggatttcagcttctctgacgattcagggtgtccagatttaagatggagttattttaggcactgaattgacaattccaaaatttgtgcagtccgaagaaactaaaactgaaaattagagacaaagcagttctttatttcaaccctgcaaacgtgtgtatgtttcctctgggataggaaagggacatcaatgggtcagtaatgcagaggaggagaactgaaaatgaaggagtggctacctgggctatgtacataattgtttttcatttttatagcaacctggtaagtaggtattgttatccttatttagtgtggaaaaattgaacctaaaggatttacagtcagctacatagccaatgtgtgagggccaaaattgcacttaacttcaaaataggtctttacaccatttaaaaatcaaactaaattggatcaagtgtagataacagtagctacagggaagcatgaggtgggtgagaattagccactctccaacgtagtccctgccaggatataatgaaagcaagtttcagactaaattctccacacacatacttttaaactgtattagcaaggaggccctaagcaattcatcagtccgttctgtaaacattcatgaagtctcaagtctttattcttttaggttcttctaccaccactctgcagaaaatatattgcagtcagcttaactatattccccaataggattctactacccttaaattcagcatcaggcaccagaaatcatataatccaccagcaggatacaggaccaatccagcctcaggcagcacaccaaaggcttcactcgatgactattccctgttcatacagggtcagggaagcctatttataccttgaatctcataagtagtgtctgtttttagaatttatttttctgatcaataagccattaatttcatcaatgaaaactcatttctgccattcattaattcatatcttaatcaatggacagtggagttgcatttattaaccagtactatgtctgaccttcctgattagatactagctgttcactcctaaagtgtatatttctgactaccccaagggtttaataaacaaaaatctacatttgtatcatactgtttatgatgtagtaaattatacatgtcaaagcaaaggacacaagcaaatccttagcccagacactagatgtagcgggagctcagctgaagactgaattactatcgcactagaattcagcaccatcttgttttgtgctttagttatctaattgcttcgtgtgttggatttggcttcttaatcagattatgaaattcttggaaagagagagttatatactgtttattcttctacaatagctagcacagtgctagatacatataggtctagaatcaatcatttttaattattaaaattcatagtaataccttacaaacacttggcccgtaggattctatagttgctttgagattctaaagtacctcagtggactacaaaccttaagaaattgcctgactgacttgagtgatggaaatggtatattttgtgtagattttctcatatcaattcacagctttgttctaacaattattaaacttcattgggataagcataaagtatgaaccataataaacaatcatgcacctcataacgatgttttggtcagctatggactgtatatgtgacagggatctcataaaattatactggagctgagaaattactactgcctagtgacatcatagcacaccaccttactcacgtgtttgtgatgatgctgttgtaaacatacctgccgcacttctggtcttataagagtatagcacatacaatcatgtatagtacatacttgacaatgatcataaatgtctgtgttacaagtttatgtatttactatgctatactttttattatttgagagagtacatcttccacttatttaaaaaaaaagttgattgtaaaacagcctcaggcaggtccttcaggaggtattccagaagaagacattgttatcatacaagatgatagctccatgcatgttattgaacctgaaaaccttccaataggacaagatgtggaggtgggacagtgatactgacaatcctggccgtgcgtaggcctaagctaatgtgtgagtttatgtcttaccttttaacaaaaaggtttttttaattaaaaaaaattaattaaaaaaggaaaaagtatatataataagactataaagaaagaaaatcattttatacagccacacaatgtatttgtgttttaagctaagtgttactacgaaagagtcaaaacgttttagtaattaaaaagtttataaagtaaaaaagttacagtcagctaaggttaatttgctatcaaagaaagaaaaatattttaaaataaatgtagtctaagtgtgcagtgtttatgaagtctccagtagtgtccagtaatagcctaggcttcatattcactcaaactcactcactgactcacccagagcaacttcagtcctgtaagctccattcatggtaagtgccctatctaggtgaaccatctcttaacttttataccgcatttttactgtaccttttctctatttatgtttagatacataaatacttttatgagccgggcattgtggctcacgcctgtaatcccagcactttgggaggccgaggtgggcagatcatgaggtcaggagattgagaccatcctggctaacacagtgaaaccccgtctctactaaaaaatacaaaaaaaaaaaaaaaattaactgggcgtggtggcgggcgcctgtagtcccagctacttgggaggctgaggcaggagaatggcaggaacccaggaggcggagcttgcagtgagccgagatcgcaccactgcgctccagcctggcgacagagcaagactccgtctcaaaaaaaaaaaaatacttttatgttacaattgcctaaagtattcagtacagtaacgcaccatacagatgtgtatcctaggggcaataggctataccaggcagtctaggtgtgtggtaggctacaccatctagatttgggtagtacgctctgtgatgttcacacgacaaaatcacctaatgttgcctttctcagaatgtgtctttgtagtgtgaccgtacaaacataaatactgatatctggcttcatttcaaaattttttaaattgagtttgtccatttccactgaatttaattatttcgagcaccaactccaggagcaggaagttagcactgggcttgtttttattctgagtactgcttgaatactaatagttgaaaagtattgtaatatttgaccctgaagagctttgactcagggattttgtgttgtcattcacatcctcggcaaggaaaggtatccagctcctactatttaatatgtaatcacgacatctagtgctcactgtttggttttgttaagcaatagctgtgagccacagagccaacctgcagccgcatctcacccaagaaggcccagggctgtgttttcagttttgcttttaatgattgcataactgtgtgaagttctaagacactgttgggattttagccttgggatgacaagcctttggggcacctctttggggtaaagaaagaagaactaacagaagagcttcagtttaagtctgatgaggacaaacgcctggcactaggtgggttttaaaaatccttgaaaattttttaaaaactaaaaaaaaagccagctcttttgcaattgcccagagagaggaggacacccatattgattgatgcattgttctcctaggcaggaatcgtcccactatagtctgcggtagcaagagttcaagggttaaagtaggaagactgatcccataaatgtaatttgcattccttccaaattcacatacaattgtatagcagtgagtatttaaatttaaaaacattatagtttaaggaacttttctcatgaacagttctcctagtgtacattatgtaaattctaccaccagagaaaaattcctgctttgttccggcttaagcttggtacatatatacaaacccatactattacttcagaaaattcaacttaggtaatctggctcaatactcatggttagagattttaactttaacaacttaacaatatttggtttatcatatttgtgcttttatttcaatttagaatgttttccagccagaaatctagctttaagttttataaagcatgatgacacagcagctagaactcaaatctctaaatggaattatgctaaatttaacaatatgttacctaaagtccttatgccttaaaatgtttctaggctaaattctgcaatttccctggaaacatattgaattgtcttcaataatacattgcataaatatatttatcctacatctaggtacttcaaattataagctagtaaatcttgtaatatttctagctttaagactcgtatgtatttcttcctttgtattttctccccaatcatatgattatgtactattgatgctataaatatcttatattttaaggttaggctaattcccagtggctctattatcccacctgtgcttgcaactcagtatgtgatgaaattgcctatgacttatcaattaacccttggtgtccctagaatccaaaataaagaataaatgtatgtaaaaggataattggagacttagaatctcttcctcaagattttatctggttaatgactatcacaggtgggctgttctttttattcttggaagaacatactctattccggaggggaaaatatcaaattagttcagcctgctacctgctcccatagaagatgggggaagctggctctttcatcggtgttttcgtctgtagccgcccccttccccaaccttgagttgatttaaaaggatggaagaaagtaccgtgctacctccaatgctgtcattcagtgttcaccccaggcagtgtgctagacacattcctggactaaatcctttagttcctttaagacaacaaacctataagataggtattattatctcgattttacatattaaaaaataatgtaagcctttttgtatttgcattgttttgctttgttctttaaatgtctgctttaaaaaaagaagtggggtaggtaaaggatcaaaaaaggcctggaatcccaaaagtaatgataaatgttctaaaaactctttaaaactttttatcttccatctaaacaggatgcatctgttacccatgctaattacacagaaggcatctgagtcttcctaacttctagcacgtaatagacaacctgtgattcctaacatttactgttggaatttacccattggatcttttctattataaatttatcttcacttttttgttgttgtttttccaagaagaggtgaaaatagcaatgccggctgggcatggtggctcacacctgtaatctcaggactttgggaggccaaggccggtgaatcatttgaggtcaggagttcgtgaccagcctggccaacatggtgaaaccctgtctctaccaaaagaatataaaaatgagccatgcatggtggcgcacgcctgtagttccaggtacttgtgaggctgaggcacaagaatcgcttgaacccagaagacagaggttgcagtgagctgagatcatgcccctgcactccagcctggatgacaaagtgaaactatgtctcaaaaaaaaaaaaaaaaaaaaaaaaatgcttgggagccaggtaatactcaaagaagaatgattgccactgggcttttctcaaacccactcatctgtcagtcacgtttgaaaattatttctcaggtcagatacggtggctcacgcctgtaagcccagcactttgggagacctaagcgggcggttcacttgaggtcaggagttcaaaaccagcctggccaacgtgatgaagccccccgtctccactaaaaatacaaaaaattagccgggtgtggtgtggtggtgggcacctgtaatctcagctacttgggaggccaaggcaggggaatggtttgaacccgggaggcagaggttgcagtgagccgagagagtgccactgcactccagcctgggcgacagaacgagactctgtctcaaaagcaaagaaaagggaaaaaaaaactgtttctctgttaaaggaaaggaagtagctcacctgactgacatatatgtgtccagaaatgaaatctttacagtgacctgttactgtcttaatgataaacattgaattattgacatctactttatctgaggcgttatcctaggaactttatatgcgttgtctgtaatccttatagcatccctcagaaccacattcttccccttctacatccttccttctcaggtaaggaaactgaggattgcctcaaagtcacatgactatggtaaagacatttttttcccacatgcttatgactaaatgttagtactcgctggaaacttcataccagacatcccataccctttggactgattaactcatagcaggggaacttgggccttagagtcactgttaattggaggttagtggtatgtggctgagagaaaattgtctgggaaatgcatttgcccttcaagctcagaacccagaaagcttttgtcagagccagccaggactggctgcaggattttggaatttcagaaattttgtgagatttttataatattaaaaattaaaatatattaaagtataattaaataaatcatattaaggatgaagtaggtcgggcatggtggctcacgcctgtaatcccagcactttgggaggccgaggcgggcggatcacgaggtcaggagatcgagaccatcctggctaacatggtgaaaccccatctctactaaaaatacaaaaaattagccgggcgtggtggtgggtgcctgtaatcccagctactcgggaggctgaggcaggagaatgacgtgaacccgggaggcagagcttgcagtgagccaagatagcgccactgcagtccagcctgggcgaaagagctagaatctgtctcaaaaaaaaaaaaaaaaaaaaagaatgaagtaaagaaatactcaacactcgtcacttcctaaatattttactattgtccatgctttggaggtaattgacatctattatatctgtgttgtggaaatactatgtaatggggtgctaccatacatcctttccaactttatgttcagtgacttaacattgctagcttgaaattagctatggcaggagcatttacaccatggaaatcagcaaatatgataaatcaatgcttgatttatcattttgttgcttgtctacaattaagaatgaagaaattattaatgcaaattaaacttaaaagtgtgttaagtctacagctgctacatgggaaaaaggaaatttttcttccaatattcaaaagctattatctgattcaccaaagaatttgctcatgtcattaacaaatgagtgtaattccaacatatatgttctttgtttcactttcttctaaattgttaaacaaaaatgtgaaccagcattcatgtgggaactatacctgctcatcagttgaaactataggttaactatggatagaaaaggctggcagaactcattgaaagcattctgtgaaatcagtcctctaaatggaatttattatttttaaaaatactattatttgtaaactatgtggtacacatcctttatttacagtaagcattttttttccatagaaccagttgtaaaacatttgccagaccactagctgtaaggtataactggtctgcaaactttgcacctgccagaaccacagagtaaaatcataccttccccaaaacaaaggcaccattttgaacacagttggaataggaacatagcttttaatcctgttgtttaaaaagagaagctaaaaagtatgctgactgcttttaatatttttcccattcgtccactagcaggagtgaatactgtcaagaagtcttcaaactacccaaaagcaagttgaagataagcttctatgaaatgtcatgcatttttgtagtgtgtgtatgtactatgttttgctaaagaagattatagaatccatctcctggactttggggacttggggggaacagtgggaggggggcgagggataaaagactacaaatgtggtgcagtgtgtactgctttgatgatgggtgcaccaaaaatctcacaaatcatctggtatgtaaccagataccacctgtacacccaatagcttatggaaaaatagaaatttaaaaattaaaacattaataaaatatgtataattatttaaaaaaatagtatctatttccaagtatctttggcttaagcagtaggattttttttccccaaagaacagtaagttaatgcactttacatgttaatatttccagctaagaaaacattaaggattgaaaattaggaatttaagctggtctcatatttatttagttgagtgaattaaaggggggttaagagtttatcagtttctggtgttcttttacttctaccctgtaccactctctagaaatacacttgtgatctgtgaattgtcacgcatatcgttatatgatcatttacttaagtctactttaattggttttggatcgtttccacaaactatgtttctgcattacattccacattgcagaaggtggggctgctctgttgagtttcgcttataaataagcaaacattctttgacctgcaaaattccaagaacagccctccttcctacctgacccttatatatttctaacacttgttaatagaaaaattgaatgaaaaaaacaacaactaaagatccttccaatattttctggaaaattgatttccttttgtgggagttggagtgtctaactggaagggataaaaataatacctgagcaagttatatttgactcatatttgaacagtcatctaatggaagacaaatctatgttcgcaaagtctttgtttcccttagggaagtaagtggattgccaaataatggtgggaaatgcttacagtgcatattttctttgtgattatcaggcagaattttgttctggttttgggattcaaaatatgccaggttctttattttcttaggatgtccattttacctagttcattgtaaatgacactgaaaggaaaccccgatcaaagtttttggcttcctggaattttgctgttgcttgggggaaaagcaatgcttttttttctgtttggatttttcagtggcatttaaggaagcaagatgaaataggtaatccatacagaaataatcatcttgtttttctttttgaaaatcactggtccaagaaagatacaatttaaatccaaggtcattggcattgatcagaatagatagctgatacttttcctgaaagatgaaccataatattttagcatcatgaagcccaggaatgtgagccacaagaacctgggtccaggaaagtcatgtaaatccattctggcttggccacagctggggccttgactagagttaccgttttcttaaccttaaagccacgccttggactctgcttcctttaatctgaccagactgtcttgaatctaatagtatgaggccatgtatttagggtcagttagctgattattgagtacccactatgtgcttgctactgggttaaacatgatagcttccttatggaatttacatttgtcttagtccttttgggttgctataacaaaataccttagactggccaatttataaataatagaaatttatttcacataattctggatgctgggatgtccaagatcaaggcatcacagatttggtgtctggcgagggcttgctgtcacccataaatggtgccttgtgactgtgtccttacagggcagaaggggagggcagctcccttcaacctcttttgtaaggacactaatcccatttgtgaagtcagagcccttgtgatgtaatcaacttctaagggcctcacctcttaacatttccacacttgggtttatgtttcaacatatggattttggagggacactagtgttcaggccatagcaacatttagcctagaacagcctagaaatgggtgagaattatttcctttattcaactagaattgattgaatgcctatcatatactaggtgctcttccgcatactgaggattcaaatgcgacaaattccaactcttgtctaagaggtgcaagagagtgccatgagagttcagaactaggacaactaatccagctagaggcatccagggtactttccggaagaggccaacactgagtgggaagtcagagtcagccagatgctataaggagggctttccggagagaaggctgtccatggacacggccagtaaaaactcccaaagtgtgacagcgtgacgtgtttttgaaagaatcgagggctgggcgtggtggctcacacctgtaatcccagtgcttggtcggccaaggcgggaggattgctttaaagcaaggagttcagggttacagtgagctatggtcccatcactgcactgcaaactgggtgacagagtgagaccctgtttcaaaaaacagaatattttttctctatatccacaccttgttggatatgcccacaatttggggccatttacagatggagtggggggccacagtgatcctaagagccagggagggaggagcaggaagtgggaaaggggtttaagtagacagcttccagagccccacttcgctccacctctacctggatttctgttcattcaggtctcccacaaccaagaggtgtctggtgagaagatcagtaaatcacctcattttgattccacattcgtaaagaactgaaaatcgctatttcatgacctgcgcttttcctcgcagtaaccctgagagtttggaaaggggcattaccaccaccacattatggatgaggaaattgacatcctcagtgtgagcgatgttgctgggtccacagttcaacatggcagcgctgggactggagctgtgtttcctgggcctttgggcccaggcagtagagtataggtttaaatcttggctctaccagttgctagctagaggatataaagcaagttccttaacctgtttaaccttgcttcctcctctgttagatgagcttcaaaatagtacctcctaagtggttgtgaggattaaatgagatcatgcacataaagtgcttggcacatagtaagcactcaataaatatttattccattaataggcactgaatcagattctgtggttgcaaaactgggtgtgacacgagtacaaaacagagacagacaactacataactggccatatagccaggggataggctctgagtaagcacttagcacagcactttgatggttctatttgggataggggcacagcgggccaaaagctttcacagagaagatcctattaggactttgacccagaaggtagaatttcactccccttgaaagggcaagtccaactaaagagatgcaattctattagttacctattactgtacaacaaattaccccaatatttagcagcttaaaacaacaaacttttttttttatctgacagtttctgtaggccaggaatctgggcgcaggataatggggtgcctctagtttaaggtctgtcagtcaagctgtcagtcagggctgcagtgatctccaggctggactggggcatggagaatccgctttcaagctcactcaggtgtctcttggcgggtctgaaaaggtacacttccaagctcactcgtgtgactgctagcatgcctaggtttctcatcaggtactttctttatcctgtagagatggagtcagcaaactttttatgtagagaaccagatagtaaatattttggactttgccagttatggtatctattgcaactactcaactctgctgtgtagctcaaaagcagccacagacaatgcataaatgaatgggcctagttgtgttccaatagacatgtatttgttctctctcttgctctctactaaaactgatagcttaaccaggatatcaaaatacattacaaacctcatgtagaatgggaaagatttaggggacgacaacttaactgacagttcaggttctttttggtaatacatgtagtcttagtcactggtggcatggctggccagctttggggcagagtgacggactcatggcagcagggcccttgcctgccataagaaaagacaggcccggaagctgaagggccagtggcatcataattacatctttccagtaattgattgcttgacctgtgccaatgtaacatatgtaacccataagattgttcttaaggctcataagatatagatacttaaggactcacagagagtgcagtgtctacacaggtatgttctgccctccagaatttcccttaaataattgcacagaaatctgtccctaatatttccttttgcattacatgtatggtgtacctagaatctggcttttctaaaacaactagaacatcagcaaggtgtctcagaggttgaaaagaggcctggatgattctttgtgcttgtgtttgaggctgtcaatatgttaaagtagtaaaataatgacaaagcagcattataaacattgaagaatattttaaatgcttacatgtacaaatttgcaatattatacacatgcataaaagtggtagaattttcctagtctagaaataacataaggaacagcaagtgatttgttatagaaaaaaaatgaggctgaggtttaaagatacatgaagaacattacctttcttcagtcctgtcagtgcggctctgggcatgtatttggagatagtgtcaggagcctacatttgagttctctctttgacaggaagtccaagttattcaacttcctgtgtctcacattccctgcctagctctgcagtgataggctttgttgcatgcatccaccatactgaagactccatgatatataataaatgaagaagcttaaactctgaattctttctccaaaatatattagttgtgtaaccttatgcaagttatttaggcttgctaaaccaatttccattatcgtaaaatgaagctaggacactggaatgcttatttcacacagagttgctgggaaaagaacaagatagtgagtgtaaagtatcaaacacatagtgaatgctcaagtgtcagataccatcaccatcttcaccgtcatcaccatcaccaccacttccactgtcaccaccatcaccaccatcatcattaccaccacaaccctgtcacacacacacacacacacgcacacccatgcatcagaaccagagcctcaaatcttggtttgaaaatctgttgagtgtaacaactgggactggatccagtgaagagtcttatggttataacctccctgagccctcctgcatgtgtgaactgttagcaccacagccgcagtgacttggccctgggttctgcttcattccaccctcacctgtccttggtaaataaacatgtatgtgcaagacagtttgtacatctcagacaaatctcttctgccacatgtgtgagaaaattgagacagaataaggactttataactagaaaagataaaatccaaagggcattggggcatctgcagattcacagaatgactgtcagtcatcattcttgggcccctgatgctaaaagagacacaccttgccatctccacctgggaagagcttgtgctgcaaagagagagaacatgatgaacttaacaggagttaagaatttggctctgattccctggagtctgttaggtggggtctttagctgtttggaaaagaagggtttctgcctgggacaggtaataattgctgaacagactttccttgcactttccctggaggtgtgaatttgatagcagtgatgccttgcagattatcatttcctggtttatgatggaggaacttaatctcctgtttaggtttctaactgccaggtcccataggttacttacttcacaacagaaaaatagaaaagaatggaaagataaaatcaaattcatctcacacattaaaatcatggcctgttatagtcagcactgtagacactgaacttggaagctgcaaggagggtgatattaccaaaaatgttaagttccaaaaatgttaaactctagagagaatggttaattaactgtcaggggtcactgtagggtagatgcatgtcgcaatgataatctatgcataccctaagaatgacccccacatagcactcgcacctgaatgtgtgtttggagttccaagctaaggaatctgggagtggccaagccagagattcactccttatctatgaggaacatctgagcccccagccgaccctgtgaaaaacagaccatacatgggattaaggcccttggttttcagttaaatgaaggttaagtagaagctgttaaaaggaggatgttacgtgaaaaatgttatataaacgacatgcttctcttgagtggctgtggttatcgcgttctgctgccactggtcctgtggttctcctgttcagcctgctgccactggtctgtcctgatatgtaagttcccctctaaaccctgtggcagccgggcgcggtggctcacacctgtaatcccagcactttgggaggccaaggtgggcaaatcacctgaggtcaggagtttgagaccagcctggccaacatggcaaaaccccgtccctactaaaaatacaaaaattagccagatgtggcgcacacctgtaatcccagctactccagaggctgaggcaggagaatggcttgaacctgggaggcagaggttgcattgagctgagattatgccactgcactccagcctgggcgacagagcaagactccgtctcaaaataagaataaacataaaccctgtgtcgcattcactggctccaggtctcttcttcagcctctcggacctgctgccatcctcactggaattaatggggaattggcatgacaatcactcttggaataatttgcaagaatttaaaacaattattatgaacattgtgtattttcatggaaaaggccagagacgtgatgctaagtgaaaaaaatgggacatgttgtaaaatgatcaaaacagggtatttagcatatgcaacagcacgcatttatcatttctttatcataagaacattcaaaagcctctcttctaaatattttataagatactacaccttactgttactaaatgtgaaaaaaataaaaattaaaaaccacacaagaaaaagaagtgggacacgaagttgtatgtgtattgtatagaatttgtatgcagatggacataaacccttgaaaaaatttgcatacataacacacggttcagctgcactgattatggttgaccttttttcctctctttttccaagttttgtgcacttatatgtatttgtgcatgcgtgcataattatatatgttttaatgtagagtgtataaatcacattatgtatatgcaaacatatataacatttttaatgaacaaaggtctttaagcatttggaaaagaccagatctgagcagagcgagtgcaaaaagaaagtttttgtactttaaaaactacttagaatttggcataaactaaggactaagctttaacgttaatcgataaatgagtgaatcttacattctatcccgaatatgattgtgctttagtgaagtaactaggatttttcttttttctgtggagattctagatataaatcacggttttgtttctttggtttaaattacattcctctttgatcattacttcacacaatgaaaagatatttccttgtgcaaagtagtggttaacttctcataacctctgacaacaaagagcccctgtgtgaggacacaggaattcctcttgggatacagggaaggcccccagctgaatcgtatccaaggaagatgttgcaaagcttgcaaagcttgttcagaaaaaggagcccagcttgagctctttgctttctattcagatattggccccatgtagaggtgggggtgggagttggggggaacccatcaaagagaaatgggaaacaaacctgactgcatttacagattacaaggaaaagttaattcttgcaaccagtgttagagccaactcaggcttattatatttagaatttaactccacttggaaaaaaaccccttttttttttttcctttcatggaagttaaagaaggtaacacaaacagcccgtccactctgtggtgtaaactctgaagtaaaaaacacctgtctgcagagaagtcccaggctggctgagttcaccttgactagctctatttttccccaccagtgagtccagcatgttcccaccagttattattatgaactgaaatctcgcagagtcaggcatttggcatggtattcacggcctctccccacctaaccccagcccatcctagtggatttatctcccatcatgcttccttttccaccacccacaaaccttcccttcctcccatgctttaactccccacccccaaccttgttgggaggacttatagaacgatataaagcacccacaagtgggtctggcatgtccaggctttcagtaaatgctggtgcccttttcccttcttctctttccctttgcacaaaaagtcttcctattagaggtacttaagtcttgggacaatgatagaccctttaacagggtggtgatgagcagaaatgagcgaggaggagagtctgccctctccgccctctaccagcccctcttaggggcctccctctaccagcctactcatcaaatgctgcacattaataacaattagccacatggccgctgccatttttgtgcttctgccaccagcttttcctggttcatgcattatgtgtacacctcatgtgaaggaacgaaggaacagagaggttttgagatttttcttgaggccacacagcttataagtagtggagccgattcaaattcaggagtttctggctctagagctcacccctcttttccacttgtgctgaactcctattaacctcaatagggaaggcaccaagttcaagaggccgaaaaagacatctagagccaggaaatgagacatggggcttatttggggcctacatacagaggagagagtccagtggcggcaggctggacaatataaccacattgcccagtggtagcggactaggcaacttgcaaacagcatgcactctatacagcattttcacttaccctccccttaataacctccacctggcaaccttcatttaacccaaaactcaggtctcaatcccctgtacagcgcatcttccattggacaggccgggtctcagatgtttatcatagataaggaaggaatctctgaggtggtcactcctggattccctagctcagaacacacattcaggtgcatctgtcattcagggtcattctaagggcatacttaaattattaccaccaggtgcatttaccctgcaccactatgcaaaagtgtcttcccaaagactcaccgacttttggtcaccagcagcatttgtccccaacacctgtgggtgctcaaaccgtatcaggagaagaaataccccctcctagttcaggggtggctccacttgaaaaataacattctacaaagtaaaaattccattccatgtacagataaattgcacggataaatatcaagcaagaatctatttgctaacagaccacggaatgttgtccttcgggtgtttaatgttgtacttgaatatgctgtaaaaaacgccatttaagaacgtgtagatcagcactatccaatagaactttctgtaatgaggaacatgttctatgtccatactgtacaatacagtagccactagccacatgtggcttttgagcacttgaagtatggctcattagtgtaaccaaggagctgaaattttaatgtatttaattttaagtaatttaggtagccatatgtcgttagtatttaccattttgactgtgcagctccagaatattcagaaagattggttgtaggacaccaccccaactccattttcatagtgttttgcctataatctctattatatcattgcatctaattgcttaggtgcacccaccccactaaattataagcttgatgtcttattcatctgggctgtgatccctactagcatatggtctggcccgcagcactagatgtttaataattaatgcaagttaaataaatggatgtgaactggctcattcagaagccagattcctactgcttgctatcatctaattcactctttctcatgactttctcttatgactagactggtccccaaatctccaggtcaagcccagtctgctcacctgtaagcacatttttcttttctcaaacgaaatcgctcttttaagtgattgttttggtatttgcctctttctctctaaatgcatacttctattactatttctttggtgggtttttttccataataggcatcatcttccacagtggaagaagctaccacctccagccctaccatacataaggaatgccaccattctccactgaaccccctgcctttaatttgggttagaggaattttataactgtgtaaatacttttgaaagctaaaccagggagtggattaccattatatttccttttctgtacagtgtttttctgcaggtagcaaagggcttgtttctcatttattgaatgttctgtatacctaccactgattcaacctcaaattatttccatgttgtataaatctttatctttgggacactttagttattctgttcatttcatctcttgaaagaaggctgcctggctgggcgcggtggctcacacctataatcccagcactttgggaggccgaggcaggcggatcacgaggtcaggagattgagaccacggtgaaacccatctctactgaaaaaaaaaatacaaaaaattagccgggcgtggtggcgggcgcctgtagtcccagctactcgggaggctgaggcaggagaatggcgtgaacccaggaggcagagcttgcagtgagccgagatagcgccactgcactccagcctgggcgacagagcaagactccgtctcaaaaaaaaaaaagaaggctgctagagccttcttagcttctccaatctgaacaagctgtgccctctcttgtatacactggaggcattctgggatctcccatcaccatcatccttggtaatacttttgcctctcttctgtgtttaatgccctattttatctatcccttgtcattccctcttggtttactccctcacttgttttttacatcttctagtaacttctgatagcctgagaaaagatatatggatgataaacgttttgagacctttcatatctgaaaatgtctttatcctaccctctcacttaattggtagtttggccagatttagaattatttgtgtgtatatatgtttaagaagtccaaaatcatgctgatgcccagctctttgtatatcattgagttttttttgttttatgtttccctgggaggctactggatctttacttttatcctacttctgaaatatctcagtgatgtatgttgattttgattctatttttaaccatttcactgggcagttggtgagtcctttcaatccagaaactcatgtccttcaattacgtaaaattttctcaaattattttgtgacgaattccttcccttcttttgtttattctctcttcctgcaactcctattatttggatactggatgtcctggattggtcttctaatttttttttatcttttttattcaattttaaatgactttatctcttttgctaatttatgtgagatttcttcacctttttcttctagattctctgttgaaatagttatttttgctcttttgttttaatttcaaggagctgttttttttgttctctgattaaaaaaaaacatagctttcagtttgggggaacaagtaacatgatgaggatgttattgtcagtggcttggggtttgggttgggggttggttttttgtttgtttgttgttttggattttcttttttctattctttgtttcctccaagtgctttttgttggttgcttggttcttttttgtttttttttctgttttttgtttttttgttttttttgagatggagttttgctcttgttgcgcaggctggagtgcaatggtatgatcttgggggcacaacctctgccccccgggttcaagtgattctcctgcctcagcctcccaagtagctggaattacaggcatgtaccaccacacctggctaatttttgtattttcagtagagatggggtttctccatgttggtctggctggtctcgaactcctgacctcaagtgatccacgcaccttggcctccccaagtgctgggattataggcctgagccaccgcgcctggccaggttgcttggttttaatctctatctttatggtagagacttttgttggtagaaggtagctgccaggcattctcacagaaacaaggaggggagcaggctgcagtccccaacatttcctgtgcatgtgttcacttaatccccctgtttttggtatgaaacccctgccctccactgtgtgtcctctactgttgtttccagtccagaaaccctgtttcaccctttcctgacactcaacctgcattctttggctgagacggaaagtagaaaccactctaaggagtgcaggaagagatttggtaacctgacttcttaaaaaccttccaaactattcttattttagtcctccataattcactcttactttccttgggactttaaggattctaccatctaaattgggctaatcctttgttttccagagtgctgatttaagaggtcagtgactttactttctgtttttacctcctctattgctctccctttgggtttctgcctttgtttcaatgggaggtagttggacgtgtttgtcctgtccatcacctttctgttgtcatccccccattcattgtttcagctcagtaggttaactgataacttcaggatctctgaaactctgtatattgtcctcctgccaactgtctcatttatggaaccactgttcttccattctgtcagcctccaaaaataataattctaataattccttcttttatcatacaaattccttcttccatggaaatctggaactttttcccttaaaatatagtacatatttacagaagtcctactttgtatttctttttgaagaaataaagataatgagacctgatccttagattcaaggaacttccattgtagtggctgggagaaaaactgcaaactaatagatgatgagaaggaggatggggatgatgatgataacagtgatgaatcaagcaacagccaacactgttgaaattatactttgtaccgactgtgctccataccttactgtgttctttcacttaatcctaactactgtctgaaaaaggtactgagggaacagaaagaccctctcatattgttttatattgttttatactcagtacctgttttaagaaaaaaaacaaggaagtgaaatcaaagacaggcagcctggcgccaggcctaaaaccaggactgggcctgcctggcctaaacctggtagttaaaagtcaactcatgacttagaacccaatgttacccatagatttcaggcattgtatggaagaacattgtgaaactccctgctctgttctgtttcactctgactaccagtgcatgaaacacctgtcacatgtcccctagattgctcaatcaatcacgaccctttcacgtacaatctttagtgttgcaagcccttaaaagggatagaaattgtgcagtcagggagctcggattttaagacagtagcttgctgatgctcccagctgaataaagcccttccttctaaaacttggtgtctgagaggttttccctgcggctcatcctgctacatttcttggttccctgaccgggaagcgaggtgactgacagatggccgaggcagccccttaggtggcctaggcctgccctgtggagcatccctgcaggggactccagccagcctgagtgacgcgatccaaagaccgctcccaggtaggcaattgccccggtggaacgcctcgccacagcagcacgtagcaggcccctgcagtggctgagcaccaggaaggaactggcatttagagtctggacatctgaaactaggtaagaccagtctttggaacttgcccactccatttgagtggaagtgtggcctgatcacccacggcatgccttaatcggcactttgatgttgattttgggtttgacttggtttgaattgcttgacaggactggtcttgggaacttgcccactccatttgagtggtagtgtggcctgatcacccatggcgtgcctttatcggcactttggttttggttttgacttggtttaaattccttgacaagactggtcttgggaacttgccttctccattcgagtggaagcatggcctgatcacccacggtgtgcctctaccggcactttggtttttgtttttgacttgacttagattgcttgatactttggttttggttttgacctggcttggatttctggatactctgattttggtttggtgtgaactgcaaaagtgtgtgtgtgccctttttaagtgttttttgttttgtggtgtgcatgtggtgtgagtgtggtattttgtctcaaagaagcataggtcaggcacaaataagcccaccccactaggaactatgttgaaaaatttcaagaaaggatttaagggagattatagtgttacatgacaccagaaaaacttagaactttgtgtgaaatagactggccagcattagaggtaggttggccaccagaaggaagcctggacaggtcccttgtttcaaaggtatgacccaaggtaacctgtaagccaaggcacccagaccagtttccacacatagacaattacacctggttttagacccccttccccacccaacagtagttaagagaacagcagcataagtggctggcagaggcaaggaaagaccagcagggagaaaaagaggccatctataccaattctaagttaatttagactaaacaaggtcttattaatagcaaaggataattgaaatcccaaacttacaaggttttcaacagaagtgaagtttgctaaaatttaacagcgtaacatgtattatggtaacttctaatcttgtggccttacacagtctagtccaaagacacaaagaaagttctctttaaaaaaaaaaaaaatggttatcttcaaaaaaaaaaggaaaaaaaaagggggggaggcagaatttatatcaaaagagtgttatatggtaaattcttgtcctgaaataaattaactggttgtttaaagaaaaaactacttgtaataagtcagaaagttgagacacgttgaaaaattgtctgtgaaagtcgtgaaagaaaaaaagttataaaaaaaagttatgcaaaaaatgttgtataatttaaaagtaataaggcctcctgagtactactgaagaaacagtttatgtgcaaggtgtataaagtaaaatatatctttggtaaaaatattataaggaggcataagaatgtggatttttacctacattaaaaggttaaaaaaaagttattgttttaaaagtttaagcaagttttaaaatgttaattgtaaagaaaattctgtgtataaacatattagctaaagttaaaaaggtatcatccagtttttctgtgaactggatattaaaggaaaaatgcaacaggtttttcttaaagcatcaacctgctctttaacaaaaattataaaaggttaaaaaaaaagagtctataaaatcttaccttatggtcaaacatgaaaaattggataaatatgtctacaaggttttattaaaattaagtttaacattaataacacactaatataaaggtaaaatttagtttatctggtataaaaatcatacaagaaacattattaaacataaaatggtgtttagctttctttggtctaaaaactaataaaaataggtgctaaaagaaacattcattttactagaggatcataaaagttaaagacttaaactttggcaattaaaacagcataccaagatgcaaatgtctggttgaaatggatcaaatattccatctgcatgttaaacaaaagcaattgtgatgcttgtgcacatggcagaggccctgtttatctcccttccactaaggtggtcctccagtcgaccaggcatgggctgcatggtagctcttttccaggattctacagcctggagtaataagtcatgccaagctctctctgctatatcccggagtccctgcaggtcagacccgagggccatccagcctccatgccccaacactaagttcacttcgtgtctctcaccacagggaggaaacttagcattccttggagacctgaagtgatgcgatgagcttaagaattttcaagagcttatcaattagtcagcccttgttcatccccaagcggatgcgtggtagtattgtggtggacctttactgggcactctgccaaataactggagtggaacttatactttagtccaattgcctatccctttcaccctggcatttcatcaaccagaagaaaaaaaaaatggcatttggagttttaacccagactgtagggccctggccaaggccagtggcctatctctcaaaaacaactagctggggtttccaaaggctgacccccatgtctaaggtccctggcagcaacggccctgttagcacaagaagcagataagctaactcttaggcaaaacctaaacataaagtccccccatgctgtggtgactttaataaataccaaaggacatcattagctaataaatgctagactaactagataccaaagcttgctctgtgaaaatccccgcataaccattgaagtttgcaacaccctaaccccgccaccttactcctggtatcagagagcccagataaacataactgtttagaggtgttggactcagtttattctagtaggcccaacctccgagactacccttaaacatcagtagactgggggctgtacatggatgggagcagcttcgccaacccctgcaaagtgactctgaagaagacagcaagccctgctccagtcacacccagaagctgactggtccacacaggccgaagcatgaggaaactcatcgtgggacttattttccttaaaatttagacttgtacagtaaggacttcaactgaccttcctcagactgagggctgttcctagtatatacatcaagtcactgaggtaggacaaaagattgctacagtcctattgttttacagttattgtgaatgcctaggaactccaaaaggaacctgtttgtataataacactcagtaccaagtatgtaatccaggaagtgaccagcccgatgtgtgctatgacccctctgaacctcccatgatcacagtctttgaagtaagactaaggactggtccttttcctggtgacacaagtaaagtaatagctagaacagaagaaagaggggtccccaaacatgtaaccttaaaatttgatgcttgtgcttctattaatagtaatcagcaaggaatagggtgcagttctctagactggaaaaaaaagttacacagtaaaaaaaaaaattaagtatatctgtcaagaatcatatttatgtgagatgtgtcaatactggtcttgtgtcatttggacttacttggaaacaggattaaaaaggtcctgtttggctccagaaaggaaaagcagccccactgtgggagctgcagccctttagaactggtaatcacaaacccctcacacccaaaatgaaataaaggaaaatatgtatcattgagcattgatggaaaaggactagatcctagtgtaaacatcttaataaaaggagaggttcaaagacgctctccagaacccgtatttcagactttctatgatgaactaaatgtgccagtacctgagattccaggaaagactaaaaatttgtttttgcaattagccgagcatgtagcccagtctctaaaagtcacttcgtgttatgtttgtggaggaactataacaggagatcaatggccatgggaatcccgagaattaattcctacagacccagttcctgatgaattaccggcccaaaagaaccaccctgacaatttttaggttctaaaggcctcaattattggacaatattgcatagctagaaaaagaaaaaattcactcattctgcaggatgatttagttgcctaggacaaaaactgtaataatagtaccataaaaaaaaaacagttacatgatagagttccagttacatagacagagatccattcagtaaatttccaaggttgcagactgtctgggcccacccagaagtccactgggactggactgcccccagtgggttatactggatatgtggacatagagcctatgctaagctgcctgatcagtggacaggtagctgtgtaattgacaccattaaaccatctttctttttactgcccgtaaaagcaggcaaattcctgggtttccctgtctatgcttcccacaaaaaacgaagcgtagccataggtaattaaaaagatgataaatggccccctaaaaaaattatacaatactataggcctgccagctagacacaagatggctcatggggatactggacccccaattacatgctcaacagaatcatatggttgcaagctgttttagaaatcatcactaataaaaccagtcaaaccttgactattctggcccggcaaaaaaaccctcagataagaaatgctatctatcaaaatagattggctctcgactacttgctagcagctgaaagagaggtctataagaaatttaaccttactaattactgtctacacatagataatcaaaggcaagtactcaaagacatagttagaaatatgacaaaactggcacatgtgcccgtaaaagtgtagcacagattcaaccctgaagccatgtttagaaggtggttcccagcactagaaaaatttaaaactcttataataggagttataatagtaatagaaacctgcttactgctcccttgtttactacctgtacttcttcaaatgataaaaagcttcatcgctaccttagttcaccaaaatgcttcagcacaagtgtactatataaatcactatcaatctattgcacaaaaagacataagtagcaaaaataagagtgagaactcccactaataaaaagtgagagtctcaaaggggggaaatgagggaagagataaaccctctcatattgttttatattgttttatactcagtacctgtcttaagaaaaaaaacaaggaagtgaaatcaaagacaggcagcccggggccaggcccaaaaccagacctgggcctgcctggcctaaacctagtagttaaaaatcaactcatgacttagaacccaatgttacccatagatttcaggcattgtatggaagaacattgtgaaactgcctgctgtgttgtgtttcactctgactaccagtgcatgaaacccctatcatgtatcccctagattgctcaatcaatcacgaccctttcatgtaaaatctttagtgttgtgagcccttaaaagggacagaaattgtgcacttggggagctcagattttaagacagtagcttgccgatgctcccagctgaataaaacccttccttctacaactcagtgtctgagaggttttgcctgtggctcatcctgctacagtactattatcattgtcattttatgcataaggaaggagctagtgaggctatgtaactcttgtacaatactatgtgtaataaacatataaaccaatgtgctaagagaaaccaggggcagtagaaattaactcaaaaatccaagaagtcttgaaataaaatcacttccaaatttgctccttcctctggattccctttgatgccaccacacgccaggcttttttttatctcatcattaaattgaaagggtaaactcttagcaagtctttctgtacccaacccttttcattttctctgcttaccactggtaggtcatgctttgtaatatattgcttccatcttgtcattcaccacttcagaacctaatttgtttgcctatcatgccatatttggtcttctggacctactttcagtaacctggccatataggccatatccatcttgtaaccccaaaatccaacatgggtctctccattgtctttcacacaagtcctgttcttttctacctttttgcttttactaaaactgtcctctccgcctaattaatttctacctatctctcatggcctcatttttccataaagcctttcctggcagcttcgttgcagtgggattacattttctcccaaactcccataacgcttagtgctgactggctgtaccaggcatcaggtcttccccatgtacaagcaatagcttgcccaacaaatgagttatttatacttgtatccctgtatagaaacacatattttccaggcaccagcagtataccaaaaaatatttatttttgaaaagatttatcacttcaaaaagtcattctgggaaaaattataacttctttgatgcatcttatttcatggttattgttattttgacacctgatctttatagttcttggagctgataaacttcttactttacccctggatgttgttagtttcatcttagaaggacttctttgtataactgtgcacaacgtagacacttgtttgatatagggtattgtttgtaaaatttttgcataatatattgctgaaataaactataatatgggattaatgccacatttcattaaatattagatgccattgattgtaacatgtaccattatcttacgtaacacaaagatagaaaataatgctgccaatgtaaccatgatgtgccaatgattgctagatacattccaattccagatatgttaaaaggtaaatgaatacacgtacatcttagaatcgataaaatgtgagcgttgttgtgttataatattatgcattggtattaggcatctttaaattgccaatgatatttttaagtcaaattttttaaaacatgcaaggtaccacctatatgcaagtcactgtgccaagggacacaatgtgcagataaacactgatgaaaccatggctttctctactgagggtttatagtctgatagagggaacattgtataaatgaattatgtactataatccaagacggaaagtgatcagagctatccaccttgatacagtgatatagtttggctgtgtccccacccaaatctcatcttgaattgtagctaccataatccccacgtgttgtgggaggtaattgaatcatgggggtgggtttttcccgtggtattctcatgatactgaataaatctcatgagatctgatggttttataaagggcagttcccctgcacacgctgccttgcctcctgacatgtaagatgtgcctttgcatctgcttcaccatccgccatgattgtgaggcctccccagccacgtggaactgtgagtccattaaacctctttttctttataaattacccagtctcaggaatttcttcatagcagtatgaaaatggactaatacaaagagcttaaagatcctttagaaatatttatttatttatttatttagaggcagagtcttgctctgtcacccaagctggagtgcagtggtgcaatgagctcgctgcaccctccgcctccaggttcaagcaattctgctcctcagcctcctgagtagctgggactacaggcatgtgccaccacgcctggctaatttttgtacttttagtagagacaaggtttcaccatgttggtcaggctagtctcgaacttctgacctcaggtgatccacctgcctcagcctcccaaagtgctgggattacaggtgtgagccaccacacccggcctagaaatattttaaatagagtaattacctttattttggaatttttcaaagtcttcctggagaaagtggtgtgtgaaatgagttttgaaggatgaatagaattttgcaaactattgattggtaaggaggtatgccaattggggaaaataatatgtgcaaaggtatagaagcattggcattaaagaataatgaaaagtctagtttggctggaaatagaaagtagctggaggagttccccagataaactaggaaggccatggatgtcgtattgtagaaggccttgaatgcatagctgaggatatttaagatttggtaggcaatacggaaccacttaaggtcttttaacagtgcagtggtttaatgagagcttttcattacatagctggctccatctcatcttttagatcccagtttaaatgctaccctctcagagggtccaaccctcactctaagtgaattctcacctataactccaaattgccacatccagttggtttcctaggaagcacttaccactggttttgatctgtctaccaaccacctggtaagttgcatggtagggcaagtagggcgttctgttcccctttcatactctcagtgcttagcactctacatggcacttcttaggcactcagtaacagcttactaagtgtgcagacatctgagagtagcttctaacagacagttggatactttgttcaaaacaaaaacaagaattatgtgacgttatcaattcatagaggacactctgagacaggaggccaggaaacaagtcctggctcctccctaccgattccttgcatggccctggataagtcactaagactcatgccctctggtttgtttatctttccgaaaatggttgtggaggaactgactgctgaggtcttctcttcagaaatgctgcatcatccacatgcaaaatatgggtctggtgcttaggagacaaagggtgtggctcgagaggtggattttggatttgttctacagggaatacagtataatcaaagtcaagataaggatccagtttttaaaatggtctcgatcctctgcacagcatttgatgctgttggactggtagctgttctctttatctgaggcactgtagagccctgtacctcaaaccttttctactgctgcttgtctgtttctttcacccagaacccttcaccccacagatgtagatgttcaaatcatatggttctgccttcttccctcttcacatctcactccctagggtgactcttaacactccatggaaatccttgttccccctgagtctcctccttaaacatcaagcaatccagaatatttactgctcccatcaggctgttattctataggatgcaccacctggcatcccaccctattctttccacgtttcattaaattttctaacagtctttcactacagtttttgttacctaaaatctgcagtttcctgtgcatagcatagggcttgtcacacagtaggaattcagaattctttgttgactaaatgatactccattctttctgcctcatctctgtcacattccccttgcctaaaacgccctcccgacacacctggtcactattagtttttcttttttattttctttttcttttttttgttttgttttgtttttttgtttttttgagacagagtttcgctcttgttgcccaggcaggagtgcagtggcaccatctcggctcactgcaacctctgtccccggggttcaagcgattctcctgcctccgcctcctgtgtagctgggattacaggcacctgccaccacaccaggttaattttttgtatttttagtagagacggggtttcaccatgttggccaggctggtctcgaactcctgacctcaggtgatccacctgtctcagccccgctgagtgctgggattacaagcatgaccacgcccagcccctttattagtttttcatccgatatgattcctctctgtttcagtgcctggctcaggtactgtcagcttctggaagcctcccagttacactctcttccctacctgaaccacctcaggattttgttggtgtccccttgatggcattgtttgtactctgaatgatattgtagttcattgtaagctcttctcacctctttgcttttccctgctagagggttatctccctgcaggcatggacttgtgtttctcatggcttccttatcaagtaatatttaaatgaattgtgaatactatgataaaaaataagaataatagaataatcatgggacaatgtttgagcagtgtatcagagcttaaggagttactgaacaatttaaagaaataaccaagtgagaagatttcgctgacgagaatataaaattaaatcactgaaagggtgtaaaaccattccaatatcataagacagagctcattatctcgatatacagtctacttgggagtggaataagagcctttcttgaaaatgatgtgtccatgtgtagtaaattattctaataatcatggagaagtgaatacaaatctgaacacttgttttactttcttaagttctatacatcataaacaaagatattttctaaatcatgtattttattgaaataccacacatttattcattcaattttgcttgtttttgttgttgttttgtttttttgtgggatttttcgcttagtcaaaactttgtccatcagagaagaggcacattgtcatgtaatgtttatcaatagtaataacaactagaatgtcttagtccattcagactgctataagaaaataccagaaagtgggtggtttataaacaacagaaatttctcagagttgtggaggctggaaagttcaagatcaaggtgccagcagatttggcgtctggtgaggacctgcttcatagataaccatcgttcgctataacttcataaggcagatggggcgaggcagctctctgggatctctttaataatggcactgattttatccccagagggtcctgcctcctaataccatcacactggggattggtttcaacatatgaatttgcagggggcacagacattcagtccatagtagatggcttttggttattggacaactccaacatttccagtgtgtgatcaacagtttatatgatgttccatttaaatctcactataatattattttacagactgaaattgtggttaactgtgagttgattgctgagtgtcaggagctgggctgcaaaccccagcctgataaatgtgaaaccccttgccttcctgggcaaactgttccaagccaggaactccttccccacattactgcccagtgccctttaggaaatgcttcctgcagtcacactcacgataatacctgactgtgaaaagaaggcaacccacagatctcaatgttcaacttttttgttgttgcaggaagagaagttaaacttctagagaaacctaacagacaatatccacaacaggtaagctattttatctttccatgctttggtgagaaaatctattctcttcactttctgttaaattttctatcatttggtcttctgctacagtttttattacctaaaaccttaaagccagtagacacagaagtccccaaagtctccttctttctgactcactcaggtttgagtagaattgctgtttcctttttacgtttgttttttggacatacaattctaaaacgagtgtgataatgcatggttcaaccaagtctccacactgaaaagatttccagttaatctatccccccgtccccaggcaatttcaagcttctcccgtaatgtccatgcctcagaacagtggctctcagcgtgtggtcccgggacctacggcatcagcctcacctgggtacttgttagaaattcagtttctccctggaagaaaacctaggcattaccattcaggacataggtatgggcaaggacttcatgtctaaaacaccaaaagcaatggcaacaaaagatgaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaccaaatttacaagaaaaaaacaaacaaccccatcaaaaagtgggcgaaggacatgaacagacacttctcaaaagaagacatttatgcagccaaaaaacacatgaaaaaatgctcaccatcactggccatcagagaaatgcaaatcaaaatcacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaagatgagttcatgccctttgtagggacatggatgaaattggaaatcatcattctcagtaaactatcgcaagaacaaaaaaccaaacaccgcatattctcactcatagatgggaattgaacaatgagaacacatggacacaggaaggggaacatcacactctggggactgttgtggggtggggggagggggaagggatagcattaggagatatacctaatgctaaatgacaagttaatgggtgcagcacaccagcatggcacatgtatacatatgtaactaacctgcacattgtgcacatgtaccctaaaacttaaagtataataataataagataaaataaaataaattcagtttctcaggccccatcccagacccactaaatcagagggtccaggataacgactagtcctcgagatgattccagtatactctcctgtttaggacccaggtactgtgaatacagaccttccttctctttatttctctctgagtctccttcccaagccctttaccatttccatctttgtccgaacttgcattataatcttctatatatttttactccagtggaaccagcctggtcccctcactctgtgtctcctgaaagtggtgcatgcattattcttgttcccctttgcaaattctagatggtcaagctgcctcctatctgcaaaccttatcttcctttaaggttcatgccattggcctattctgtccttttccctacttgttgcctttatctggggacttcccagtggctctagatcattcaataccataggcccaaagcctttctgactttctgcactctagtcatcctcacttccactacatttcactttccatggccacatcctggaccatgtccttcattgtagacactaatatgccaatgccaccatctcttatggctccaaattctcatgctcaaggatgccaggtcactggtcttgcttttgttccccctaacctcattaggatcctcaccctgcaggactctttcttcttccttagccaacctcttggccacacagccctaaccttttagtgcaggctccaggtccattgcttcagccatgcttgccagcactctcaagacccaagccctgttgccttatacctcaacctgggaccagggtagtaacccacattctataggcctttacctggattgccgggcactgctgggagagggaaagaatgccagaactacatgcattggcatcactcagatttttggtggccagctgaggccaaccctcagcactgctcagctgcctttcagtcgttgctcttcccctccaccacacaccattccaaaccttgtcactttgagctttcacatctagccctttcagcagacaccttgcccctacatcaagaaactcacagcttacagtcttccagcttccctccctgcatctagaactgtctccacttaaaatcacccttgcctctttccctctaggctccaaaggaaaagtgtatatctgtacatctttctaaggtgtatttcttcattagtgatcttgacttgatcctagattttcccccattgtttctactattctcagtttctttcaactatctttttcctccttggcttataaaaggtatttatctttcacctgctacgaaaccatcctataatcctatatctttgttcactgtgactgttcccttcatcttttccatctcagccaagctccctaagagttctctctcctccttttcatatgccccatgcattccttaacctgctgcagcccagcatgcacctccactgctctacaaccttcctgcatttcccaccaacaacctccttgatatgaaattcaggtgcactgttccatcctttccttatctctgaggcacctgacactctttgatggaagactgtctcctctcctgcttcttgataataaagcccaattccctccttcctctctgagcattcttcccaatcctccttatatgctcatcctcctctgcctaagagcaaacaagcagagttaagacttgcaggcaactcgcaagccccaccctcatgagttgaatagttgagaaggcaggaaagacgtcaaaaaatgaattaaataaaactgtaagttgtgctaagaatgtaaagtgaaaggtgatatgaggtggaataacagggtttaaaactggctggtttagattgggtggggtgagaaggcaaaggaaatagtctatgacaaggtccttgagatcaggagcaaaacataaattttaaagacttgaaagaaggccaatgtggccagggaaagaaaggggggacaatacaccagaaagctgtgtatgagatagaaaagacttcatctattattgtataagtttcttattaattttaagtgagttactgcagtcgacaatcataattcactgtagttatgttctataaagtcacttcaaacaaggagttagtgaatactgcacaattgctctcaggggaaatatggggttaggttcctagaagcctctggtcacaatattttcatcaactgatcaatatataacttgttttatgtgtgtttcagttgttaaagcactttatttgcatatgtattgttaattcattaacattgagctcagggctaacagcactatgactcatttctgaacaaagcttatctaacacacacattttctctgtaaggcacatcacagcattcttgcacctaggaccactagacaacacgtcagcactatgcctggggctatttttaacagtgacatcaccaacaaaaagcacaaaatgcaaacaatgggtccatgagaagaaacccatttacagtatggcacagtgccatcttgtttgagctcagctagaaacataagcatctaatgactcaaaatattttgcccactctgcacatgtccaggaatggccacacaagcaccatgagtattgatttgggggttacaaattaacgttagtaagtcagtgaattcacaaatacagaatccacaaataatgagaaccaagtgtatatgtaaagcatatcgatgaacaccaggtacataagaaggaatatgtacatttgatattttaatcatcttcattattgcatgctactaaatatcctgacagcatgagatacctctgaaaagttttaggcaggggaagtgataatgatccagattcatggcctaaaaagatcgtgactcctttgtggcaaatatgttagccagagacactagcaggtataggtgatagtaaggcgatgttgcagtcagtaatccaggtacaaaagagatgatgctgtttgaggacagggcagtgggagtgcacatagttctcctggaatgtgctctggaaatctaccagaaccactgtctgcccacctttgcccacaagccttttctaatcttcctacggttactccggagctccttgtcctatatagcatattatatgacatatttgaatctagtacttatgacactatattagtcatgtatctatatacttgtctcctttcctggacagtaaactctttctacatccctggaatcaagttcggtacttggcacataataggtgctcaggaaatatctgttgcctgaatggttggtgagtcatttaacaaacagcagagatcttctacctcttagtgtcttagcaattagcagagtgtcttacccctagtaggggggtgtttaaggcctctaaaccgtgctcagtctttccaagtgcaaaacctatttttactgtactttaaaggaatattgggttccaactctgcacacgtaggttcatctacaattaggggacaaattgtaggttttttcttgtcttccgaccagttcttgcttccagtcttgagtccggaaaaacatttataaaataaaatagttgggtgggataacttctaagattctttcaaatcagagccctatatcactctgctaaggctaccataacaaaatactctagactgggtggcttaaacaaaagaaatttattttctcagagtcctggaggccgggaggtccaagatcaagaagtcggcaaattcgattcccgggagagctctttccagcttgcagatgccgccttctcactgtgtcctcacgtgccctctcctcagtgtgctctggacccaccagcaccattcgctttcgctcacaagccttttctaatcttcccgaggttgctcaggagggagtgctctctctcctcttaaggccaccaatcctcttatgttaggaccccaccctgatgacctcatttaaccttaattacctccagaaagccctatctctaattacactcacaatgagttagggtttcaacatgtgaatttgggggaagacacaattcagtccacagcgggtactgtaagactctgggaattaccctgaactagtttattccaagcaggtggccctgagctgtgcttcctttaaaatctatttgtagccttaccagactatattatataaactcctctccacatggccacctctaaaacttcctcagcatttttagaacttaattttgtccaaatgcttcaagtttcttccagatgtctgccatctcccagatacagctacttagcaaaatcagagacattccctgtcatggagacacggcccagttcccatgtggttccagggaagatttggtcaaaacattgcccatttctacacagtgtctaaatggaactagcacccaatggttaaagaatattctcagccagggacagtggctcacctctgtaatcccagcgttttgggaggctgggacgggtggatcaccggagatcaggaggtcgagacccgcctggccaacatagtgaaaccctgtctctactaaaaatacaaaaaattagctgggcgtggtggcaggcacctgtaatcccagctattcaggaggctgaggcaggagaatcacttggacccgggagtcggaggttgcagtgagccaagatggcaccactgcactccagcctgggtgacaagagtgagactctgtctcaaaaaaaaaaaaaaaagaaagaaaaaaaaccgaatattctcgcagacaattgccatgaacatgcaaacggccaacatttcctaagcacctactatttgcaagacacatattgccagccctgtcacatgcttaagtcatgtgatcctcataggaccctgaccagtacttctggtaatgcagccataaaaatgaaagttaccatgcactgatgccaggggtgtctgacttttttatttatttattttttttgagatggagtctcactcttactgcccaggctgcagtgcagtggcgcgatcttggctcactgtaacctccgcctcttggattcaagtgattctcctgcctcagcctcccaagtagctgagattacaggtgtctgccaccatgaccagctattttttgtatttttagtagagatggggtttcaccaagttggccaggctggtctcgaactcctgacctcaggtgatccacctgcctcggcctcccaaagtgctgggattaaaggtgcgagccactgtgcccagcccggtgtctgacatttttcagcagatcctttagtaatgattgatgctgagcttgttagaaacacaggctgtcaggccccactcagagccaggtggattcctcatgacccagtgccctgtgctcctatctgtctacaagattccaccccgtacacacacacacgtacacacacacacacagacacacacactagtctttattcattaacaaactacatcttgtctgctccaaacaggagcctacttccaggaatttacagtccagagaatagggacatagcttctcaaacttttcccttaaactgtccccacgagggtacaggaggatctgggaggctggggagtgtggagaggatgaccacaagctactggcagaacttgacatctctgtgtgccttccgtttcattctagtcattcacacaaatgttgccttttcacccatgatattctgagttaattttatataacaaataatgggcttctccccccaaaaccttcgcatggggccatatttattttgtggcttacctttccctcccagctcatggccatgtatcctcatgtagaagggggggctctgagattggctcacaacacgggcagcctctggatctgggagaagtgcaaggtcagccatggaggaggagcagcaccgggtctaatctgggggaaggaacaggacccccttgactccacagacaccttcctcccccaggctcttccacagagttattgtccaaatgtacagtgggcagagaccaacccagatggagttctgatgtgcagtgattgtgtgaagaggcctctgtagaatttcaggagccttttgaccccaccattgcttggccagaccagaataaacccaatgtctagccagtgctagaggaagccctggtctcatcaggcttaaaggtgacagtaactgtgatggttaatattgagtgtcaacttgatgggattgaaggatgcaaagtgttggtcctgggtgtgtctgtgagggtgctgccaaaggagattaacatttgagtcagtgggctggggaaggcagacccacccttaatctgggtaggcaccatttaatcagctcccagcgaatataaagcaggcagaaaaacgtcaaaaggtgagactagcctagcctcccagcctacatccttctcccgtgctggacacttcctgcctcaaacatcggactccacgttcttcagttttgggactcggactggctctccttgctcctcagcttgcagatgagctattgtgggaccttgtgattgtgtgagttaacacttaatattacctcccctttacatatatgtctatcctgttagttctgtccctctggagaaccctgactaatacagtaaccatctaaaataccacatcacctacttcataaccttgccgcatagcacaacacctacactacttgggccataatttttgtttctttttttgttcttttttttttattttatttttttttgctttttgagacacagtcttactccatcacccaggctggagtgcagtggcctgatcttggctcactgccacctccacctcccgggttcaagtaattctcccacctcagcttcctgagtagctgcgattacaggcgcacatcaccacacctggctaatttttgcattttcagaagagataaggtttcaccatgttggccaggctggtctcgaactcccgacctcaagtgacccacccatatcggcctcccaaagtgctgggcttataggcacccaaaattcttgtttctgaggctttttattttattttttgagacagagccttgctccattggccaggctggagtgcaatggcacaatcttggctcactgcaacctctgcctcctgggttcaagtgattctcctgcctcagcctcccaagtagttggactacaggtgcaccaccacacccagctaatatttgtatttttagtagagatagggttccaccatgttgggtcaggctgctctagaactcctgacctcaagtgatccgcccaccttggcctcccaaagtgctgggattacaggtgtgagccaccgcgcctggtcctgaggcctttcttgtaccaagtccttctcttgagatgagtaaaataaccgctatatcctgccatctgctggtgaattgatgcaactgcacctataaaattcagcccaaatctagagaatccagttctctcttgcaaaagctattggagcacaaactgcttcttgcataatccagcggacaaaaaaaaataaaataaaataaaataaaataaacttactaggatggatgccagaaatattatagtaataaaaacaataacaacattaataataccttcactatcctactttcaacttttacaaccttgggcaagcaagttatataacctcccatttagttatctataaaatactggttcccaccttaaagggttgttttaaagttgaaatgagttaatacatgaaagatgaaagtccccaaaacagtccttggcacatagaaaacactcagtggctaactgcttattgtgattaagtactggctgtatgccagacattatagcaagcgctatgcatacttatcttagtgttcaaaacaatcctcataaactgtaactatcatcattcgcgtgttgcagattaggccactgaaactcacggaggggaagaaacttggctagaagtcacaaagctagtaagcagtggaggtggaattgctgactactctgatcctaagtcactcgcttaaccactctgctgaactgctggtgtggtgtgatcaatcttcctgaatgttcgtctaaatgccatccggcttcaccagaatcaatctctctctctctctttctctctcacacacacacacacgactatacgctctcccagggagcacccgggtgccatcatatccccagaacctagcacagtgcctggtgcataccaagacccagtggagccatcgtgaagtcagcgatgttgcacacagctgtgagcattcgtcacacacctgtcttaaggatagcaggctaattactagatggggggaaaaaatagtatcagatcttgaataaagggccacatgaaatgtttttcaatctatgaaaatgtctgtgatatgctatcgtaaagactacaggagggacaaaaggagtgacatcatcactatgttgtaataacaacaaaaaaaaccacattgaatgtgtttccacattcaacatggatatcaaagatcctgtgaacccagcagcaagaaagtcctaggaccaggccctggcctgttcctcagcattcctacagtggaagcacctctcaggtgcacagggccggcaaggccagccttggtaaaggctagagaggcagcccttctagtggtatgattccagagggttcagggccacctgtcactgagaaacaccaatttcaacccagacattctaccctcagaggctgatttctttggctcctgggaacttatttttttacatagttttctttaaaatgcaggaacaccaggaggcccagggttgccaccagtgctctgaaaaccactctgccctcctgcctggcagcatgcacctctcagcccattcccagtggagaaggggggtcactttctccatcaggagtctccctggtctgagagcctcgtccctctcagggactttgctgttacacacattctgtcccaatctcacagttcctcctggcagaggctgaagaggcatttccaaaagagctgcagagttcagggaataagacagagaacttggccttttatcattcagtcaagatcatggcctggggtgagtgtggacgtaggacccagagggcagtattgcgaagagctagttcacaaaccactgggcgtggtgccccacgtgcagcacggaagtactgaagcatgccttcagcataattctcaggatttgatgtgataacaacaaggaaatcaagtcaatgagttgaagttccccttttttcccactttatcgtttagattgttaaatttcaaagagagctttgattcacaaactcgttttgcagataaagaaactgaggactcaagagattacagcctgggcaacaagacaaaatcccatctctaccaaaaaaattaataaataaaaatagctggacacggtggcgtgtgcatgtagttgcagctactcaggaggctgaggtgggaggattgcttgagcctgggaggcagaggttgcagtgagccgagatgatgccactgtgctccagcctgggtgacagagtgagaccctgtctcaaaaaaaaagggggggagagattaaacaacttcaccatgtccatgccattggtgatggcgttatggctaggaggtaagaagtgaatttctttatttttattttattttattttattttgagatggagttttgctcttgttgcccaggctggagtgcaatggcaagatctcggctcactgcaacctccgcctcccaggttcaagcaattctcctgcctcagcctcttgagtagctgagattacaagcacctgccaccacgcccagctaattttttgtattttcagtagagatggggtttcaccatgttagccaggctggtcttgaactcctgacttcaggtgatctgcctgcttcggcctcccaaagcgctggggttacaggtgtgagccaccacgcccggccccgaggaggtggatttcttatacctgggcacagactttgcctggctaagttcacccaaacaccatatagcttaattagtttgaggagtaaaactccagtgataattaggactgtcattttgatagcagatttttcagaagtattctacaaaacatgagatctgttggttgttaataagtttgttatgagaaaaaaagttctgtagcccaataatgtagggaaataatcgggttaaacagagtgaaacagttccttctcataaccatgaatttcttcatctttaatttctgttgttcccaaacctgttttgaccagggagccttttccagggagaaaacccatgagcacttccctgcacacaaatatcccgtcaaagccagcgctagaccatgctaacacttctatcccagcacactggctattgagaatgcatgaaatggactatttgatggtgctgataacaaaagtctgcatataatccttttttttttttttttttgagacggagtctcgctctgtcgccccggctggagtacagtggcgccatctcggctcactgcaagctccgcctcccaggttcacgccattctcctgcctcagcctcccgagtagctgggactacaggcgcccgccaccacgcctggctaatttttttttttttttttttttttttgtatttttagtagagacagagtttcaccgtgttagccaggatggtctcgatctcctgaccttttgagccgccgacctcggcctcccaaagtgctgggattacaggcatgagccaccgcgcccggctgtctgcatataatctttcaagttctctaaaataacagaagcttagcctctgtaggagaaaagtaaacacatcagaaaaatttgtcccgtgagttttcaaagactgcccaaaagagtaggaaatgtttctgccaaaaaaaaaaaaaaaaaaagattgagctgtcaaagagtttatcttctagtcctttttcaactatagattcattactgtctataatgttgggcaagcagtctctagtttcttctataaaggcagcacagctcctggtagttatttttattcattcttcttgggtcaggacctcagtccctagtagcggctcactaaatatttgtctacttcgccttctggccaggttatgtgaaatctcaagctgtgttttctaaacattagcaaattgttggaaatttacatgttccattctattgtatctcctcccttccaaatactccaacttctataaacgcaaaccacctcccagcagccactttaaaagtttgttgaatagaacccttggagccggacgtccttgacccttggaattgcataatagaggttttgctgtctcccaagatgggaagggggaacaacagtctctcccatttctccgagctcctgcctccggcttgtagtttggaccactgggtagtatgagatttgattgtggaaaagggtatagaccctctgttagaatagtttatcatatctcatacccatcatgccttcattcccacgtgtcattcagcgccattccttcatttaaatagtaagaatgaagtgccccatacaagctagatgctggttggattaggcattgcctgtggggagctcatgtgtagtagggaaggcagacagccaacaagcaccaaagtccccctctaagatgcaacaacagcctgaagacaggaaccataccctttatttgcctctagagttctcatcctgggactatatatggtcttcagtatatacacaggatgatgtgtaggttggtagacttttgatgagctgccttccaagatctctctccatggtctaatttatagagactattatccttttttttttttttttttttttttttgagacagacctcactctatcatccaggctggagtgcagtggcacgatcttggctcactgcaacctccacctcccgggttcaaacgattctcctgcctcaccctcccgagtggctgggattacaggtgcctgccaccgtgcccagctaatttttgtatttttatttttattttttgagacagagtctcgctctgtcgcccaggctggagtgcaatggcgtgatctcagctcactgcaagctccacctcccaggttcacaccattctcctgcctcagcctcccaagtagctgggactacaaatgcccgccaccacgcctggctaattttttgtatttttagtagagacggggtttcaccgtgttagccaggatggtctcgatctcctgacctcgtgatctgcccgcctcagcctcccaaattttgtatttttagtagaaacagggtttcaccatgttggccagactggtctcgaacttctgacctcaagcgatcctcccacctcggcctcccaaagtgctgggattactgacgtgagccgccacacacagccatatagggaatatcttaataacatggatttcctggaggtgtcaagtcccagcccaggttgtgacaggcagagtaagaactgaccttagattcacacgtttgtttttaacttcacaccttttttttttttttctttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttttttagtagagatggggtttcaccgttttagccgggatggtctcgatctcctgacctcgtgatccgcccgcctcggcctcccaaagtgctgggattacaggcgtgagccaacgtgcccggccacacctttttagaacattttattttgacattatttcagactaacagaaaagttgcaagaaaaatgcaaagaatccccataaatcctctacccagagtccctaaacatgaacatctaccacatttgctttgttgttctctctgtctttatatacacacaattttttttctgaatcattttaagcagttatataaaccatggtcctttagctctcaaatcagtttgattatcctctatccaaaatgcttgagaacagaaatgttttagagtttggatttttttaaaattttggaatatttgcatgtatatcatgaaatatcttaggaatgggaactgagtctaaatatgacattcaaatgtttcatatataccttttacacatacctgaagataattttatatttttaataatttgtgcatgaaacaaaatttttacttcgttttcactgtggcctgtcacatgaagtcaagtgtggtatcatgtaggtgctccaaaagtttcagaaatgggagcattttggattttggatttttggatttcagatgctcaacttttactttactgtgtatttcctaaaaacaagggcattctctttttttctgccttcttcccaacattgtattgtattttcaaacatatagcaaagttgaaagaattttgtagtaaatttctgtatacccaccaccaatccatcttatattttgctgcatttcaaagtaagttgtggacctcatgtatttcccttctctgctttcacttaagcatgtatatcattaatgagaattctgtacgtgtttgcattttttgaaatgactttcattacaaaagtaatgtgttcattgtagaaaattggtaattgcagatttaaaaatctacaaatctatcagttagtagtcatttgtaccagatattgtgctatgtattttatcaacatcatctctagtcatcctttcacaaaccctaagaagaagcattatccccattttacagacaaggactctgtgagcaagttgctgcagttcccacagtggcagaatcaggatatgcatccaagtctgtcccatcccctgactctcagctgcatgccatcctgctagccttgtgtctactccaccccactctgagataaccactgttaacccttctctctcaattcttttccaggtgtgtagatttccacaaaactgtgattatattatacaagtcattttgtaactggcttttttgcacatatgcaaacctctttctccagcaccttgttaatggctgcagggtattctgttgagtaaagataccatatttaagagctaccttattgttatttatttttcaagttttcactattatgaaatcttcttgcatactactaattttatccttagggtcacaagtagaattgctgagtcagagattatgcatagtttccactgttaatacagattctcaaatttgctttcaacatctcctaccagtagtaaatgactagcagatttccctacatcctacactgacatcaagtatacattttaacaactcatttttatctgggtgcagtggctcatgcctataattccagcaccttgggaggccaaggtgggtggatcacgaggtcaggagttcaagaccagcctggccaagatggtgaaaccccatctctactaaaaacacaaaaatttgctgggtgtggtggcacgtgcctgtaatcccagctactcaggaggctgagacaggagaatcgcttgaacctgggaggcggaggtagcagtgagccaagatcatgccactatactccagcctgggtgacagagcaagactccatctcaaaaaaaaaaaagaaaaaactcatttctagttagataagcaaaaacatgtatgttttgtttagcatacctttgattgttaatcaagttgaacatattttcacatataaggctttccctttcatatactacttgttcaggtccacacggttctttttttaagttggtctcttgaataattccaacccatttcacattaaagccaatgttaagagtgaaatttttatttttcaagcagattttacttcatttatttttattttaagtttttaaaattatttttaatttttgtgggtacatggtatatatatttatggggtatgtgaaatattttgatacaggcttgcaatgcataataatcatatccaggtaaatgggatacacattgcctcaagcatttatcctttgtgttataaacaaacaagtgatattctttaattatttttaaatgtacaattaaatacttattgactgtagtcacctgttaagctatcaaataccaggccttattctttctttgtaacttttgctttgcccccattagccatccccacttctctttcacccccacccccaactatccttaacagcttctggtaaccatctatctactctctatctcctgaagttcaattgttttaatttttggctcccacagataagtgagaacatgagaaatttgtctttctgtgcctggcttatttcacttaacataacaacctcctgttctatccatgttgttgcaaagtaaaggagctcattctttttcatggctgaatagttctccattgtgagaactctataccacattttctttattcattcttctgttgcttccaaatcttggctattgtcaatagtgctgcaataaacatgggagtgcaggtatctcttcaatacagtgatttcctttctcatggatatatactcagcaatgggattgctggatcatatggtagctctgtttttagtttctgagaaacctcaaaactattctccatagtggttgtactaatttacattcccaccaactgtgtatgagagttctcttctccacatcctcaccagtatttgttgttgcgcatcttttggataaaagccattctaacagggttgaaatgatatctcattgtagttttgatgtgcatttctctgatgatcattgatgttgagcaccttttcctatactgtttgccatttgtatgtcttcttttgagaaatatctattcagatattttgcccatttttaattggattcttagattttttttttcctgtagagttgtttaagctccttacatattttggttattaatctcttgtcagatggatagtttgcaaatgttctctcccattctgtgggttgtctcttcactccgttgattgttttctttgctgtgcagaagctttttaacttgatgtgatctttgttgtccattgttgctttgggtgcctttgtttcttgggtattactcaataaatctttaatcagtccaatgtcctggagactttcccttgtcttcttgtagtagtttcatagtgtgaggtcttagatttatgtctttaatccattttgacttgatttttatatacagcaagagagagggatccagtttcattcttctgcatatgaatatctagttttcccagcaccatttactgaggaaactgtcctttccccagtgtatgttcttggttcctttgttgaaaatgagaacactataagtgtattgatttgtttctgacttctgtcttctattggtctatatgtctatgtttttatgccaaaaccatgctgtaccgattactatatctctgtagtgtaatttaaagtcaggtaatgtgattcttccattttgtttttttcgctcaggatggctttggctagtctgagtcttttgtggttccacatacattttagaattgttttttctatttctgtgaagaaatgttgatagagattgcatgggatctacagattgcgttgggtagtatggacattttaacgatattgattcttccaatccataatcatgaaatatctttctaatttttgtgtcctttttaatttctttcaccaacattttatagtcttcatagtagagatctttcacttttttggttaattgctaggtatttaattttatttgtatctattagaaatgtgatttttttcttgatttcttttttggattgttcactcttggcatatagaaatgctacaggtttttgtatgttgattttgtatcctgtgactttacttaatttgcttatcagttctaatagttctttggtggagtctttagatttccccaaatataaggttgtctcatcagcagacaaaggtaatttgacttcttcctttccaatttgcatgccccttatttctttatgttgtctgattgctctagctaggacttctagtactatgttggataactgtgatgaaaatgggcatccttatcatgttttagatttagagaaaaggctttcagtttttccccattcagtatgatactagctatggatctgtcatatatggcttttattatgtcgaggtatgttccctactatacccagtgtttttagggtttttatgaagggatgttgaactttatcaaatgccttttcagcatcagttgaaatgatcatatggtttttgctcttcattctgttgatatgatatatcacattgatttgcatatgttgaaccatccttccatccctgggataaatcccacttggtcaacttggtcataatgaatgatctttttaatgtgttgttgaatttggtttgctagtattttatttaggatttttgcattgacactcatcagggatattggcctgtagttttcttttttttgatgtgtctttgtctggttttggtatcagggtaatactagcctcatagaatgagtttgaaaatattccctcctcctctatttttgagaagagtttgagtaggattggtattagttcttctttaaatatttggtagaattcagcagtgaagctgtcaggtcccaagtttttctttgctgggagactttattacaactttgatcttgttattggtcagttcaaattttggatttcttcatcttcaatcttgataggtggtatgtgtctagtaatttatccctgttttctagattttccagtttattgacatataattgttcatagtagccactaatgatttattgaatttctgcagtatcagtcgtaatgtcttccttttcatctgattttatttatttggatcttctctcttttttcttagtctggctaaaggtttgccagttttgttatcttttcaaaaaaaaccaatcttttgttgatcttttgtattgttttcttcatttcaacttcatttctgctgtgatctttattatttcttttcttctgggtttggtttactgttgcttctctagttctttaaagtgcattttaggttatttattccaagtttttctttgtttatgtaggcctgtatagggataaacttccctctaagtactgcttttgctggatcccatagattttggtctcgtgtttccatgatcatgtgtttcaagaatttttttcagtttccttctgaatctcttcattgacccagtgtttatttaagagcttattgttgaatttccatatgttcatatcatttccaaaattcctcttggtattgatttctagttttactccattgtggtcagagaagatgtttgatatcatttcaatttttttgaatgttttaagacttgttttgtgacctaacatatggtctatccttgagaatagtccatgtgctgaggaaaagaatgtacattctacagcagttggatgaaatgttgtgtaaatatctattaggtccgtttgatctacagtacagttaagtgcaatgtttctttgctgatattctgtgtggaagatctgtccaatgctgaaagtggggtgttgaagtctccagctattgttgtattggggtctatccctctctttcgctccagtaatatttgctttatatatctgaatgctccagtgttgggcgcatatatatttacaattgttatatcctcttgctgaattgaacccttcatcattatgtaatgaccttctttgtctcatcttaaaggttttgtcttgaaatctattttgtctgacataagtatagttattcctgcccttttttggtttccattggcatggagcatctttttctatgtctttattttcagtctatgtgtgtctttataggtgaaatgtgtttctaataggcaacagatcattaggtcttttgaaaaatctattcagccactctatgtcttttgagtagacagcttagtccgtttacatttgatgttatgattaataagtaaggacttactcctgccattttatttgttttctggttgttttgtggtcttcctttccttcatttcttcttttctgtcttccttctaatgtaggtgatattctctggtgatataatttaatttcttgattttaatacttttctgtattcattgtatgtttttttaatttgaagttgccatgaggcctgcaaatactatcctaaaacccattattctggcctggtgcggtggcctgtaatcctagctctctgggagacagaggcaggtggatcacctgaagtcaggagtttgagaccagcctgaccaacatggtgaaaccccatctctactaaatacaaaaaaaattagcgaggcatggtggtgcacacctgtaatcccagctattcgggaggctgaggcaggagaattgcttgaacctgggaggcggaggttgcagtgagccgagattgcgccattgcactccagcctgggcaacagagcaaaactccgtctcaaaacataaataaataaataaccattattttaatttgataacaacttagcattgcttgcataaacaaaccaacaagaaaaaaaaccaaaaacaaaaaaacaaagattctaacttcatcccctcactttttaactttttgttgtatctatttacatattatcgtacagtctatgtcttgaaaaatttttgttattatttatgattggttcatcttttagtctttctattcaagagacatttacataccacagttacaatgttataatattctgtgtttatctgtttgcttatgattaccagtgagttttgtacctttagattatttctcattgctcattaacatccctttctttctgattgaagtactccctttagcatttcttgtaagatagaactggtgttgatgaaatctctcagcttctgtttgtctaggaaagtttacttcttcatgtttgaagactatttttgccacaaacactattccagtgtaaaagttattttccttcagcactttaaatatgttatgccactgacatgtcatatctctcctggactgtaagatttccactgaaaagtctgctgccagatgtattggagcttcattgtatgttatttgtttcttttctctgctgctttcaggatcctttctttatccttgacctttgggagtttgattactaattgccttgaggtagtcttctttgggttaaatctgcttggtgttctgtaaccttcttgtgcttggatattgatatatttctctaggtttgggaagttctctgttattatctctttgaataagctttctacccctatttttctacttctccttatggccaataactcttagatttgcccttttgaggctattttctagatcttgtaggtgtgcatcattgttttttattctttttttcttctgtgtcctctgaatatatttttaaatagcatgtcttcaaggtcactaattctttattctgtttgattaattctgctgttaagagactctgatgcattcttcagtatgtcacttgtatttttcaactccagaatttctgcttgattattttgtttcaatctctttgttaaatttatctgatagaattttgaattccttctctgtggtatcttgaatttctttgagtttcctcaatacagctattttaagttttctgtcagaaaagtcatatatctctgtttctctaggattggtccctggagctttagttagttctttcggtgaggtcattttttttttttttttggatggtcttcatgtttgtggatgctcactggtgtctgggcattgaacaattaggtattcctcatagtctttccagtttgggcttgtttgtacctgttcttgggaaggcttttcaggtattcgaagggacttgtgtgttgtgatctgagccatatctacattagaggcaccccaagcccagtaatgctatggttcttgcagactcatagaggtatcaccttggtggtcttggataagatctgaaagagttcactggattaccgggcagactcttgttccccaaacaaaagtttctctctctgtactgagccacctgaagctggggatagggtgacacaagcacccttgtggccatgatcactaggactgtgctgggtcagacctgaagccaacacagcactggatcttacccagggccctctgtaaccactagctagctagctccaatgtttgctcaaggccctaaggctctacaatcaacaggtgcaaagccagccaggcttgtgtccttcccttcagggtgacaagataccccaggccctaagtgggagctagggactgaagtcaaaatccttagagatctacctggtgctctattctactggggctgagctgtcactcaaaccataagacaaggccatttccattcttccctccccttttcccaggcaaaggatcctcttcctatcaccattactaccacaggcccacagagagtattgccaggctactgccgatgttcacttaaggcccaagggctcctcagacagtttatagtaagttctgccaggcctaggacacatccttcagggcagtggacttgcctgtggtcaagtgcaaatccagaaatgccatccaagagccaaggccttgaattagggactccaagagctcgcttggtgctctaccccactgtggctgagctggtacctaaagtgcaagacaaagtccactttacttttccctctgcttttctcaagtagaagtagtctctccccatagccaccacagctaggaatgtgctgggtctcacctgaaaccagcacatctcagagtctcacccaaggcccatagcgtactacctgggtattcctgctggttattcagggcccaagggctctccactcagcaggtgatgggtcttgccaggacttggtccttcctttcaaggaagtgcagtcccttctggcccagggtgtgtctataaatgtcatctaggagctggggcctggaatgggggcctcatgactctgcctggtgccctatgctaatgtggctgagctggtatcctatggtgtaagacaaagtcctctttactcttccctgtcttttcctcaagcacaaggaaggggtcactttcattgctgtgagctgtgctgcctgggttttgggacacgtgacacaggttctcccttagccactctggtgtctcagtagatcaggtgcccccccaggtccactggctctggccccagcacagtactgatatcttgcctaggaaccacagttcttgtggcctaggctacccttcaagtgtattaggattgcagagcactttagtccatggtggtgcggcttgccaaaactcaagttccaacaactggaatatataatttccctctggctagatctggtccaaatgctccctctgtgtgtgggtaggctggggggtcgtggcttagctgatttcagcctggttttgctttctgctctgatagggcagcactgagttcaaacgcaaagtccccaaatcactgtactctccctcccccaaacacacagatgctctctccacgacatgcagccactgccaaggaatgggcagcggcagttcaagattgtctttcctactaccctctttagtgcctctttcagcaatatgaagttaaaaccaggtacactgattgtgtacctgatttttggttcttataaaggtgcttgttggtgtagatgatagttgttaaatttggtgttcctgtggggcaatgaagtgaacatcagtggaggcttctatctggccatcttgttctgcccttccccaagagcattctcttatataaccccagtacaatgttcaaaagcaggtaattcacatcaatttaatacgattacctaatctacagaccttattcagattttaccaattatgtcaataacgaccttttagcaagaaggacatgcagtgcatcggctgtcatgtctcttaaatctccttgaatttggaagcattcttctgtctttctttgctttttcataacattacattattttaagagtacaggccagttgctttgcagactatccctcgttgtttcaactcagagtatgctcttttgtcaggaaatcacagaagtgaggctaagttctcagtgcatcctatcaggagccacatgccattgattagtctcattatggcactattacctttgattacttggttaaggcgctgtatgccgggtttctccaacgtaaggataatattttgtccttaatcatatgggggggagctactttaagactaaatatcctgtcctcctcaaaatttcacccactagtcctaccatccattgatacttcttactgacatcaattattattatgatggctatcaaatggtttttctattattatgatggctatcaaatgatttttctagttccagtatttctcgtatgtttgttagctggtttcctacttgtaaggtagagtgttccctttccctttatgtatcttagtgtggactcataagtccttgttttattcaattggctacaaatgctgtagattagtaattattttaatattccagttgttccacatttggccagtaaaacttctacaagtggattcctgtgtccttttaaaatgtccctgtcattcttcaaagctatcactatttaaaggcagcttccagatgggttgagtcttttcctatatgcccttgacttcctaatgaatactcagttaatttctctgcctggctggagaactcctgggcttccctggacttcgcccttcccctacctccattgctaccctcccagcaaggaggcttcaccaatgactgacatggcattagcatggccttctttttttattgtttgtttgtttttgtttttgtttttttttttttgagacggaatctcgctctgtcgcccaggctggagtgcagtggtgcgatctcggctcactgcaagctccgcctcccaggttcacgccattctcctgcctcagcctcccgagtagctgggactacaggcgcccaccaccacgcccagctaatttttttttatttttagtggagacggggtttcaccgtattagccaggatggtctcgatctcctgacctcgtgatagcctggccttgtttaaacacaaaacagagtcagcccccaacacagggctgcagaagcaggcggcagcagcattgggtggacacagccatcctaatggtgtttgtttttcccctgtgtaaactaagaagtggttgtgaaggattttccctttgttgcctgttgcttttttatgctccaaagaggaagcaaattttgattttgctcagtaataaagggtacccaacaactgaattcttacctttaagctagctgttgccaaaagggaggcaaggaagacagctgatagactgctcattttgaacccaatcttacgtcaaaagagcatatttttttcattgctgtgtgtcacatgctagacccggagcatttccttgttgcccctgggcttaggagaagtccttgctaaatgcaagatgtagaagtgggagtgacatatgaaaaaagaaatgaattaaatttgatatgacacatcatataaggaagaataattgtagacacaggcatgcaggggttgggtgtgagtacattagtccccacccttttcgtcagcagtcacacaaccttggacattagagcctgtccgtctgatctagagaaggaatgttgctggggaaggaaaactcagggcgaggtgagagaggacagaacctctaaccaggaagaggctgtccccgccaagctccggagaggcgcggaagcatgaccctcaggtatgggaccaggtctataggaaacccatgtggtgtgccctaatgggaggcaagccggggaggacccaaactggaaacctgattctgaaagaggaaaaccaccacaacatcctttgtaattgtgcagcttggaagaacagtatagatcctgtggttttcctggggaaggaggggagcctaaaagccgcaaatgatgtatatttccttcagaagcagggaaggggcagttttcgagtacggctgttaaatctcagcactcacttcattcggtgcaggctgctcctgtggtcttggctatagcagcagaaggcggggatggagggtgccccagggtcaatcttggtcagcctccgaggagctgggagtgcaaggtgtcactctggatgtgcctgcctgcttttcctcgccttcttgccctccttcgcctttcctccctcttttctttcctcctttctttcgccttcccctgtacacctcttgaattcaccatcataaagttgacctgagatgtttcaatgagtaatgttttatgattgcttcagttacattattacaatccagtctgccttccttgtttctcaaacagttctaagctcttttctccttttctttgacttgtttttttttttttttttactacctatcctcctgactagttgttgttgtttgttggttggtttgcttttaaagagtccaggataaacaaagtattgcaggcatgaaaagggtcaggatttcagagcgaattgtggagggggagggtcaggaggggaggggagaggaggggagaggagaggggagggtggaggagaggtattgagggaggggaggggagaggagaggtattgagggaggggaggggagaggagaggtattgagggaggggaggggagaggagaggtgttgagggagaggaggggagatcagaggtgttgagggagaggaggggagaggagaggtgttgagggaggggaggggagaggagaggtgttgagggaggggaggggagaggagaggtgttgagggaggggagggtagaggagaggtattgagggaggggaggggagaggagaggtgttgagggaggggagggtagaggagaggtattgagggaggggaggggagaggagaaatgttgagggaggggaggggagaggagaggtgttgaggaaggagaggggagaggagaggtgttgagggaggggaggggagaggagaggtgttgaggaaggagaggggtgaggagaggtgttgagggaggggaggaggtgcacgtgcttcttctcgcctgtcctatttatccagctcatctatgaattatcagcagaaaaggaaagtaaaggaggagtagaggctgggaataaaatcctgggctttagaaatggggtagtttaagagtattctgaaaggtacaatgttacacatgtgtacacagttccatagcaaaagcgatttttctgtctacgggactgttgttgtacttggggttttctatctttcaattggtgtcacagttgatagaaatataccatgtagcccttattccagaaacaagtcctacttgacattgttaatactcttgtttgtatgcataggttctggcaactagattatatctttcttggatactagacctccatctttttctttttggggggtgtgttttaatatgctgtatccaaatggggtggttaagacacccctggtctatgtttattatgaatgtttgctcatatgacccccagcaacactatatagtaggaatattattatccccatctacaggccaagtgactgaggcccaaagtcccacagtagcagggttttctgtctcctgagcccaccctcataacacctgggcgacacggctggcacaaactggaaatgtcttgattggttgcagacacacaacaggttcactgatagtgctctcgtttttaatccatagccattaaatcattcattcattccacatttattgactgcctgctctgtaccaggtgctgtcctaagtgctgagaattagacttgaagaagggtggagcacggtaaggaaagagggtggcaagagatgcacggctggtccgagggactcttctacattccatgagtcctcccaggaagagttggaaggacaaggggtttggtcctcaagcatgaagtgatttggggatgttactagttttctgtgctgctgcagcaaattactacgaacttagaggtttaaaaaaatggaagcagccgggcatggtggctcacgcctgtaatcccagcactttcagaggccaaggtggatggatcacctgaggtcaggagttcaagaccagcctggccagcatggtgaaacctcatctctactaaaaatataaaagttagctgggcgtgttggcaggcacctgtaatcccagctactggggaggctgaggcaggagaatcacttgaaccagggaggcagaggttgcagcgagccgagattgtgccattgcactccagcctgggcaacagagtgaggctctgtctcaaaaaaacaaacaaaacaaaacaaaacaatggaagtttattctctcccagttctagagaccagaagtctgaaattggtatcagtgggcttgatccaggggtgggtatcagggatcaaggtgtcaccggggccacactctttccagaggctccaggggtgaatctgttccttccctcttccagcttggggggctgccagtactcttggtttgtgacctccttgctccaatctctgcctttttggtcacattgcctcttcctcttctgtctataatcaaatgtccctccacctccttctcataagcatttatttaattgtatttagagtccacccagataaactaggcaaattgtaccatctgaaaatcctacacttaatcacatctgcaaatacctttaatttgggggctggggtggcatataaggtattatttataggttccagggattaggatgtggatatctttgggggccatttttcagcctaccatagggagttatttgtggattttatttttttaatgtaaatctagtcccttttaactaagcaaccaatctgtacttcttaaaaagcaccagtcatattcactgtggacaaaagcttatgaagcagcatccctggaaattcacctatgattgaaagaaggaaggagggacaacatgggagacagagacacagccagcaatgaatgatgtctctttctggtgcatgtgcttcatggagacagggagactggggatgcagattctgttttggcttgtctttttaaaggctgtaggcccgtcacagtggctcatgcctgtaatcccagacctttgagaggccaaggcaggcagatcacttgaggtcaggagtttgagaccagcatggccaacgtggcaaaaccctgtctctactaaaaatacaaagattagccaggcatggtggcacccgcctgtaaacccagctacttgggaggctgaggcaggagaatcgcttgaacctgggaggcagaggttgcagtgagccgagattgcgccactgcactccagcctgggcgacagagtgagactgtgtctcaaaaaaaaataataaataaaaataaaggctgtagatattagaaatgaataatatctaagagatgcttccatactcatttttaggatgttctgaggaaggaagaggccaacatggtcagttttatatgaagagaagattttgttccaaaggaaatgatggggaaaagcccagcttggggaggggtcagggaacagtgggcaagtgggaaatgagtccaccttctgccaggaagcccaagggggcatgtctttgagctgcaaaagaacaggtccacaaatcatagctgagattggcccagcggtaggaaaagcaacacagaatcaatttagtgtggttgaagcttgtgcgatgactcgggctatcacgctcctcagggcctgaatcatgggacacaatggatccgccagcttattccggcatcctttaactcttgaggagcaaatgccctggcaaggaatccgtcagaatctccttcccctcctgctgctgcgtgcagtgggccgtgccctggtgaggttcctgtgtcctctgtagaaggtaacagattagaaaagcagaagtcccttctctgtctagcatccttccaccttcttctcctcatctgcaaaatggggatgaaacacataaccccagggttgggagaaaggtctgacacagaggcaagtgtcagtgaacgtttgagaactctgaagcggtgatggaaatggggtattcctggtaaccagcaccctctctgacccacgtggtagttatccttttgccaaaatgtgtgactctcttaatacattttgagtctctagggaaaaaaaaaggcaaacttaattcctactaatatatcactcactgtgttctctaccttttacgctttcttttccaggtggtaacagaaaacaatccagatggggtgcaggtgctgtaaaataatacaaaggtaaagctggagaaatactacttctaaatggaggaatttgtgatgagcgtggggtcacttttaaagaccatgcgtgtattcagtgcatttatccagcttggggcatgatcaacattgccaacacattaagagtttggaattgttataatatcatttaaaagaacatgtgccctagatttttttaactttttttgctcacttctcaaagcatgttgggaacaccatcattttctgaggctgaatttggtctgggtttctgaggatgcctgaaatggcatcgctgaaaataaatcaccccaatcacatatgtgcttttaattttgtccacattgcatttcagaaaattgtgagtaacgtgaacataaacttctaactaagaaaaagggtaactgatgatcttgctttcttaacaaatatactgtctttttaatcatagttctattctagacctatatataaataagctgtattccactgtaatcatactgtgatgtttggctttattcaaaaactatgtattgtaagtatcattcctgtgactacagacttcatatttatcattttagtgactgcataatattccactgagaggatatactccttatggccctgttagtggacatttgttttatttgttttttattttaaaattctatgaaccactttgtattttacttcaccccttacccctccttcctccttttggctctcttcttaagagtatttcaggcagaaccttgtttatctttttcaagactgtctcgctctgtcatccaggctggagtgcaggggcgtgatctcagctcactgcagcctccgcctcccaggttcaagcgattctcctatctcagcctcccgagtagctgggattacaggtgcctaccacctcacccagctaatttttgtatttttagtaaagatggggtttcaccatgtcggtcaggctggtctcgaactcctgacctcaagtgatccacccgccttggccacccaaattgctgagattacaggcgtgagccaccaaacatttttataccaactatatctatttgatttagacatacttatctaggttgaaaagtaatcacagaaattaaattagcaggaatcgtagaaagaagcagggcctgtggtaaaaagcattaatgatggagcagacctgactggttttcattgtctttcctgaagctatctctttgatccagttcaagtgccctctcctggctatgtcaatgaagtcaacagctgcaagctagatgaagacgacactgataaattaaaaggcaaatggagcagtgaagtcttggtgcagaaaaatgaccctcagaggcagggctcaaagaagactgagagcagcagcaggacagctgatccatgggagccctgctggcctcaccaagggccgctcccacagggggacgctggaggggaacaccatgcctgcggtgtcaacggcatcggccctgctgccactccacagcccactgggaattccagccccacccaggatgacaggggctcctgggccagtactgcaaatactgttcccccaactcaacccttcctggaaggagggggcaccaggaaacaggactgtgtgctgctggcctcagaagggacccaagtcatgagaaatggagactccagagctccttctgaggcagaaagttttgccttggaagtacaagaccatgtcttccagataccagccccagattaccttcagcattggggcccagctggagacaacgttgatcataatgaaaaggactgtgttttcaagaaccatactgaggatgaatccctagagggaattcagcccccagtgggggagcatggtttgaatacgcccttctctgtgaggagaagctgggattcattgaatgaggatgtggaaacagaagttctaagcatctgctttaatgagaagggtcctgttcatgccatgcctgtggttgactcaggaaacaggcaggaggatacccatggctccgatggagatggggatggggagattgtggacgaggatgcagcggtggcggaggcccttgcagctttagaagctgctactgcaggagaagatttggatgagactgattaggggaggggatttgcacagggaggtaagctggtgtcatgctgagcatgcagatgcatttgctccctggatgcatagcaggtgattctgccagcatgcaccagtgcagccttaccagttgtttacatccagcatctgttctgattgtcagcatctgtcccatgctgcttgtcacatatctggagtttcactctgtgtagatgagctgtcattcaggacactaggagaaaaatctgagtgggtcattgtgcccatatccacagaaaatgcagaagttgaacagcttgcttgacaaccctcaaacatctttgagcacctggtacagatgtttatgagaatactctaagatctcaacccttgatcccaaaggcacacaatcacagagcattccttttgactgtaaactgtttaccttgcttttgagagccaaacattgtacccaacctggaaaaagtaactaccccaattaaagtgcctcatgtgtccccagagcatggcttaacttcagggacaatcacccagggaactaataactaaccagttgttcaacagcgggttaagctcagcagttttcacagtagagcagaagtccccaggaaacaaagggttagtcattagctgagatgttgattttaaaacaccttgaccttaacttttttacattattacttttaaatctcctttgggattggggaggctggccaaaataagtcttaaaactgcttatgtcatatttggattttaagttcatgacattcggaacagcaaagccatatatgcaatgtttttatgccattaaatgtctgattccaattaaaatataacaacgtatgtgtctttctagaagtcttaactcaaaggtggttctaattttctcagaatatcagtgaccctggatgttactttcaatgtaaagaactaatctagatggccgggcgtggtggctcatgcctgtaatcccagcactttgggaggccgaggcgggtggatcacaaggtcaggagttcaagatcagcctggccaacatagtgaaaccctgtctctactaaaaatacaaaaaattatccgggcacggtggcgggcgcctgtaatcccagctacttgggaggctgaggcaaggagaatcacttgaacctgggaggtggaggttgcagtgagctgagatcgtgccactgcactccagcctgggtgacagtgcaagactccatctcaaaaaaaaaaaaaaaaaaaagagctaagctaggcacagtggctcatgtctgtaatctgagcactttggaaggctgaggtgagaggattgccagggccaggaattcgagaccaacctgggcaatttagcgagaccccatctctatgaaaaaaaaaaaaaaaaaaagagctagactacaaaattatactcaaggaagggaccgagctggtttgcagagccatagctttggctttctctctgtcaaacttgatgccataactaaatgtcctgatcttacctcaaagatgaacaagccctctctggatttcagccttctaattcactgaaacaaggacaaccattctaacgtaactcaatggagaatttaaaggcattaaggatgctcaaaactatctagaaaaaaataaacatggaagatgctttagtttggtgttttgtaacacagaattgaaatctgactgaacttcatttgatttccagctttgccatgtgaccttggacaagttatgtatccctttacccatctgtaaagtgagaagaataattgtatgtgcttgtaaaggttaaatgagatgatgtaagtgtttagcacagtgcttggcacactaggcactcaaaaatgatgttttactagttgaaaacaattcctttaacaaacatttttacatccccacaactgaaaactctaaaactgggaagtatgtataatgtcattatttgactttggcaattatttagtataaaacatgatttctgagccttccagcacctttaaggacggcacccttacaaatgcttaatgagcctatgggtttgtttggtactgtaatgacaagccatcgcaagtgacctctatatacagggtcactcagagcccttaaaaagataaagtcttggcattgttaattgcattagaggtatgtctccttttgtatttagtacaccaaatacttaatatttcagaatgcttattccttcaatgatttcctaagtgtatcagttgagattatgttcagttgtatgggacgagtgttttatacaaatagaggcttatttacctcttatgtaaaagaagtctggagttagtgatccagggtggtagagaatgtatcactggcccgtgtatcaatgacccacatatcaatgacccacgtatcaatgacccgcatatgaatgacccatgctgcttcaatcattttggtttccttctcaagatcactttgtagtccataatggctgctgtggcttcagtcattacatttgcattccatgttggaaaaagaataaaggaataaaaacccca

SEQ ID NO: 2469 - DNA, 95579 bp, Homo sapiens
agaagttctaagcatctgctttaatgagaagggtcctgttcatgccatgcctgtggttgactcaggaaacaggcaggaggatacccatggctccgatggagatggggatggggagattgtggacgaggatgcagcggtggcggaggcccttgcagctttagaagctgctactgcaggagaagatttggatgagactgattaggggaggggatttgcacagggaggtaagctggtgtcatgctgagcatgcagatgcatttgctccctggatgcatagcaggtgattctgccagcatgcaccagtgcagccttaccagttgtttacatccagcatctgttctgattgtcagcatctgtcccatgctgcttgtcacatatctggagtttcactctgtgtagatgagctgtcattcaggacactaggagaaaaatctgagtgggtcattgtgcccatatccacagaaaatgcagaagttgaacagcttgcttgacaaccctcaaacatctttgagcacctggtacagatgtttatgagaatactctaagatctcaacccttgatcccaaaggcacacaatcacagagcattccttttgactgtaaactgtttaccttgcttttgagagccaaacattgtacccaacctggaaaaagtaactaccccaattaaagtgcctcatgtgtccccagagcatggcttaacttcagggacaatcacccagggaactaataactaaccagttgttcaacagcgggttaagctcagcagttttcacagtagagcagaagtccccaggaaacaaagggttagtcattagctgagatgttgattttaaaacaccttgaccttaacttttttacattattacttttaaatctcctttgggattggggaggctggccaaaataagtcttaaaactgcttatgtcatatttggattttaagttcatgacattcggaacagcaaagccatatatgcaatgtttttatgccattaaatgtctgattccaattaaaatataacaacgtatgtgtctttctagaagtcttaactcaaaggtggttctaattttctcagaatatcagtgaccctggatgttactttcaatgtaaagaactaatctagatggccgggcgtggtggctcatgcctgtaatcccagcactttgggaggccgaggcgggtggatcacaaggtcaggagttcaagatcagcctggccaacatagtgaaaccctgtctctactaaaaatacaaaaaattatccgggcacggtggcgggcgcctgtaatcccagctacttgggaggctgaggcaaggagaatcacttgaacctgggaggtggaggttgcagtgagctgagatcgtgccactgcactccagcctgggtgacagtgcaagactccatctcaaaaaaaaaaaaaaaaaaaagagctaagctaggcacagtggctcatgtctgtaatctgagcactttggaaggctgaggtgagaggattgccagggccaggaattcgagaccaacctgggcaatttagcgagaccccatctctatgaaaaaaaaaaaaaaaaaaagagctagactacaaaattatactcaaggaagggaccgagctggtttgcagagccatagctttggctttctctctgtcaaacttgatgccataactaaatgtcctgatcttacctcaaagatgaacaagccctctctggatttcagccttctaattcactgaaacaaggacaaccattctaacgtaactcaatggagaatttaaaggcattaaggatgctcaaaactatctagaaaaaaataaacatggaagatgctttagtttggtgttttgtaacacagaattgaaatctgactgaacttcatttgatttccagctttgccatgtgaccttggacaagttatgtatccctttacccatctgtaaagtgagaagaataattgtatgtgcttgtaaaggttaaatgagatgatgtaagtgtttagcacagtgcttggcacactaggcactcaaaaatgatgttttactagttgaaaacaattcctttaacaaacatttttacatccccacaactgaaaactctaaaactgggaagtatgtataatgtcattatttgactttggcaattatttagtataaaacatgatttctgagccttccagcacctttaaggacggcacccttacaaatgcttaatgagcctatgggtttgtttggtactgtaatgacaagccatcgcaagtgacctctatatacagggtcactcagagcccttaaaaagataaagtcttggcattgttaattgcattagaggtatgtctccttttgtatttagtacaccaaatacttaatatttcagaatgcttattccttcaatgatttcctaagtgtatcagttgagattatgttcagttgtatgggacgagtgttttatacaaatagaggcttatttacctcttatgtaaaagaagtctggagttagtgatccagggtggtagagaatgtatcactggcccgtgtatcaatgacccacatatcaatgacccacgtatcaatgacccgcatatgaatgacccatgctgcttcaatcattttggtttccttctcaagatcactttgtagtccataatggctgctgtggcttcagtcattacatttgcattccatgttggaaaaagaataaaggaataaaaaccccactcactctctattaaggaccccacagaagtataattcatcccttccacattactctctttggtcaaaatctggtcacttggccacatctagctgcaagagagactaggaaatcgtcttgctagtggtgtgcgtggctttgccaaataaactcagaatgcagttactaagaaggggaaatggacaatgagtttcgaggcggtcagtttacagtctctgccacaggaggtctcaaaacccaaaagcctgggatacagctggtttcaaaagattggaagatcgtgtgtacattcagtgtgacaccaaaggggcttccacctttggtccgggggaaggaggactggacagctaccgctgctccaacttcccattgataactccaaaccggacgaaaagaagaaattcagacaaagaaggggtagggtaaggtatcagggcagacaagtctctttctcttacccagacacacactttcgcatttatatatgtatataattttacatcttagaacagctgcagagttcaccataactgacagctctgtagttttaaagattctcttttatgaataactgctttgaaaaggtcgacagatggccaatactttcaagagttctttaaaagtaattctggcccctttcatctttactccagtatccaggatcccccaaaggaaatgaaagtaaaaaatctttaggttgaaaagtaattccagcttttagccttatctaccaggttgtctaacagtgagctgtctgagcacgcttatgtgtgtagtgtcttctttctgcagcctagtgccacctcttgtcagaaaagtgatgttgaaaatagccaaccttttcaaacattgtggacaatatgaaagcacaatgcactctgattggaaggcactaactgtgattaggggcagacttcacagttccccatgaaccttaggcaattgcatcacgtggatatttaccatgttaaatcctgattttgaattaagattattttatgtatatattacatataggtttcttgagctaagaagttagatttaactttttactgggggaaaatgaactatcatataaatatgaaattaaattttttcccctcattgccaaagcagatgtagtgaatagttataactggaaaaaccagatacccaaaaaaacgaagagaattttaggtttcttacatagcacatgcccatctgtccatgctcagtaagtgctggccattcgtcattttcctccctctgccccgctctgtctctctgattctcttctcttcctacctctcccatccgtacctccaagcaggaggccttagaaagaatgaatgagacaccagatgcaagtgcaagtgcaaagatctcctgacttccctggtttggtcgtctgtgtgcaaccatgcagcagatagagcacagtcactactgcagcacaggatatagcctcctttcctggacttggacttaactcttcatcaagggcactgcttttcacacaaccaggctttatgacgaaaacgtagaaattaattgctttctggtcttgtttcattttttttctctagattaaacctcatgcatttttaaatcctctattttggagttggtgacaaacacagacaagctgacatctgtttttcatggtaaatcctttccctgttaactaatagaacaataagtcattcatttatagatttactaaatttgtaagtttctcatatgtatcaggttatacaaaccacacctaagtggtctgctaacttctgaagcactcccagccactttaagaaacattttatgcaagtcaatgtgttgatcgtagatgatgcttacctgcacatttagtcacttggagtcaactattagcaatttttttcaactgaaatatctgtactaaaaaaatgcgtttggcctgagatctaagttagtgtacggcacaaggggggaactcaatacatatttgttgattgaaagaatacataaaagaagtctggagttagtgatcttttcccggtctggttggggagatatcatgcaggtagccaggattgtgctggattgtgacatggtgtaataaaggtatacatggtgtaataaaggatgtgggagcacaaatccataggaatttgagagtttaggaattgtatttattattcaggcccttcactctcagactaccctgctctatttgaataatgaggcttgtggtggtctgtggaaaagtggacagagtagaatttgggcagctgctgaaggtttggtctctagaatgagtccacgttaccctaaggacggtaatcccaaattgagacaaaaactttaagaaaaccaatgtttggggccaagcaatggggagcttggccgacctcgttttttagtgattttgaactcaatctttaaaatcctggaagagaaggaaaaaaagggtgtatattcgtgtaatgacatccagatctcaccgttctcttggctcctagtgatgggggaaaaaaggtgcgcccagggttgacccttcagtaacacctgcagccatgcgtcatgacctccaggtgttcagaggccctgcccatgtgacacgtgcctggtacttcccatacatgtgcctctttaatcctaataaacctggggtgaaatccggctgtgcctcttgctcgctgtgtgaccttttgactttaagttccttaacgtttctgagcctcacttttctcatctgtgaaatggggatcattcctatttctaagaattgaaagcgcacattctcaaacttcagtgtgcccctgaggcatgtggtgtgcttgtttaaaaggcagatttctggacctacctctaggaattcagacttaggaggtcttgagtggggtcctggcatctacatcgtttttgtaagtaattctccgcacttggagaaacacataagactccagcagggattgccacaccttttttttatcttgcaccagttatcagtaaaaagtactgcacacacccttaatataagcacttttacaaccatactgtcttctaatatgttatatggtttacagtatttagcaatactaagatgaagtaacaacatatcagagcattaatatttttttcactcccctggggtatgtgaaacctactttggaaaccactggtttagaagatcaaatgaactagtatatataaaagctctctgtaaatagacaaaactgggcatatatatatatatatatatatatatatttttttttttttttttttttttttttttgagatggagattcattcttgttgcccaggctggagtgcaatggcacgatcttggctcactgcaacctctgcctcctgggttcaagcgattctcctgcctcagcctcccacgtagctggaattacaggcacgcgccaccacgcccagctaattctgtatttttactggagacagggttttgccatgttggtcaggctggtctcgaactccccacctcaggtgatctgcccaccttgacctcccaaagtgctgggattacaggcgtgagtcaccgcgcccagcccgggccaatatttttgaaagcacatagagcatacacatgagtgtggaccacgcacttataatataagcccacttgcaaatccagtcaacaccactgacctgcaactcttcctcctcacctgtgctgccctctgagccttgttcctaggagacttctgtatttactgcctttaagcattttggaatagttaatacagaactaagggaaaatatgacctagagaccaaaaggcagacaaagaattttacttatctccctaatcaaaactacacattccaaactaaaatgagtgaggcctttgaggaacaggctaattagaatacttgtttagtcagaatctggctactttgaaagcacaacaatgcaatttctcttgacataagttaccaacttaaaatcccacacaaaaaaatccatttctaggtccaactcattcttttccattctccaaaatattcctaaagctatggagaaaggtaaacctcagaatttacataaatcaggaagagttcacaggccacagaaggtccatagcctctactcatcagccgacgtgctgctctctctgtcttagatgttgatgcttagaaaggaaacaaaagctttaaattaccaatttctgaagacacaagatctaaggtccaaggttttcatggcatcagccataagccgggtgacaaaccatcaaggactgttgtggtttttaaattaaaatttacaggggctgggtgccgtggctcatgcctgtaatcccagcactttgggaggccgaggcaggcggatcacttgaggtcaggagttcaagaccagccgggccaaaatggcgaaaccctgtctctactaaaaataaaaaaattagccagggctggtggtgctcgcctgtaatcccagctacttgggaggctgaggcaggagaattgcttgaacccaggaggcagaggttgcagtgagctgagatcgtgctggtgcactccagcctacatatatatatacacatatatataaaatgatatgtaatatatatatatcataatatatatatatatataactcctcctatagctacttttctgcaaataactgcattagtcatgagttctttttgttggttttgttggttggctgcaaatgacagaaacccaaactagataacaaaagaatttccttgaatgttctgttctgggaaacaaagtgcaactctgtctcaaaaaaaaaaaaaaaaaaaaaaaaaaaaaaaagtttataggaagaaaatatatagagaaaaaatctgcaaagacattacttcaaaataatttgccaaatattaacgtagaaattgtattcagtaattaatttctgggagccaacaagttatgggttttggtattttgttgttgtttttagtatttttataggtatgactatagcttaacattttcagtactgctatgtgttaagcaccaaatgcagtcagccttgttctaagtactgcacgtgaatcatctcactgaagtctaccgtgacgccatgagctataggtatgattgtccccatttcacacatgggaaaatggaggctcaaacagctaaataactcatccagaatcacacaaccagacagtggcagaatctcaactgaacccagactgaacaacaaaccggtgcttttttttttgagatggagtctcgctctgtcacccaggctggagtgcagtggtgtgatctcagctcactataacctctgcctcccagcttcaagcgattctcctgtctcagcctcccgagtagctgggattacaagcgtgcaccaccatgcccagctagttttttgtattttagtagagacaaggtttcaccgtgttgcccaggctggtctcgaactcctgagctcaggcaatccacccacctcaccctcccaaagtgctaggattacaggcgtgagccaccgcgcctggcccaaacctgtgcttttaaaggtgacataatatgcctctctgtggcaacatccatgttgccattagacaaagataagggctgaatcaaaatgtgagacaacccaattttgtatatgtaaaattgtatgtattgtcaattgggattaaaagggggttttgttctggttctaaggaagattgtaataaagaatagaaaagttagtcaaggccttgtaaccataataggtctgctgcccaacgtgccgcaagtcaatagctgagacacggggttgccgcagagcaagaggtttaatgggagggccgctgaacgaggagatggaaggaaacctcaaatctgtctccctgaggagtttggggctaggcattttaaagggtttggagtaagcctaagtgtggtgatagttgattggtcgaagagtacagggtgaagtcatgggacagggtgatgaagaaactgtattctcatgctgatcccatttgtctgggtgggttggctgtcagctgtttcactggaatttgggggaaaacaccttaagcaattctaacaaaagctttatgattctaatgtcagaaatcctatctataggaacaatggggatgcacatggccaggatctagtgctactacaggacttttggtgacaaggaagtgggccaaagtacagcctgattaatgcttaatccagaattcttgttaaccctgtgaggacagcttcagctttatctgtaaaatctctgagactgtctactgtcaatggtatttttgcggcaatcgtaagaccatgaatttcctttccctacaaaggttgaggcagatccaggggccatatgtccccacccatgaaccacccctacatagcttaagattcctttcctcagtttcatcatctgtatagtggaggtgatggctaggcccctctctcggccataatgagatttaaatgagataaaaagtgcttagcacgtacccagcacaaagtaaacaataaatgttagatgtaattttgtccgagtacagtggctcacgcctgtaaacccagcactccgggaggccgaggcaggcgcatcacttgatgtcaggaattcaagaccagcctggccaacgtggcaaaaccctgtctctactaaaaatataaaaattagccaggcgtggtggtgcacacctgtaatcccagctactctggaggctgaggcaggagaattgctttaatccagggggcggaggttgcagtgagccaagattgcgccactgcactccagcctgggtgacagagcgagactccatctcaaaaaaaaaaaaaaaaaaaaaagttagatgtacttttattatccagcgaaggtcactggcccacttctatgagtaacactcaatgcttttttaaataactagatctttgttgctacccaccaaagctgtatgaatcacttctaataatactaatttctaaactgggtaagttctgttctacctacatcattaataatcgtctaaaggcaaaaatgcatcttgggggcacttcaattttagtgtatttttattctcattatcttcatcatttaacaattgtagaacacacgggaatttatcctttgaactttaagtcacattgcatttgaagtgaatatttatagcattaaaattgacctttcttttatctttcctcatgccccaaataagattttataaaataaaatgcatttttaatacaaaacagaaaccatggaagatttgggagggttgattggttattttggagaggttgtgtctggcttgggttttatttagtatggatttgtgcgtgtgtgtgtgtgtgtgtgtgtgtgtagtttttgtttgatttggtcaacactaatattcatctgtaataagtaaacccatatattttttcaatttgggtataatgttatgatttcaagagtattttgtctatgatttctcagctagattaacttaggaatgaaaataaattgagttacttttaaactcactgagatgcctatgctacatgcacatcttgtcataaaagggttaagataaaatttcagcctgaacaaacagaggaagagaccatgctccttagctggtagatctgggttcattcaacatcagtcaaggcaagaaagtcattctttccaataaggcagttgacctgccatcaggagaacctcaggccccataggctttgcagttacatcttgtacctggttccgcccccagcccaccttcgaatgttataaacaatatggctgtggcagaaacatcaaaaactaactctcaaaaggcaaaatccccatcatttattccactacagagggttggaacttggcatctctgtggccaatagattgttctgtttcatctgagagaccactgagtgagcactgactgtgcctggcctgtactaagtgcattacacatctgagctcatatgatcctcacaaccaccctaaaaggcacatattatcttcattctgtagttagaagacggggtccaaagagtttaaggtcacagacagcaaaggcatctgaatgccaaatctgtgctcttatcgggagctgtaagaatgagccctgtgccaatccaggaaagatggtgaaaggaaattctcctgaagcaataaaaggaaaagggtttgcaaaagcatttcacaacagaaaccgcaccatggccaggccttctggcgatggagtgaaggcagctctaggaagtctcagctgcagggctggatgccagagcttcactttccatgtggctctataactcctcctatagctacgtttctgcaaataactgcattagtcatgagttctttttgttggtttggttggttggttgcaaatgacagaaacccaaactagataacaaaagaatttccttgaaatgttcgtgaagttcagaagggcaactaggccttggggacaactgaatctggggcttgaaagcaaccaggctgggcacagtggctcatgcctgtagttccagcactttgggaggctgaggtgggcagatcgtttgagctcaggagttcgagaccagcctgggcaacgtgaaaaaaacctgtctctttgaaaaatacaaaataaagtagctgagcatgatggcctgtgcctgcagtcccagctacttgggaggctcaggtgggaggattgcttgagcctgggaggtcgaggctctggtgagccatgattgtgccactgcattcaagcctaggtgacagagtgagactctgtctcaaaccaaaaaaaaaaaaaaaaaagcaaccagcactgcctgtcttccctccgcacattccctccctttcatcacaccaggaaagaagactacacagcaggaaatatggtcttcaccagcccctagcccacagctttagccaccagagcaataaaccattttttccagcccatttgctggagaaaatggtttattgctctggcggctaatgctgtacctttagccatgggaaccctcatgggcttccccatgaggctatggaactctgtggctcagttccacagcaagcaactggccggctcaactcgactcagacaaagttgtgtgtgctggaccagtcacagccactctgatcagccgtgggggatggacgcatgtagacccttcaccaagttaccaaacatgccgcttacagcagtcgcgccctcggtaggggtggatgagaagacagaggatttgcaggcatttttctgatccttaaaactcctgtgagacaggtcattttacagatggcattgaggctcagaaagataagatacctttctcaatgtcacacagtggtgagtgtggggctcaaacgcaacagcaaaggtcgtgcctacttctctgagaccacaccacttccatgacagcattcagcgcgcggggttccctccaaagcggaaccgaatcattctcaccagtatccaggtaacacctgcagtgacacaagctcccaggtgagaaaatggagcgtccgatgagaaaaacaataaagacaaactggcagtgccagaaaatcagttagaaaaaaactagacttgaacctttactctcacaaaatagctaatggtagtctttcgtttttaaaggtgggcttttgtttatttattcattcagcaaaaaatcacgagtactttctgcaacaccagggcttgaaggaagatacagcaccaaccccccaacggccgtgcagttctccgattcggccagcagagggagcgaagggccagctctgtgggaggacctgcagagctggacaccagctgaaccgcgtgggcagccacaccaccccctggccacgccacaaaatgcccaagacaaagaagtcccagctgtcctttaggtgtttagagctacagtgagggtaccctggggagatctgagaacagtcctgcagcatggttctgggaagatgaggagaggagggaatccttgggtagaaccaacatgccccacccagactaaagggtcggaggatctaagaactggcaagtcaaacctcagatacaaaacatagtcctctttgaccacacaacacgccctcagtgatactatgcactaaatcgcgcgacgccatttccaagcccccaactctactgtcctcagtgagacagaaggaagggttccccgccttttggggtggaggaagcctggatgtgaagacagatttgaaaaagaagtgcaggagcattcaagaccatgggcaggccccctggcaaattcacccagggggctggtggagactatatttcctgctgtgtagtcttctttcctggtgtgaggaaagggagggaatgtgcagagggaaaacaggcagtgctggttgcttttttttgttgttgttgtttgtttgtttgtttgagacagagtctcactctgtcacctaggcttgaatgcaatggcacaattatggctcgccagagccttgacctcgcaggcttaagcaatcctcccatctgagcctcccaagtagctgggactgcaggcacgggccatcatgctcggctactttcttttgtatttttcaaagagtcagggttttttcacgttgcccaggctggtctcaaactcctgagctcaagcaatctgcccaccttggcctcccaaagtgctggaactgccagggtggggagcttgctgaaccaattgttcagggccagcgttgtgaggctagcgtccgtcaccatggggaacagaagggtcatatgtgccacattgccagctgcccactactcccctaatgagccaagaaagacatgaaagccagttagtgaccaaacgtccccattctacattacacatgtactagaggggatatcaaaaaggccaattaaccaaaaactaagcccgtcgtccccaagtgacccctttcaactataaatcgggattggaggaattctaacatccatcctagtgcacacattctgagtttctggttctcatgttgtgacttggtcacaaatgaccaaatcaacctttccacttcctcagcataagctgttattgatcatcttgttttcaaggacatacacacgcgcacacacacacgcacactccaaatcagaatcctatgaggtaccacacagagtgaagtttgctgtctatacattttaaaaatctcaaccaggatatgaaggagagatggaatgcagatggtgacaaatgactctgtgttacaaatgagtcacattaccatgcagaagcgggtggggaacaaaggagctgacttaagaaactttggcaaatacagttttgacagaatactgtaaggctaaaaacaagaaccacacacacacacagacacacacagacacacacacagacacacacacagacacacacacagacacacacatacacacagacacacacacagacacacacacacagacacacacacacatacacacagacacacacacagacacacacacacacacacagacacacacacacagacacacacatacacacacagagacacacacatacacacagtacttcagttggaaagtgtgtttctcacagtaatatattttcaaactacttaatatgtatgctagtgttgaataaacatgtaaaaatatcatagataataagagccaggtttcctcactgttggagaagaaagttacaaataaggaaagcaggaagcttagaacgagtactatggagcaagcctggagtcagaagtagcagtgtgggcacatgcttttgttttacagatagatacaaaaaatacataaagatgtgtgtatccgcatgggttggtgtgtgtgtatgtatatatgtgtgtacagggggcctagtagctgtgacatcccagcatcaatgaggacacctagtcctctttatttctaaacatcattgtccaataaaaggaaccagggctccttgggttagtggttgatttcagggctggggcaaggaaaatacaagacaagatgaacctggagaatcttgtggtgccagaaagtaataaagggctttcaaaaaagaaaggacctgtaatcctagcactttggaaggctgaggtaggtggatcacttgaggccaggagttcaaaaccagcctggccaacatggtgaaaccctgtctctactaaaaatacaaaatgtagccaggtgtggtggcgtatgcttgtaatcccagctactcaggaggctgaggcagaagaaccacttgagcctgggaggcaaacgttgcagcgagtcgagattgtaccactgcactctggcctgggcgacagagtgagactttgtcaagaaagaaagaaaaagaataaagaaagagagagagagagagagagaaagaaagagaaagaaagaaagaaagaaagaaagaaagaaagaaagaaagaaagaaagaaggaaaagaaaagaaaagaaagagaaaggaaagaaggaaagaaagagaaagaaaggaagaaagaggaaggaagggagggagggagagagagaaggagagaaagaggaagggaaggagagagggagggaggaaggaagggaagaaggaagagagggtagaagaaaggaggaagagaaagagaaggaaggagaaagaaagaaaaagaagaaagggaaggaaggaaaaagatgcaagaaaggggaaggatggaaggcaagaagaaggaggaggaggagaaggaggaggagaaggaaggaagggagagagagaaagaaaagaaagaaaaaaaggagaaagaagaaagaaagagaaagaagaaagaaagaaggaaagaaagaaaaaggaaagaagacaagagaaagaaagaaagagtgtgtaataggtggaggaaggagaaaagtaaaggatggaaccacatcaagggacatgggcaccaacctgaaagggctcctaccacagacatagccactgcagccaggatccaccaatggttggtgtggtgggttgaatgatatcccccacaagacctgttgatgttgaagtcctaccttctgagacctgtggatatgaccttatcaggaaatgggttctctgcaaatgtaatcaagttaagataaagtcatactggattagggtggaccctaaacccaatgcctggtgtccttgtaagagcagaggactccctcacacaggaaagaagacacagaatgccagaattgccagcaaccatcagaagctgggagggaggcatgggccagattataccccagagatatcagaaggaatcaaccctgcagacaccttgacttcagggtctggctttttagactgtgaaagaatacacttctgtgttctggggcacccaggttttggtaatttgttatggtagccctagaaaactcatacagatggtaaaattaatgtgtgaaagtttaagcagaaataagatattggcctaatctctaagtatctcccatctaatattcattaattacaaagggaaaatagtaactttaccaaaatgaaacctggcagacaccaccttgggcaatgatgaagattgacatcacgggtaatatgtaccatcacgttcctgacatgattcaatgggaagggcacatcacctgtatggtgtcccttcccttatgcaaaacctccgtctaatcacaagaatcagctgaaacacctaggttgagggagagtctacaaaagaactgatcagtacattcgagtgtcaagatcacgaaacacaagaaaagactaaagggcaaccacagatcagaggggacaggatccaacaactaaatgcagtgggtgatcctggaacagcagggggacattagtgagacaatggatgcaatccaaagaacgttgtggtttaatgaatggtactgtaccactgttagttttttagttgtgatcacttttttatagttaagatggtaacatacggggaaatggagggaagggtttacatgaactctgtactgcttttgcaactcttctacaagtccaaaattatcttcaaatttaaaaagcagtaacaggcatacctcattttattgcactttgctgtagtgtgctttgcagatattgtagggttttcttgtttgtttttgttttgttttttaatgaaccgtacgtgtgtggcaaccctgcaagtcgagaaggtccatcagcacttttctttcttttcttttttttttttttttttgaggtggagtcttgctctgtcgcccaggcaggagtgcagcggcacaatctcagctcactgcaacctcctcttcccaggttcaagcaattcccctgcctcagcctcccaagtagctggggatatagacacgcaccaccacacctggctaatttttttcttttttttgtatgttagtaaagacaaggtttcaccatggtggccaggatggtctcggtctcctgacctcgtgatccgcctgcctcggcctcccaaagtgcagggattacaggcgtgagccactgcgcccagccatcagcaccacttttccaacagcatgtgctcactcatgtccctgtgtcacatatgggtaattcttgaaatatttcaaacttttcaattaattattattatatctattatagtgatccgtgatcagcgatttctgatgttactattgtaattgttttgggatgacatgaactgtgcccacataaaatgacaaacttaatctgtaaatgctgtgcatgtgtgttccaactgcccgaccaaccagccgttcccgtctctctccctctcctcaggcctccctattccctgagacaaaatattaaaattaggccagttagtaaccctacaatggcttctcactgctcaagtgaaaggaagggtcacatgcatctcaccttaaataaaaagctagaaatgattaaggcgtgtcaaaagccgagacaggcagaaaattaggcctcctgtaccaaatagttaagttgtgaatgcaaagcaaagcaaaagttttgaagaaaatttaaaatgctactctagcaaatacacgaatgataagaaagtgcaacagccttattgctgatacggagacagattcagtggcctggataaaaaaatcaaaccagccacaacattcccttaagcccaagcctaatacagagcaaggtcctaactcttcagttctataatgactgaaagaagtgaggaagctgcagaaaaaaggtaggaagctgcagaaaaaaggttggaagccagcagacgttggttcataagatttttaaatttaatttttttttttttttttgagacagagtctagctctgtcacccaggctggtgtgcagtgactgcaatctctatctcccggattcaagtgatccttctactgcagcctcctgagtagctgagattacaggtgtgcaccattatgcccagctagtttttgtatttttagtggagacagggtttcgccgtgttggccaggttggtctcaaactcctgacctcaagcaatcagcccgcctcagcctcccaaagtgctgggattacaggcatgagccactgcacccagccagttcataaggattaactaaagaaaccattgccattatacagaagtacaaagtgaagcagcaagtgctaatttagaaactgcagtaaataatccagaaaatctaggtaagatcatggatgaaggtggctaaatgaaaaaacagatttggaaggagatgacatctaggattttcatagttgagaagtcaatgcctggcttcaaaacctcaaaagcacaggctctcattttaggggctaacatagctgtcaactttaggttgaagccaatgctcatttaccatcttgaaaatcataaggcccttaagaattatgctaaatcgactctgcctgtaaacagcctagataacagcacatctgttgacagcatggtttactgaacatttaaagcccactgttgagacctactgctcagaaaaaaagattccattcaaaataataactcattgacaaggacctggtcagttacccaagagctcttatggagatgtacaaagggagaaatgctttcatgcctgctaacacaacatccattctgcagcccatagattaattcccactttcaagtctaattatttaagaaaggcatttcataaggctacagccgccgtagacagtgattcctctagtggacctcagtaaagtcaattgaaatcttctggaaggaattcaccattctagatgccattaagaacatttttgattcacaggaggtaaaaatagagacattaacaggagtctggaagttgattccaaccctcacagatgacttggaggggttcaagacttcagtggaggaagtcactgcagatgtggtggaaacagcagcagaactagaatcagaagtgagcatgaagattgaactgaattgctgccatctcatgataaaacttgaatagatgaggaattgcttaacagatgatgaaagaaagtggtttcctgagatggcatctactcctggtgaagatgctgtgaacactgttgaaatgacagcaaaggatttagaatataataatacataaacttagttgataaagcagcatcagattttgagatgattgactccaattttgaaagatgttctactgtgataaaatgctatcaaacagtactgcatgctatagagaaaactttcatgaaaggtgaggtcaatcagtgcagcaaactttatcactgtgttattttaagaaattgccacagccaccccaaccttcagtaaccaccaccctggtcagtagccttcaacattgaggcaagatcctgcagcagcaaaaagattatgacttgctgaaggctcagattatcgtatttttttttagcaataaaaagtattttaaattaaggtatgtatgttttttgacagaatattattgcatatacttaatagactatagtatagtataaatataacttttttatatgcagtgggaaaccaaaaagctcatgtggctggcttgattgcaatatttgctttactgcagtaggccggggctgaacccacagtatctccaaagtatgcctgtgttaggggaaggggtactgcaggaggggaaatctcatgaggaaagtcagccaagtgatcacttgatatttcaagacacaagaaattcagcactgtaaaaaattaagctcaataattatactgccacgactgtatttccagtgtacaaggcgccaataattggatcacccacaagacaacacactgcgtttaacatttttatttttaactccgctttggtagtacaaaagtcataaaagtacaaaccagacagttaaaaatacacttgacactcgaaatggtgaaaattttccttacaaatttttacatcaaggtagtagccaactcattgatgacaccaaaaagttgtccatcattagtgttttctagagaaagtctgttgtggattccctcatccttagaaaggaggaggagtaacacaagacctgtaaacatcagttgctttgggaacacaggaattctcatcagatagttcagtataaaccagtaaaaagcgtatgtgttgaaaatactgaacgcttaattttggcaaatttggaagcctgccagacaaaaaccgctcaagtatttattagaaaatatttaaaacatactcttggtatcaatacagttttaaatatttttgagtattctcttgcctgttgtattgctatttaaaaaaaagtgctctgacttgaataagatggaaaaataattaaagctaaagaatatcttacattttatcccccaccattttgagggcatatttttaaagcaaaaaagtatgcttatttgtttttaattaaaatgattagcctagactgcacatatattatttacactaatacatacccctaaaagtcctatattgctactttctggatctcagtgaaatttatttccatactgactttctccagtccacagtgtatatgaatatgtacacatacagtgtttattagttgtcagtaaaaattctcatgaaactaaattccccatttatttaaaaggttagaaatgtttagtttgatgctggaaataaaatcattgaagtctatgtacagtaaatactttgaagtatatttttatggaaatcatcttttgggagacaaatgaaagatgtgcattttcctatatgaaataaaagaagtgctcaaggcaccccccaacactgacatggaggcgggtcttggagaccttgtaactggcctcccccacagctcaccccagagctaccataaatcatgtaatactatttatgcctctgggtcctttcaggtgttttgtaaaatgtacagttataaaaaaaaaaaagaaaaagaaaagtttgccaggcctaaagggaaaagtaactggagtgttttaaataatgagcattagttacaggatgaaaaacaggaaatacacaaagaaaaacatgccagaggtaggtgcaggcccatcttatatgagaagcagggttctaggccgggcgcagtggctcaagcctgtaatcccagaactttgggaggccgaggcgggtggatcacgaggtcaggagatcgagaccatcttcgctaatgcggtgaaaccccgtctctcctaaaaatacaaaaaaaataagccaagcgtggtggtgggcacctgtagtcccagctactcaggaggctgaggcaggagaatggcgtgaactcagaaggtggagcttgcagtgagctgagatcgtgccactgcactccagcctgggcgacagagcgagactccgcctcaaaaaaaaaaaaaaaaaaaaaaaaagagagaagcagggttcttttgttttggccttgggttgtccaaacaaatttgtgtgtgtgtgactttcaaccattttctcctttattcaatggattaaccaagaatcgctcagctaaaggttaaaaaaaaaaaaaaaacaaaaaaaaacaaaaaaccgggtgcagtggcccacgcctatattcccagcactttgggaggccgaggcgggtagatcgcctgaggtcaggagttcaagaccagcctgaccaatatagtgataccccgtctctactaaaaatacaaaaattagtcgagcgtggtggtgcatgcctgtaatcccagctacttgggaggctgaggcaggagaatcgcttgaacctggggaggtggagattgaggtgagtggagattgtgccactgcactccagcctaggggacacagcgagactctgcctcaaaaaaaaaaaaaaaaaaaccttctcaaaatgtgtaagtgctgtaggagtgacatggtggtggcaggagttaatgctgaatttgtggtcaaggaatccaaagtctagcatctggtcccatctgactccatggtcccttggggaatcaactcctcagggctaactagattatttccactgagcttttaccactgaagattcatcttttatcttttgtaacagctaacctgtatgtatcaagatcttcttacaaccagtgtcaaaataggatgcaggaactggaaaaagaaacacacactcacgtgcacacatgcatacacatatacacacacacccctgagcataagctcagactgtacatgaatagtatcactgcacatactcatcataatggaaaaactacagtgtgtacaccaaggcctgggattaggggctgggaagagtagaggctgggagtggttaagaagataaaaacagctctttccttccctggaagtataataaaattttcaacagactctttcaaccaaaacttgtttcaaagcaaactgaattctgtatatggcacagcaataatattcccttttaggttttatccacgtgcctgctgactccatgatagaaactgtataaaatatataaaaatattcccaaggcaacttcatataagttttcagtctcttagagctcttcaagtcaagtcattgctgcaagagaaaacaaaaaatgtagatctttaaccaagggtaagcatcatatcacatattaatctgcctgaatatttaaaaacacagaagaattataatctattcttaccctgtcccatcccatcccaccccattccttctaccactgtacatttttttctagaattcaggctaaagaaatttaagtaaaatataattaattccaagagttctctcgagatctggctgtttaaatgtatgtgcccctccccctttctctctcttgctcctgcttttcccatgtgatgtgccttcaataggtgtctttctaaagccccaccaaagccagttcactggaagtctctactgaccatccaagacagcacggttgggatttcaagtaagaacacaatgattaaatattccatcttaggtctttattgtaccttcagggttctggattgtatttttaagtcattctaacaactggcccttgtcaatgtctacgtttacatcacaaacaaaggcccatacttgtaaaatagctccctgcttttcaaatgactttctataactatctcatttaatgaacagctctgtgactttttactttcctgttttacagactggcataacccaggacaggactaaaattatagagctccccgtgtatgctgaaatacacataccatgcaggtgaacccacacaaggttaaggaacgaaacgttctcccacctgccaaaatcatgtgtaccctataaacactaaacaaaaccagagatagacccagcttgcagaaatatgaagaaatagcatgaagttgctagaagtgttttgaagaacatactttttacttattttacagcttgtccttcaagatatgtaccttattattatctatgttatcctcttctgtcatttggtcatccataatattcaatggtatattcaatataatattcatttggtcaaccataatattcaatattatattcaatataatattcaaagagaatagagacagagcacaagaggaagaatgagggagacagacagaaagaaagagatttatttcccaaatgagatgatgagtaaaggacctttatccccttagctaaaaaggaaacactgtccaataaaacagcatggatcaagtttttaattctaatgaaatacgtaataccctgcactgaattgccaaaactgtacaagaactgcagatttttactgtaaaactgaacaaagtcaagtctggaactactttcaggtaggtgtcaattcatataaacattctagcagagggggaaaaaaggtagaaaggccagaggtagagacatataaaaatggccctaaaaaaaaaaaaaggaaaaaatgagagggaattttccaggcaaaaccttaaactaggccattatctagaaaacaggtatggtattccactgtttttatgtctcctctttatgtgctcccttagaactagacatttttgcatcaaggaaaataacaacgtcaaaggtgggggatgtcaggcctagaaactaatgtttcatcacagtaacagttttcactgcaacctagaaacactcctcattttgagtgttttgcacagatttgaccggctttaagaactgggcatgcaagaatacaggctaagctaaaaaggaggggcctggattcaaatccagacccctactcccagccgtggaaccgtggctgtttctgtagcattctctcctagggttactggggatttgacatgagatgatcctatgcacaacgcttaatacgaggaaaagcaatcagtatgctccgaaaggttaactattctggtcattaccatcatccaattctctgctctcaacaatcacattagctttcttcaacagctgccttctgcagctgataaaaactgcactatctgtaatatctttgagagaggaagtaaaaaatacaaatcactgcttaaagtcctcactgctaataccagaaactaagcagaaaagggaaagctaatcttattaaaacccttgcagttctggtctctaattacaaacacacatttattagaaggtagcacattactggcacaacactatgaccttccaggtatttctttaacccagaacaataataaaagtgttacaaggtgccttccatattgtcctgcagcagtcagaaatcatgtgtgggtgggcacagagacaccagaaaggctaacaggagtgggtgagagaggaaacacccacccactcactgttcccagttgccatcacatgggaccacaccacactgagcaagcctggcctatctctcttcgggagaaattttgtgatgacagtttacacaagtgagtactcaagctggaaaaaattaagcgaagttccattacatggaaaacagaattcagaaatcccaaagtgtaaccattttgcttataaaacaagactgatggataaaaattaagaaccgcccagaagatttatctggaacaaaggaagaggttgtctttttctttagagtttattgcttatgacataatcttataaagataaagccataatcctctcattatactatgggtccacggaagctgccatatgtctctgattaggatatacatacaaatatctatgccttgttaaaaaggattctctagaaaaaaaaaagaaattgatccctttaaaaattagaaacatgttataagaaactaggagcctaagcggattaatgaacagtaaatgctaaaatctctaagtgtaggatgttaaggaagaaaaagtctatctgattaataataacagcactggcatttgcagagcactttctctgtgccaggtactgtcatgctaagcactctagggtcattaactcaatcttcccgatgactccataagtcaatgattcctattttcataggaggaaactgaggcttccaggttcaataatttaccaaaggccacacaattagtaacgggaaagtaggaaatccatcccaggcagtaagacctggaagaccacaaagctacctccatgctgcactgctatccagtcaccccggacacacccacagcatcactggaatcctctggtaccctcgcttctctgctccccacctgtgtggcaggcaacagaaaggaaatgcagaaactagaaatgctgccagggtctctctcaggggaaatcactgtggttgcatgaacagttaaatgatgctaaaaacctatactttaaaggggcccagtccctgggaagatcaaaagtatacacctacacaacactgaattctgatctcattctaagacaaggctatggaaccacacagtcggattaataattctcttgaccacttttaaataaaataaatagagaacgttgtttatagagctacatgacagcaatattaacactgaagtcccggagctacatttaagtgatcaatcactaataatctgtgctcctttaaggctcacacttcttagttagagatttatcttgttccaggctctactgaccattctgcagttacacgcttgcaggttatgatggctgtgcatgtgacaccatggtcctgcaatggtactgcctgcgtagatcggcatcttggcagatatcgattaatggaatcacatcacagagtattcagtgcttatagtcctttaaatcttgctctggtctaaattgtgtgttaaattttataaattaacacggataccttcttattttaataaaggctcttgtttaacaaacccaatagattcatgctaatctaggctaatccatgcaatcttttaaaatcagtgtttcccagaatgatcagcagaacctgctttagaatcggcttaaatattaccaaaaacttcagattccttgggcctctccctgagacctactaaatcagagtctacggggttgcagtccaggactctgctttcctataaggtgcttcattgattctaatgcacgtatgaaggtttaagcttttaggtaagacccagtactaatgtttttcaactgattaaaaacagcaagaattaaatccgcttccaaagggtaaaccctgcaaacacaacactataaagtcagcggaggtcaaaaaatacatctcagaaatgggggcgaaaacaagtatgacaaaatcacttaaagactgaaatattaattaaaaacttcagtaacttggccaggcatggtagctcatgcctataatcccagcactttgggaggccaaggtgggcagatcacttgaggtcaggagttcgagaccagcctggccaacatggtgaaaccacgtctctactaaaaatacaaaaattagctgggcatgatgacgcatgcctgtagtcccagctacttgggaggctgaggcaatagaatcgcttgaacctgggaagcagaggctgcagtgagccgagattgcaccactgtactccagcctgtgtgacagagtgagactccgtctcaaaacaaaacaaaacaaaaaatcagtaactcaattttaaaattacagaatctgtttttaaatgtatttcaaagtagttgggaactagaattcgactaatttgcagagggctcttgtaatgatgagatgaatgccatattatcacacctgttaaggaatcactgagggccaactatgtacaagatgccaagatgccacctaaagtctcagcaaaggatgagaagacaccatccaaaggcactgcccaagtcctgaaggagcttagtgtatgcagggaggaagcttaaacaatcagcttcgacgcaagaaaaactgagccatgctgcatatcatttttaaacacaactggaatattttataacttgtttttttcatctaataatatacagtagatgctctgtgtctgtacatataactctacatcaatctttttttctttttttttaagagacagggtctcactctgttgcccaggctggagtacagtggcacaatcatggcttgctggaacctcgaactcctgggcttaagtcatggagttcaagctaccactttatcctcccatgtagctgggactacaggtgcatgccaccctactcagctaattttttatttttttttatttatttatttttttaagtagagacagggtcactatgttgcccaggctgatctcaaacttctggcttcaagcagtcctccagcctcagcctcccgaactgctgggattacaggtatgagctatcacacccagcatctacttcaatctttggcatttgcaggccattatgaaatgcataaggcacaattcatttacttaatctcccattgatagatgtatttaaagatgcttccaggtacttgctactatgtaaataatgctaaagtgaacaactttggacattatctttgcatttatgcatgatatttattaattggaataatttggtcaaagagtacatatttaagtttttacagttccagattgccaccacaaaggtctagaccattgtagcctcctgctttggtgtgggataatgtccatctccctgcaccctcttgatttttgtttggttggttggtcgtttttcttttcttttcttttcttttcttttgagacggagtttcgctctcgttgcccaggctggagtgcaatggtgtgatctcgtctcactgcaacctccgcctcccgggttcaagtgattctcctgcctcagcatcccgagtaggtgggattacaggcatgcgccaccacccccagctatttttgtatttttaatagagatggggtttctccatgttagtcaggctggtcttgaattcccaacctcaggtgatctacctgcctcagcctcccaaagtgctgggatcacaggcgtgagccactgcacccacctccctgcaccacatttttttttttagaaggagcctcgctctgtcacccgggctggagtgcagtggcgcaatctcggctcactgcaacctccgcctcccaagttcgagcgattctcctgccttagcctcccgagtagctgggactacaggcgtgcggcatcacacctggctaatttttgtatttttagtagagtcggggtttcaccatattggccagggtggtcttgaactcctgacctcgtgatccacctgcgtcagcctcccaaagtgctgggattacaggcgtgagccaccgcacccagcccctgcacccttttaaccaaggtgaccacatgaaccagtttgcctgggaggtcttggtttatatatgtttacccagaataattattcacagtgttcccttttattctctgcagagtctctctctgtcacccaggctggaatgcagtggcatgatcctgactcactacagcctccaactactgagctcaagaaatccttccacctcagcctcccaagtagctgggactacaggtgtatgccacatgcccagctaattttttaatttttaatttgcagagacaggatctcactatgttgcccaggctggtctcaaactcctggcctcgagccatcctcccacctcagcctcccaaagcactgggattacaggtgtgagctacctcctcattttggatgtgagttatatggtcatgctagtgttaacattcatctttgtcaccagagaagcaaaaagtgatctcagtttggatttatttcattattagtaaagttgggcattttttatgtttattgactactacatcttccatgagttgcatattataacccccaatttgagaagggggcttaataactaaaaccttaattttttaatatcaatagtgagaagctttctatgtatgtgggtcaattcaggaaaaataatgtttctaggtgtgtttctccattcaaaatagaaatcactttttttaactagcatagacagaaatgtatattcctgcaaattatattatcttctttgttgaataataccagtgagaaattttgcattccttacagttttgaatcttctgacattagatttagatctgaagtctgaaggttgttctttactgggttatattctcacagcaatttcaacatacttatatatttagcaacaatgggtttcccaagtgacagcaactgaacacttgtgatttaccagcctttgagatggtagaatcagagcaccttattccaagtaaaatgtaactgacatcaaaagttattctgtacctggaaaaacaaggattcaactggaaattatttaaatgcaattcagcagttccctactagtctcaacacacttctgatttaatgtctacactaagctacaggcagaataacttattactctgaatagtaccatctctttctaataaggaaaatggaacaagttagatattgcctctctactggcttgtgagctagacagagttcagctaactggccttcagtaagcctccacttgaatatcaaatggacaatactgctattaccttataggttatgtctaacctggcctctatgagcttcaagagaatcaagaaatatcaaaaacattaattttaacacttttattggctacatgtttaaatagggctgatccgatatagtaatttaacacctaacctattttgtacttacttagggcaaaggaacagtatccctacgaagtagtagtagtattattatccccacttaacagatggagaagctggggcatcagaggctaagtaatttgcccaaagctagatagctaaaaagtgacagccaagatcttgagcgcaagaagtctgattccagaacctctatggtggaaccactacagtatcctatgtcctgttacttacagaaaataggtactgttttaacttaagctatttaatgttagtagaactcaaggtctcaaggcacaaattaagaaaaatcggccaggcgcggtggcttacgcctgtaatcccagcactttcggaggccgaggcaggcagatcacaagatcaggagatcaagaccatcctggctagtatagcaaaacctcttctctactaaaaatacaaaaaatcagccaggcgtggtggtgggcacctgcagtcctagctactcgggaggctgagacaggagaatggcgtgaacctgggaggcagagcttgcagtgagccaagatcgcgccactgcactccagcctgggggacagagcaagactccatctcaaaaaataataataataataaaataaggaaaaaaataaagaaaaataaaaatcctgattataaccattaattccattttctttctaattataggtaaaaatgtctccgaaagcctttcattttccgcttccctcaagcccccttgggtctgtctttaggccctccaaagtctctagcctccaacactgctcaatttctgcagtgaaaagagcagatgtcaaacaggtgatagggataaagaggaagaacagataagctctccttcagtgggtcaactcctggtcaacaataggaaggggccctggggcaggcccctgcccagggagatatgtgttaggaggagatggcttgctttggtggcaactcaaagcaaaacaaatcaaaaattcctggtcacccatgttgtctaaactctgggaatactaataaatatgttttagtatctcctgtgcacagaacaaggccatggaagaataacttagaaaaaacatcatagttgatgacagtaaagcatgtttttaggtccactcaaaaactcccagatcatggccataaatgtactggagccactcccaacaactgaggacaaatagggcatatagctttttaactgtgtctaccattttcactccttatggctcagtcaatgtgggagagtaaaagctggttcttcctcagtcatttgtgagtaagacaaaatctcaacagtcagggaaccacagaacctaaaaatcactaacttcaataaaaaacaaggtatgaacaagtgtagtatctatactctcatttgtagaagggcaaaaggaggggctttatatacacagatatattgcataagcatgtatatgcacagcataatcctgaaaggacatagtgaacactgatcacactggtgtcctcttgagaaaaggtttaagaggtgatacacgcaaagggattagcaggataaaaatggagcaaagatttatttttgggatttatttttcaccctgcagacttttaggctgtttaaatattttatcctatgcatttcttatatttcagttcttttttaaaaattccatttcaaacacttgtaatatccaatacactggagacagtaaaggaatgagctataaggaagcccaggtcctggctccgtaatgaactctcggcatgatcttgaacaacacatgtaacaacacacactaaacaaggggactgggaggtgcaggggagaaaagtctggtataagcactaggatagaagctctgtaagagtatggtcttcattgtctgtctgacacactgccacatccctaaacacagcaaactgcctggcacatagtagggtctcaagtaatgcttttttttttttttttttttctgagacagagtcttgctgttgtcaccccggctgaagtgcagtggcatgatctcggctcacggcaacctctgcctcccgggttcaactgactctcctgcctcagcctcccgagtagctgggactacaggtgcccgccaccatgcctacctaatttttgtatttttagtagagatggggtttcaccgtgttgtccaggctggtctcgaactcctgacctcatgatctgcccaccttggcctcccaaagtgctgagattacaggtgtgagccaccgcacccggccaagaaatactttttaaagatataattgtacctccattgatctgaactagcaatcacagctgctctggagtctgcaagtctatgaccttcatctacctggaagaaaactgaatggctcacacacctggacctgatccagacagagccttaaaatccatcagctgctcatcagatgatcccatcggatgccaaggaggccatccaaaggctggaatgatcagttctgtgagctattgagctatgtgaagaaacggcggttgatttgctttcttgccaagaaaagcaaagctccctcacactccacggccactgagcatgtaagctcccaagtataaatttcttcccatccaagccctctcactacctagccctgagatatggggaacattaatccctctaagcctggctcttcatctgtaaaataggatattattacctacaactcctaaaattgcttctaaagtcccatccttcactcagcttttctcttcatctggccggttctacctacctaggcttcacagagcagggcctgggcagatgctcacctccctccacctccacatttcagatggactcagtgggctcagtctcccacacaggagtacggcaggcatcacggcactacttttacctttgagaaatgtgtttagcaactgaaaaccaagccaggtggcctaatccatgcctactttaggtgcagtttctttttatattctgttgccccgtaagaccagtgaatcaagttaaagggttcccatcaaatctgagatccttttgctttttaaaaaagatgcattttttcctgaaaaaattacagctagagagaaaaaaataaactaactagtagtacctgcagtttctcatcattaactgcttcctggagagttaataaaagaaaagcaattgagaggactgcaaatcaagcagtacgacttccgagggggtccccaaggagcttctactataattcctgccacagagtccaaaaaaaggagccaaggagcctttcctcactgttagaggagaacatgaaggcggccgaaggtcagaagagccaccttgtgaccagccacagatgctcaggagggagtttgagccatgaaagagtcttgacaaagaggagacttttattccaaagcagaacaccggcacagcagtcacgcttaggccgaaaacgtctctgtccagcatttcaatttatcccaccctctgatttttataataaaaagaacttgtcagcaaaacttttccatctccttgttagtaattttaattccacctcttggaagaaggaaatggttctttctttctttctttttttttttttttttttgaggcagagtctccctctgtcgcccaggctggagtgcagtgcagtgtgcaatctcggctcactgcaacctccacctcccaggttcacgccattctcctgcctcagcctccagagtagctgggactacaggcacccgccaccacgcccggctaatttttttttttgtattttttagtagagacggggtttcactgtgttagccaggatggtctcgatctcctgacctcgtgatccgcccacctcggcctcccacagtgctgggattacaggcgtgagccaccgcgcccagccgggaatggttatttctaaggcctccttaatgcaaacaagaaaatggcccaaattcctaagggacttgacaaatactatctatttctgagatgtcctgagagtccaaagctgtaatgttcttaagatgtaaaaaggaattcacagtaccaaaagctgatgcttcagaaatgacctaataaataattaagaccaccagccatgacaattgttaacagcagtgaatgtttagcagatactctgtgccaaggattgacttatgaactacacatatatcgtatcatgtatgtccagcaacgatctcattttaaagatgaaataaccggggcttgaaaacattaagtaacttgcccaaaaccattggtagttaagtggcacaattaaaagtaaggagtttaaaacccagcttttaatcactgaaataaattactaaaataaaaatcaatacaatagtctgaataaaacaaaaataaaaacagatgtctaatattatgaatttttgttttgataaaagaaatgctactgtaatactgcaatactactagaaaaacacataggaggaaagttccatgacactgatctggacaatgattttttgataagatcccaaaagcgcaggcaacaaaaatggacaaatgggatttcatcaaactaaaaagcttctgcagagcaaagcaatcaacagagtgaagagataacttataaaatgggagaaaatatttgcaaaccatacatcttataaatggttactatccaaaatatataagaaacacaaacaactcaaaagcaagaaaacaaataacccaatttaaaaatggggcaaaatgggaagggagggttggggagatgatggtcaaaggacataaaatttcaattaggaggaataggccatcaaatccaaatttgagcaaaaacctctttcaggaaaaattacaactctaaagactgtatcagaaatctattgcacaatatggtggctacagttaataacaatgtattgtattcttgaaaaatgctaagagagattttaaatatcctcaccacaaaaaaatgataaatatatgatgtaatacatatgtcaatcagctcaatttagccattccataatgtatgcatgtttcaaaacaacatgtcgtacataataaatatagataatttttgtcaataaaaataaataaaatgttaaaaaaattgtaatgggcaaagattctaaatagaaatttctcaaaagaagacctacaaatggccaacaaatatatgaaaaaaaggctcaacattactaatcatcatggaaatataaattaaaactataatgagataatacctcacacctgttagaatgacaattataaaaaaagtgctgatggggatgtggagaaaaagaaattcttgcatactgttagtgggaatatacattattacagtcatcatggaaaacagtacgcaggtcactaacaaaaattaaaaatagaccgggcacagtggcttgcacctgtaatccaagcactttgggaggccgaggcaggtggatcacttgagatcaggagttcaagatcagcctggccaacatgatgaaaccctgtctctcctaaaaatacaaaagttagccaggtgtggtggcttgcatctgcaatcccagctactcaggaggctgtggcaggagaatcgtctgaacccgggaggcagaggctgcagtgagccgagattgtcccactgcattgcaacctgggcgagagtgagactctgtctcagaaaacaaacaaacaaattaaaaatagaactaccatatgatccaacaatcccacttctcagtacatatccagaggtactgaaatcagtatgtcaaagagatatctgtactgccatgtccactgctgcattatcccaatagccaagatatggaatcttcctaagagtccctgaacatatgaatgaataaaatgtagtatagatacataatgaaacactgttcggccagaaaaaaagaaggaaatcctgtcattgaagataaaatggataaacctggagcacattacattgagtgaaataagccaggcacagaacgacaaataccacgtcatctcacttacatgtggaatctaaaaaaagttgaactcatagaagcagagagaagaaaggtggttagaggtaggggcgggggaggggttggtcaaaagacacaaaattttagttagaggggataaataatttcaagagatctattgtacaacatggtgactgcagttaataacaatgtatcatattcttaaaaattgctaagagagtagatttggagtgttctcaccacgcaaaaaaattataagtatgtgtggcaatgcatacgttcattagctcaatttagccatcgcagtgtacacacatttgaaaacattacattgcacatgataaatatatgcaactttcatgtgtccattaaaatctgattaattttcaataaaaaattttaaagtatggttatgtaaacttactaaatcaatgtttccaacaggacactatcagcgaatggaacaaaagagggcagacttcagaaacatgcgacacagaatgcttaggacaggatcatttttaaaaagccaaagaccagtgacaatgaagacaaggcagtggcatttggaggctgaaagcaattcaatttatttaactttgaagaacaaaagcttattcttctcaggagaaaccaaaacacattttctgcagaaaaaagaccattttaaccgcattgccaaaataaatcaggcagagggcaagagggcaagttagatgtagccacaaacaagaactcagaccaacaaagcagggttagacgaatggggaggccatgcccaacatcagatttggggttttaaagggagaaggaaccagaagggagagagagaaatcctgccacagtcttgataacattctatttagaatataagtttagtttctggtaacaaacaccttaaacaaaagaaataaaaaaagaaacctaaccaataagtggatatgcatttgtatttgaatatttgagtctgttctacaataaaacaaaacattgcagtaaaattgtttggctaaaaatccaaatttgagcaaaaacctctttcaggaaaaaatacaactctaaagactgtatcagattgtagaagagacacatagcactcctctcctgcttcactagctgcattccagtgcagatcttctggcttcgtctagaaccagagagtctggcccagaagtaaaattttcagaatttttctagttggaaaatcaagtcatgttaaatgtcccaaacatactttttttggggggatgagatttgaaaagaaaaaaaactgcaagaaaaattttaatgaatacataatttttaaaacaccaatgaatattcccttccttcctttttcagggcctatacttcattggggtaatcagatagggccacccagcaggtctcaatctgagcaggctctactcatgggacctgctcgtcttggacccagttgaatgaagtctgtgacacctgaagcaaggctgcccaggttcaagtctaactctatcacattcttgctggtatctctaaacaagttgtttaaactctctgtgcttaagaccttcatctgcaaaatggggtactagcacctatagactgccgtggcgaggattacagaaattagctaatacacggaatgtgcctttcaaagcatgcccaagtacagaatacccaaaaaactgtaggtattataattaatttactccatggatcatggacatccatgatactattctacttttgagtttaaaatttttcataacgaagaattaatttttaatttgaaaatcaattacaacaagttggaggctcggaaaacacgtcaccctttgaaggccactcgtgctcattgtgatttgagcagcacaacacaatatgactaccttctactgagaaccaactacattccagactttctcttggctcttggattaaaacaatgaatttaataccttatttcacgttcaaggaaaccaggggtagggcagttaagtacaatgtccaaattgtgaagctcagatttgcacccatgtcttctgatcaaatccaatcctcgtttatataatcctgttgaataacagtgtgctgtgcagagaatatctcattgtaaatcagttaaatgtggtcaggacttcagatgcttggaccaaatttctataatcagaatcagacagattcgggccaaaaaaaccagctgagcaatcctaattccttctaaccttcccagatctagagtaccgctctctgggcagtggtggccaaaatcagccatggcactagttagccaagctctaatcagaggtgagtctgacaagaggatcatcttgcagttcctaatcgagggcaagccaggtcttctggtgcaatcggctccatctctcaactcactgcccagttgatgactcatactcagcctgtccttatgacccatactttctttgcagctaagctggctgggccttcctcacctaagacttgaatagccagatgcttctcttcccagatagccaagtccttcactgaccttaatcagaatgctcctctttccagctatatgaccttcaacatgtaactcacctttcccattcatcagtttcctcatctgtaaaactatgatcatagtactaaccccatttggagaggtttataatgatgacatgtgagaaacacatcagtaccatgcctagaagactagaatattgaattaacgttagctgctgttattacccatcttcatcatcctcttcttaaattcctcttgactcccttccctaaggtcaccagtaactggctgagaagccaatggtagacttttctgtactgtttctctctttaagaaggctcctattctgctcctaaactcaggaagagacgccagatctccccacaggcaaaaccgcgagggctaactaacactagaaaatgatcagagtccctatgtctcagaaaatttaggtgcacagagttgttccagattgcttccagagcaccttcaaccctctgagcccggcagattatcagagaagcttcacccaaaagccacatctctcctccactcagccacaccgaccaaaaatgaatgaatcacatggtaataatcagtagcatggacggagcatttcccacgtgccaggccctgccttcacacgtgcaacttcatggaaatctcactcccgcccctgaggcaaagagcaccacttccaatttccagtgaggcatagaaagctcaagtatcttgcccaggtcccagggttagtgagtggcacactggagcttgaacctggcagtctgactccagggttcatgtcagttttgctgtgtccctgcctgacctctcccccattgcccgccctcccttccctatgtaagtgtaaactcttctgccttcatgttcaggctctgatggttccatggagcacttagggcatgatccctcccaaatcgtcaccgttgctcttttacaagggataagaaacatggaaaggataaataccactcaagccggaacagaaataaaggagttaagatgaaagttaagccactatcaatttatcacagggttctggtgcgtgtgtgtgtggttttttttttttttttttttttttttgagaccgagtctcgctctgtcgcccaggctggagtgcagtggcgtgatctcggctcactgcaagctccgcctcccgggttcacgccattctcctgcctcagcctcctgagtagctgggactacaggtgcccaccactacgcccggctacttttttgtattttttagtagagacagggtttcaccatgttagccaggattgtctcgatctcctgacctcatgatccgcctgcctcggcctcccaaagtgctgggattacatgggattacaggcgtgagccaccgtgcccagctgcgtgttgttttttttttaagcagtgtcttgcaaaattaaaattgccaaatcaagaaataaatcactgtggcttttcaattgcctcaaaatatttggtgggaagagaaatattcgtattgaggtttcagaactgtgacacaaagaaaactggtttccaacagaataaaaggaaaaagcattggtttgtttgctccagactttttcaagtcacagtttacctaaaaatggtgacaagattacaagtcatttggcctgcatggttgtttaaaaaaaaaaaagtaagctgccaatatcgaaaatcagtgattttacattttagaagtctggattttgtctttttttgcgtaagaagatgcagcaacactaggtgctttctgcctcgtggtaatgcaagccctatatggtgggtgatgtgaattctagtttgccacaatccccaccatgccacattgcctcacaagtaatcctctatcctcattatcacacaggccaagcccctggaggcactaagtttgtgacttctttacaagaagctctaggcagacaagtaatcatgttcagtccccctcagtcttcctgggtcaaggaaagctctcccacttccctgtcaaataccattcctatgctgccacagcacctgggaggctccaagtaccttctcctcaccctgcaccactctgcccccaatgtcaccaaaaccacggctcacctgctactctgtgccactgcgttctctcttcacaggtgttgccggcacctccccattgacggtttcagccccactaacagacatcaggcttctccgttccttctggtttgacttgtgctccacttttgtaactctaaatctgaggggggaatggggagaggtgatggggtttgcttttctaataaacaagaattatgaataaagcaaaaatcatccacccagaggatctcaaatgaactcagccaaaagttaggacacaaatgaaaaacaacatattcgaacatgcattcctatccagtacattcccctggcccctgcccaaccttccagctgatttctactcagccacatcacagactaagccggatattttacagagcatgcaaaaggcatttaaaaactcaggtattggccaggcatggtggcttatacctgcaatcccagcagcactttggaaggctgaggtgggtggattgcttgagcctaggaatttgagaccagactgggtgtatggcaaaactctgtctctacagaaattacaaaaattagccaggtgtggtggtgtgcacttgtagtcccagctactcgggaggctgaagcaggagaatcacttgagcccaggagctggaggttgcagtgagccgagatcacgtcatgcactccagcctgggcaacagagctagaccctgtctcaataaggaaaaaaaaaaaaaaaaaaaaaaaaacacctcagagactcgaatattaaacagcgtcagagttgtcgtttctaacaatgatcagtttttttgtttatttgttttcgagacagagtttccctcttgctgcccagactggagtgcagtggtacaatctcggctcactgcaacctccacctcctgggtttaagcgactctcctgcctcagcctctcaagtagctgggattacagccatgtgccaccatgcctggctaattttgtatttttagtagagatggagtttcaccatgttggccaggccagtctcaaactccaacctcaggtgatccacctgcctcagcctcccaaagttttgggattataggcgtgagccaccatgtctggcctacatcagtttttttaaccacagaaacctggttaaatgctcaactggtttacaaattagactgacgtaaccagaatgtttaccagaagatgacgaacttccgaaaatatgcaactgtcaggcagtcctatctcaacacacacacgcacacacatgctctcacacatatgcagaaaatctgaagagccctagaaacacattttatcagcattagggtttgagagtaagcctttaaaaaaaatgggttaattttcattatagattaaggaaaaactaaaggaagttaaggaagagattttcattaagaattaagagttaaataaatgtattcagtttaactgttttttctagtatatcatcaccaaatcctagagtctttcataacagcttctttctagttctggtcttaatttcccttaaaaattatctgaaataaattctccttctgtgtccaaaataagatcaccaaccctgaagagaaggctctgaagaagtgaaagaaataacagggaaactgtaaacacaaatctattctgtcaaactgtaagactctcttaagtaatacatgctgaaaaacagcctggaatcattaagcgctcctagtatccaatatccaagaaagagagttggatttggggcattttaaaaagccatgtttggccaggcacggtggcttacacctgtaatcccaacactttgggaggccaagacaggtggatcacttgaggtcaggagttcgagaccagcctggccaacttggtgaaaccccgtctctcctaaaaatacaaaaattagccaggcatggtggcgggcacctgcagtcccagctactcgggaggctgaggcacgacaatcgtttgagcccaggaggcagaggctgcagtgagccgagttcacaccactgcactccagcttgggtgacagagtgagactccacctcaaaaaaaaaaaaaaaaaaaaaaaaaaaaaaaaaaaaaaggcatgttgaatctgagttgaaaatttcagcagatttttttttaaggccaacaaaacatgctttgtccaaacaagctacaggttctcactgctttgcattcataaattcccatgactctgcttcttaataaaacagtgtggtcatgaattgtgctgttttgctgtaagtggcaaacagccctgcaagtcttctccatgatgcttgtgcaacacatgatgaaactcaactgaattaaaataaaaataataccagccaacatttcttgagtgcgtaagtacccaaagctggtttaagacctttatgtgagtcacctcacctagtctacacacagcaactctatgaggtgagtgtgactgtccttctcactttacagagggggaaactgaggcatggagcaacgtaacagtttgtaagtagtggtgccaggacttgaaggaggtagaagtgacgagttcaggttactcttcccaggggggttgtcagtatactgagagagaaggatcatgtaagcagcactgttgactttcgctcagtgctcacccggtctcactccagcatgtgtgttccttaccagtactccccactgtctttccaaatgcaacatcggcaatgcagttcctgcatgggactcagcatctaacagcagaactgcaaaagcatcccactgcaaagatgcttcaggtaagggccaatggattcatcacttgaactgcaagatctccacctcacatatgggtcacaagtgaaaggtactaggaccaagaaagccaagacacagtggaaagcaccacccactaaaagaaagcagtcaaagcaattcacatggaacttaacagacagacactggagggctgtggaccagatccacgtcttctcccttcccttgcacatggcttgatgctatttctcagttccctgaaagttagcttggctgggtgatcaagttccagccagtggagtgtgagtcaaaatgatacgagccactctcaggcctagctctttcaaaacccctcgtgaacaaccttccacagacctgctcctttggctggcaaacctggcagagccacaaacgaagggggcctggaaccctggacaagtacttgaagagccacccattgatatctcaatacctgccctggattccataagtgaaatataaatgtctattctgtatacagttgaaaatctgggctttatctgttagagcaggtaggtatttatcttaatacatttaccatctgatctagcaacagccaccttttaggattcttctgttgttggaaaaatctaggactcacaccagaaaacatctaaaaagcccagagatataacctgagacaggcacagagaacatattctacatctgacaggtaagcagaagtccacacaccagagcacccatgtcacacacaaaccaaaagcatctgaagggatcttacctgccaacagaaaggaccgtgacctcgccttggcgccgtggtctgctctctctggacttgttagtgggctttataaagtgccaccgcttgtgcctacaccgatgacacacatccctctcgacaacaccgcccaccgtatgcagatgatggccacagacgtgcttccctggcgtcccccctggtgacaaaggcccaggactcactggcgggctccctggtgtgctgggggtcacggggctaatgtggggaggaaaacaaaaagagcaactggttaaaggaaatatcagcgaaggtgatctctctccctgtgatgacagaagcagtttaaattgaaagaaaaaaaaaagcgtcttccaattgtacaaatggactttgtgaacagacctcagacagcaggtactcagttctcatgaccatgcgatgacagtttatcttaagcaataataatatgattcacggtcaggcacaacagctcatgcctataatcccagcattttgagaggccaaagtgggaggattgcttgtggccaggagtttgagaccagcctgagcaacatagagagacctcgtctctgaaaaaaaatgaaaaaattagtcaggcatgatggtgcgtgcctgtagtcccagctacttgggaggcagtggtgggaggatcacttgagcccaggagttcaaggttgcagtagctatgattgtaccaccgaactccagcctggatgacagagtgagacctgtctctagaagaaaaaaaaatgtgatttatcacttctagaatggaatttattagctgggaataaaccactgcttctaatagtgatacactggctttaaagtattatgtttctttctaaaacactgatctcctttctcatgcaattatcctaatttctcacataccagagtgtctgcctatcactctaagcaaagagattctctaagtatatatgccctggaaaagggaagaacccaaattccatcaaattatcagataacttagagaaaacatttgatcaaatctccattatatcaaaggaggaaagcctttaggcaaagatatcaaaagtgatgttcaaaacagatgttgatggtgttgataacagtcataattaaatagctaacagtattctaagcatcttatatgtatatgttaatggaattaatccttataaaatcttatgatgtaggtattattaatttcttccttttaacaatgaggatattgaggcagggagaagtgaggtaacttgcccaagatcacactgcaaataagtgctggatctgagatccaaacctagaaagtttaattccagaaaccatgcaattaatcaccttgctatacagtatagtgcttcagaaacagcagagaccactttgataatctggaatatatttggctagaccatccaaaatataaaaagcagaaatatggccaggcgtggtggctcacacttgtaatcccagcactttgggaagccgaagcgggcagatcacgaggtcaggagatcgagaccatcctggctaacacaatgaaaccccatctctactaaaaatacaaaaaattagccgggggtggtggcgggcgcctgtagtcccagctaatcgggaggctgaggcaggagaatggtgtgaacccggaaggcggagcttgcagtgagcctagatcgcgccactgcactccagcctgggtgacaaagcaagactctgtctcaaaaaaaaaaaaaaaaagcagaaatacatagtcgagataagagctattttcaaaaagcatgtgtgaaggctctggcccagcagaaaaggaggaattctaacctaacagagccaaactgagcaggaatcagccctctggtgcaggtgggagtactgagggtggcgtggcacccacagcctgacacctggactgtggcaagagccccagagacacacaggaggctgtgatggcagaaaccagccttttcggtgatgcaaactggccacctacacacttaaaaaagaagtagagcctacggttgaggagaccgcctcaaacatgactgagccaaaagtcttctggtgctctttagggatgccttcctacctgttaaaataaaaacacaaagcagtaccttcctggagtaaaataatgttaaattagcaccacatattagaaagctgaatgcaagagtttaacaacattcattcaacaagcatttctcaagtaccagctatgtacaaaacccactgacgggcactacaggatgcccaaagatgactgagacaaagacaccttgagctaagatggtcagaacaccagccgtctgtggccaggactggaatgtgggagaaatcagagctcttctgtctctatgactctacgtctctcctaaactcaactccttgcattctgagttacctttctaaaacacacatctaacgtagccagtttgacaaacacctgttaaacatctaaggtgtgctgagtgcacaacccacatagcaagtgaagaaagatccagcccctttgccatgtcagttggcctggccaccctggactgaacccttcacaggtgagtcccaggctatcatgatgtggtgacttttcttctggcccttcttcctacagccagccctgactcttgtctccacctcctgcacgcctggttcagatggcacctcttccatgaaccttcctgaatgcccattggccccccggggtcccccagagccttcagtctccacccatcctacagcattcacaggctctccaccatgaggcctcacacacacatctccaatcctgtgttcctccatggcaagggtctgtggatgtccagctccagagcagcacccagcacacagtaggcatccaataaatgctccttgttgaagaaataatacttttatggaaatacagttctctgtaattaattatgaaggaatatgctgctcaacaaccataacctaaaatagtaatacaaaaacagaacatagcaggtagctccaaaccagcttgttcatttaatcatcattgttcatggaggtctttcaatgcttaaggtactctgtattccttataacaaccctataaagctggtactgtggtgatctccattttatagatgatggaactcagggtggtcagttaacttcctcaagaacagacagttaatattgtggtacaggcaggactcaaccacatctcccaattccaaggctatgttcttgcccttaacctctatgccttccttcttcccatcactattctctaacacagcagttctcaaccaggagtgactgtccccactacgggacattgacaatgtgtggagacattatgggttgtcacaccttgggagggtgggggcaggggatgctctgacaccttgtgagtgaaggccagggatgctatcaaacatcctcaatacacaggacagttccgcacagcaaagaactacctggtcccaaaataactatagtgttaaagctgggaaacctgctctagcagaagagcatttcagatggcgccatatctgagcaagtaactgaaaagatgtcgcactaagaaagaggggaggagcactcacctttcaggatcatacaggctgttatctgctaccatcgcctttaagacatcagcattcgctaaggaataaaaataaaattaaagaattaaaatagaatgaataagatgagtaatcacatcagaaaagctgttgaaaacacatctaattccattctttcagttcatagatgaagtcctgggggcctagagaaaggagggtctcccccaacataactgcataacatggcaccatctgtcagtaacttccaccccacaggaacttagtaagaatgacaaagaatctatggcaaggagagcagatctactataaggcattgcttcttacacatcaatagcaatataaagtagaagaaaccaccccctcaccccacaccaactccaccaaactaaaggaccatttatatgccgctgctcccttgcagttaactaattttgataaatatactttgaaaaatatgatagtgaaatgtatttcataagtgacctatagtctaataacttgtatgtgccaaaataattagccctaaactctgaatcctcctgtagcatcaattctatcccatatcgattcagggatgagagaaggttaattttccagatgagcttcaggatcatataagcccttgactggccagatatcttaaaatttcaagtattggccaggcgctgtggctcacgcctgtaatcccagcactttgggaagccgaggtggacagatcacaaggtcaggagatcgagaccatcctggctaacacggtgaaaccccatctgtactaaaaatacaaaaaattagctgggcgtggtggcaggcacctgtagtcccagctacctgggaggctaaggcagaaaaatggcatgaacccaggaggcgaagcttacagtgagcagacatcacgccactgcactccagcctgggcgatgaagcgagactctgtctcaaaaaaaaaaaaaaaaaaaaaaaaatttcaagtattgatcacaacatataagttatgtaatatacgctaactttaaaaaattagacttctaaaaaatatccaaatttgtagatgggaagctaggctgtcaacaaaagcaaaaaaaaaaacctaatctaagattcttgagtcccccaacccacacccacatccacatccacacgccatgtgttttctgcctccttgtagagtggtcacgctccccaggatgaaagactgaagtgaatgttcaagtttcccttggctatttaattggcaaggccaaatgttattactggcttgtaaccttttcaattgatttctgaagcactgttctcatgactaaccacaacaattctctagagaggaaagaacaaataaaaatcactatttaccatgtaagccaacaccaacatttaatgtttaacattcaaatgacttttctagagaaggaatattaattctagttccaactgctgctgtaagttttaacagttaagggcttacaatgtggtgtttctcaacctggctttcattattgccccacccaagagccttgttcaactattttaccctaatgactctcccattaatgtacaatacggcagatatattatatactcagttatgtactatacacatatctgtgctttacatataagagagtgagtttttttttggccccgatccaatttttatcttcttaggggacacattgccccattgcaacccttgagaacatatgggtttttgcttttttctttgaagaaatattaatacaacacttaatcttttgccaaaagaaatactttacccttcacaactatctgtggatgtccaaatgcattttcaaacacaaattttgatctaaataagacctcctgtcattacaaaaacattatgaaaacggatccatagtaatttctcctgcacaataaagaagacagttccctctgtaaaacacatttaagtataatccagtaatgtcagttaatttcccttttggctaataaatgaggattcagaaaaataatgtcgtttcagatactaggtttggatatacaatcccatatacaattttgtattttattgtatacaaaatacagtagtcctcagtatccatgcggggatgttccccagatccgtgcagacaccaaaatccacagatgctcaggttcctgatatgaaacacatctccccctcccccatacactttaagtcatctttaggttacttataatacctaatacaatggaaatcctatgtaaatagttgttatgctgttttatatgggaaataatgacaagaaaaaagtctgcacatgtccagaaggatgcaaccatccattttttttttctaattttattttatccttgattggttaaatccataggtgcagatctgatggatatggatggctgattatataaagtaatttgccacccaaacttactctgccaacatttaccatacttcaaaactataaacataaaaaagagggaaaacaacaccaataggtattaaaacagggacagcactatcagcacatacaggagtgagctttttaaaatcaaacgtttaaatcactgcctgagaaaaatcaatcacctgtaaaatgatgaccacctataaaatgaaaggtcaaattacaaaataattccaggaagataagatatattaaaatcattattaaagcttgctttttgtagatgtgtgtttctcggttattcatgaattcctgtaactcatctttatctctcaggaataattagtaaacatccccttggtttgctgagtgagtctctaggactcaccctgtggcatgtgggacacacacacacacacccacatgcatgcatgtacaggtacatacccacatgtacacacatgcgtccctgtctctgagctaatctccagggagtcaacttcagtaatctgtctattgggaacatttttggtttccagtgacgagaaggttttctaatataacaccaccgttaggactgaaacacatgccttaatttggttgtgaagttaccataaaagagcaatactgtgagttctgttgaaggtgtatctcctccttgcatattactcacagctacactaagccttaggtggttttctccacacttgccggcattttgtcaactacacttcctttccccaccttccccaaaatgggaggagctaggcacagggcaaggaaactccctcaagaaaagggaatatgttccaatgggtgacattttccagaaaagacctctttttctccctgaatccctgcttgataatatgcatgaaacagccaaaatcaggcaagaaaaatgtcttctgtctctcccatcactattctcttcaaagttttcctcacacctaaggcaaatttcccaagcaaaaactaacattgccatcaccaaaatgtaagcgccggcacgtgccagtcactgcctgaaagctttaccgatcttacgtgttggacttttctgatgaccttaacagtaggtagaattatcacccccattttacaagtatacagactaagacctaaagatcgtaactgactggccggagtcacacagctagagagtgacaggcttggacacaaaccctggtctgtctgactccagggtgggtgcttttaaccctgacatcttccttcctacccttcaatgtccaagtccccgcccaaagggacagaggttgaataatggttcatggcatgttgcataatcaacagagaaagtttcagaacccactcggtactcacagtcatttataaaggaatcttttctggcaaaatataaacgaagcctgaaggcaaaaacttcacaaaggcatctcttgcctagggatcagaagtactaatcactaaccagaagcacttgaggactatctgtagtactccctgcaatttttactaagcagccagttcaagggcctagcagaggaactcagctacagactcccagatactttccaaacatccatacaatgcaagaaaactccagcgactacccagacacgattcagttcggctctatttagaaagatgaattaaaagctagcactgccgtacatccaaccctttggattaggaaaatagtcagagtgcaggtgtggcataatatgcaacagatttggtcattgtcctgggttcctgtcacagagttcctaaaggccttggaatttcctgataggagtgtcttttgttattcataatgagcaccttttgatcacacctgggtttacactaatgcggtgacttggggtggagcccctaaacagtctcagggtggggccagtcatcattaagaccaagtgattagagggttggaactttcagccctacccagggacctcaggaaagtcagagcaggggaggacggggcagggttctgggactggaaattaaactggacaaaacaactcttgaacaacaagatttgatagcttccaggtggctgaacaggtgcaggtgccgggagggtggcgcacccagagagggcaggaaagctctgcgccccaccccaatactatgcatctcttctattttgttgttcgtgagttgcatcctctataacaagccagtacatgtaataaagtgtttccctgagtcctgtaacccattctaggattgtggatccctcctcccagccatttaagattataggtcagaagtaccagagccctggcttccaactggcatcccaagtaggggcagtcttttgggatctgacgctaactctaggtagacagagtcagaactgtattaaattgcagggttcggggatttggagaactgcaaagtatggaaaaaacccacatctttgtcagaagtgttgtgtgaggatggagacaaccaaacaaacaaagtgtgtttgcccagcaggtcagctgataatccatccttcaagagatatttatctaaattaaaattgacttccaacattaaagacataatgtgtttaaaccataaacaagaatgttaccatgagtacagttcaaatatcaccccatttgccaaacttaaaatgcgaagcagaaaccattcatatatcatgattgcaaatgtttacggatgcatgaatccaggaaaagaaaacctaaacacacgtgggaaaagggtaatagagagattgtgcttaattttattccttttttaacgtaaaggaaaagtcatggtacacgtatcacttttaaaactagaaagcaaaatttatattaattccaatttatcaaagacagaaaatatcaacagagaagtccaaattggtactaagttcaagttatgttaatcattgagacaaaaatatttttaaaaatgcatttagtccacaaaatagaggatttcagtctcaaagccgaactcaaacatgctaggttataaactggtaagagatcaaggctgcatcttatcaccaggctgtggttttggtgcaggctggaagctgaagaggccacagctggaaaggggtgtgcagcaacatcaggtattacctgagggcccaggaagggaaccaagggctgcgcaaaggattggagtcaccagctgtcctcacgggcccctggagaaaccgcaggtacacagatgaaggcatggacaggagaagaggggacccggggttgagaataagatagaaggcaaagagaactggggagcagaggagagaggagaaaaatggcacctccggtattgactgctcagtggtacctactggtgctaagcacagtaaaaacacaaaggctactttccaaaaggaaaacaacatcatttaaaaagaaaaagaaaaaaaaaccaaaacagccctattcgcccatgagtgtgggaagtgaggaaattatataatacgcctcctccaaggaccccaaacaccctctctgctgtaattaagagaagtgcttactgccagcaccgtcctgccatacctgcttgtgtgactttgaacaagtgtcttatcctctgggtcgctgtttcctaatctacaaaatagggtggtaacagggcctacgtcatctggtacttttatttttatttttatttatttatttatttatttatttatttatttatttttgagacagagtctcactctgtcgcccaggctggagtgcagtgacagtgcaatcttggctcactgcagcctctgcctcccgggttcaagtgattctcctgcctcagcctcccaagtagattacagacatgcaccaccacgcccagctaatttttacatttttagtagagacggggtttcaccacgttggccaggctggtctcgaactcctgacctcaagtgatcctcctaccttagcctcccaaagtgctgggattacaggcatgagccagcacgcccggccgctactttgaagaatttattgagttaatgcttaaggatttctacaaactaccccagctatatactgtccctctttgaaaggaataagttttccatccctctttcatgccacctggacagaggtactacagtaagtggttaaaataacagactatggaaccagaacacctgagctccaatcccagctccgccactttccagcggtgcaacactggcaacttagttaagtacggtgggcttcactttataacatgggaagaaaatgtcgagatcacagcatccctggaaagcccacagaacaggcccagcacatagcaaaccctcatgagtgctatgacgtcgatacgtgagaactttaacccctggcaaggttctcacagtttacttatttcgactgattcaactgccagtacccatttcatgcatcatcacaaatttggcaactgctccagcttttagaagcccgggtcccaaaggcctgcaagctccccacagccacgaaaggcagtctggaatgtgaaaggcacagaggcagtgaggcggtcatccatgccttacactgcacacttccagaatgggtacatcttctaggccaaggacatagtcatgcattgcttgggcaaattcaaaagcacttttttttcatataaaagaaacatccatgattgagtactcaagaacagtatcaccaactactgtgccctgaaggaaggtctctggaagacagagatcaaaatccaagtattctggtcttttttgttattttaaacatcatccgagtaagtttggttgtctgactttatagactgcagaaattgacaactgcatattagaagacaggagggacaatatcgtgtggttgaaaaggatgctgaatttgaaaccagacagacagagctgggctgctcactaaccatgtgaatttaattacttggaaccttctttctttatctgtaaaatgggtgtaactgaactaactttatagggatgttttgaagattaaatgagattacgtatataaagcacccagatctatgccaaaagcataaagcacattctaaaaacagcaatgaaaattatgctcaaccatacgaaactgctgtttctctaagtcaaaaaccgttgaagagagtcaaactgacaaacaggctgggcaggcaggtgctcttgtggagtagtgaggatctgggagtgtggggtgcccagggcagggcctgagggcagaggagcaggtatttactgatgagtgtggtgtatttcaacctttagacaaatggctcagctctatcaggctgagctctatcagtccacgagcccatgctggctaaagcacagacaaagcccaggggaaacattttcttttaaattgtaatgagaattcacagtgtgagaatccacagctattgagtaagtgggcaaggaatcccacacacctcaaatatcactgagggcatggtgtgctatggagggaataaccagtgctcagaacaataaccgtaaagtttctttactcaagattaaattaatcttccatttaagatgataatttagaatacatttcagggtgaaaaaatactaaatttcataaaagttcaactttgtaaaagtgttaacactggagaaaggatgacatagagtagacaaacagaagcacagcagcagctgccagtggacgggggaggagggaatggggagtggctgcctaaagtgtccagagcttcagcttgggaagatgtaaagttctggaactagacagtggaaatgcatgtacaacactgtgaatgtgcttaatcccactgaagggtgcactttaaaatggtaacagtactaaattttatgtgtattttaccacaatttttttaagcgcatgaaaaaggaacagacaatatttgagtacttaccatactgagcactctatgtgtgctatgtcccaacaatgctgtgaagtaaatattattattattattgtttcttattatttctttttttgacagagtctcgctctgttacccatgctggagtgcagtggtgtgatcacagctcactgcagctttgaaatcctgagctcaagtgatcctcccacgtcagcctcccaagtagctgggaacataggaatgtgccaccatgcctggctatttactttttttgaagagatggggtctcactattttgcccaggctggtcttgaactcctggcctcaagtaatcctcccacctcagccttccaaagtgctgggattacagatgtgagccaccgtgccaggctgaggtaaatattattatcctcattttacaggaagaaactctacctcatgaaacaaggcaatatagtttccccaaattgcacacaaccagtaagcagtgaggccaggatttgaacaccagctgacagcgcctccagggctgggtctctgcaacgcttagaccgactcacgcttagaaaactcactcatgtgaaacttgcgtagctgaataatgctggaagctgaggtgttagaaagcttaggtgaagtcagtaagagagtctatataaatcttgactcttcgaagcaggtttttaataaaggataggaatactgaattgttttggaacactaaaatgttcacaccttcatttttcatgatgtagtggacgatttgcccaacagtgtcactgttttcattcacactgtcattcaattctgaaagagaaaagaggaggggagaacaggttacaattggtcaccagcatcaagtcaatcaatcttagaacccaagacctcactgaacagtttccagaagcctcaggagatcacccatggtgctacaattctaggctttctccctccagccccaaacttcctaatgcataacaagcataaagagaaagtatcaaagctgtccatctatctcttctgaagttcaaatactcactttccaagacaataatttgaaaatgcatttgtaccagtcttcattattatttctctctcatcattttcttaaagccttatgagaaatgggaagaaagctcattaaaaaagaaaaagattctccttggattttattttaattgcagacttactatatcaatttacaatattaatttcctttttaaattggatcataattcttccatgttcatcagactgctgtatcctctgaaatacactttcaaattacctacattcagggcttggttatgtgtccacaaactcagtttactttggggactctgtaccaggagcatacatgacggtctttgggaaaaaaagcaaaccactctgaaaccaatctgcaaaatttgtttcaataagaacgaggaagggttgaaacgctccatcctagttcacagagaatgcatcaaggtgtgcagtgtcctactcatttacctggacaatgccttctccatccaaaggtcagctttcctccacgtgaacatgcatgtttggttagacagctcagaagctggctgctaagccaacctacagagcatctgggaaggaggagagggggaggctccactttctgttgacaaacacttggctttggtttgctcacaggctcatacatgactcatcatgcaatcctgttccttctcagcctcaaaggtcagtgggggtgggaaaaaccaacagtccagcaagctggcaaggaacgaggaacctcccctcagccagccctgctttgcctgaagggcgacctactccaatgtcacctttctgcagaaactgcccttagcagggctgaaaggaatagggggagtcacctactacctctcaaggcccaagtcaggaaacatccctaaagatgatgggaaagaaacatcagtggcgaaaacaggatttcgtctccccggtttttctaaacactaccttatgactccacattaggagaaacagatgagacagcctgaagttagtactaaggcaccagctcttgtcatacttttttctgcactgtgcacacgatcgtttacttaataaacataaattccaatcacaaatatttaagatagaactcccccagcaaaagtaacaccacaaacatggggagacctattttaatttttccttcactcttattcgaatctgattccataataatagtaaggattaatatttaatgagtagtcatatattccaaataccaaatgcatctttcctctaaatttcacagaaaccccaaaaggtaaggattattttcctcattgaaattaaattaaaatgtcaaatgaataagattaaattaattaaaaatacatttaagtgaaattatacatggcagagattcagagcacacaataacttgtctaaggccacagggcaagaaagggtgccctatctggcaggtattcagtaatgaaagcaagttttcaaactaggtgtgattactgcacaatctgcacttacactacactgcaccacctgccactaaaatggatcattctgcctcagagagatggaaagcatatatcactggtttcatatttaaaaactgtctcctcacccccaataaaaagagccctggttatttacctatcttttcaaccttttcctcttcgatatcttgctctgcttctgttgtacaacgatagcctttcttcttaagcaggtggcaaatgaggacgccaaagagacccatgataaagaacacagggacaagcgcgtatgcaatatattctgggtgtccattcccagtatcgttgctgggcgacggggtcgtctctgttctggagtgcaatgtgcggctgctcccattgtctacagaaagaaacatgcatgctgcattagatatctgtccagggcaagaaaaacctaatgactctcaggtaatgttcacagtaagtcagggtctgctcccgaaaccacaggccatgcagactggtgggtccagctgcacaggcaaaagatagcccaggtttgagctcaaacagtctgagtttaactctgctactcatgaaccaggtcccatgctgggtcattttttaaaacatcctttgaagacagcttcttcttcattgtggaatgagtatacagggttgtcgtgaagtgtccagcacagagtaaacacataaacattacatgtaacattacaaacacagaatgaacacataaacactacatgtaacattacaaatattacataaacactacattacattatagcacagttcttagtgattaagagcatggcctcagaacactcaagttcaattcccagctccaccatttagcagctgtgtgacaatggacaagaacttaacatcttgatgccttggtttcttatgaaatgggcatacaaatactacctactcacccttctaggattgttataaagatgaaataaattattacgtgtaaactagcaagcaacatagcaaatattcacccacatgccaggcaccattctaggcacttgtgatgcaggttcatcacactgagcaaaacaggcggagatttgttgtcctcatgcagcttacattctaggaggatttagtaaactagcagatctagagtatgaagaagagggaaaagtcagggatagcatcaagatcttggcctggggtgcaaacataaaaatggaagtgagtgcacttgtttatttgttcactaatcccaataaacattgaatgcatgccagttatgtgacaagcaccacactgggtgggaactggatagagtgatgaacaacgtaacgtagcccctgccatcttgaggctcgtatatgatggcatcagaaacagccattaaacaagtatacacgggcagatcgtgacagattgtgagaaatgctgtggaaggaaaacacggggcactagaagagaaaagaacagtggggatctactttatgacttcaagaatagggaagctttgaagtgggcatcttttggagaaaagggaagtttttgcctttagacatgtcaaagtatcacatgaatatatatatgagagacagtttgatatcttagcctgcaggggtgccacagggactccagaaagcagtgagcctggagcacacaattatacaatgtggccaactgagatcgcaggaagaacatactttgggaggctgaagggggtggggggagggggcgaatcacttgaggtcaggagttcaagaccagcctgggcaacatggtgaaaccccgtctccactaaaaatacaaaaattagctgggcattgtggtacacaactgtggtgccagctactggagaggcagaggtgagaggattgcttgagcctgcgaggcagaggttgcagtgagccaagaagtgcaccactgcacttcagcctgggtgacagagcaagactgtctcaaaaaaaaaaaaaaaaaaattaaattaaattaaaaagtattaaaaagttagccttatatatgttcctgtcacacagtaagcactataaatgtgttagctaccactattaatatttaggctgggcacagtggcacatgcctataatcccaacactttgggaggccaaggcaggcggatcacttgaggccaggagttcaggaagaacataccgtgtagcaaaagaatcagcagagcaccatgccatggaaaaatgaggagagaaatacaaaatgaagaggggagtcaggtagatgaggaccaaagaaaactgtggggtttgactgaaacaaagcttcagtatttggaatatcctgactctgaaaggataaagtgaggttttctacatcaagggaggttcacacacactgctcaagaaacccagaaattggaaagctagagacatttaaatataagctttctcaagagaattttggtgagaaaagaatccgtattgtaattgagagtggcaggaggcagtcaaatgcccaggcagacagggttgggtccctggtgaaaccccacctccatgctgaagaattttaaagcttgaaagccaagctacaagttaaatcctcggaccagatggaggacttgtcttcctgtttggtgcgctttcctcacaaaccaatcagcactcactccccattctgagtccataaaaggccccagacccagccacacaggaggaacttcaagtagaaccattcccccgagccccacattgcctctctgctgaaagccattttcatagctcaataaaattcttctccgccctcctcacccttcagtgtgtcgtgtatcctcattcttcttgggtgcgctacaagagcttgggaactgctgaaagtgggtacaagctataccacaggggagctgaagcacgccagcgtggccaagcagggcgtcgaggctggggcagagcgtcgccagccaggaggtccccagtttacaaagtgaccgagaagaaaactcctgcatcataatgattataatggggacaatatgcctggtatgaaatgagcacggttcatcacagcagcaaacaaacaatatcaaacagaagctttatttgcaaaccagaggccatagaacaaagactacctctctttcgcatggaaatatccattgtctttgaacatgaaaggaaataattggtttcttaggtttgtaagaggttgcattcattactttatcagacaacctccagaatttgaaatagccagtgttttctgatttctccctgaagaatcaatataataaatacatccctaaatatatgcaatataccgtctaagttagggtttaacctcatgccttattttcaggaaaaaccagaaacatttatttaatcccttttatggtcctaaaacaatgttttctttattaattcctttatataacacatattccacgcaacaagaataggtgaagtaggcagcatgctgagatcaaggagctttactcagaatcactgtctgtttcaatctgggggtgaaaataaattcttttttagggggacaatgggaaagagggatgaaagaggggctcagaattggagtcaaacacctccctctgaatcaggtgattgagaaggtgtcttcatcgtgaatttgacatgtggcaacccctaacaaacactaaatatctacagagctctgtgacttacaaacatgtgtcattcacttaatttcataattatcgtgccatgaaaaaactgaagatattaatctacattagtgaagcatataaattacagggagaggcaatatagcactcagattaaaagctcagacctggcagaaataacagacatgttattggccacatactagacatgtcaccttaggcgagtaattttaactgttctgtactctgtttcctctctgttaaaaggatcaaaatgagtgtgactaatctgtgataattttacaagatggccctgggaaataaaaatctaatctcagaccccaatttactatgccaaaaggaaaaaattaaactgaaagctgagtcattcaagaaattgcgtttccttttgttcttaggcagatagctactgataaaaggtgaagtatctgcacaggtagctactccatgctcaccttatcttaggtaaagtgctgactgactgacataattgactattaccctgcccgctccttttcccttgcaacaggtagattcagtaatgtgaacatctgctccctctttccccttgtattgaaacctcaatacaagtattgaaacctcaatacaagtattgaaacctcaatattcaatacaagtattgaaacctcaatattcaatacaagtattgaaacctcaatattcaatacaagtattgaatactcaatacaagtattgagtattgaaaccctcaaaatcttcttaggaaaatggcatgaaccacagattgttcctgtggatttgagatccttttctctggacatgtccttaacctttgcaaaataaacttctaaattgactgagacccgtctcagatactttttggtttccagcttcaaaattatttgatactgcttctactgagaggtgaggtctgtatctcgtccccttacatttacactctactctccctgacccacagaatgtgttgggaatgatgcattatcactttccagcctcaggcaataagaaactgacaacttccacttcctgtttcttggggcacttgctcttggaacccagccaccatgctgtgaggaagcctaagcttccctgtggagagaaaatagcaggcatcaacttatcagccagtaatagccataataaaagtagatcctatagtcccaactgatgctccatggggcatcagagctgtctctgatgaaccctgcccaaattgtataacaaatccttaaacaaaagaaatgattgttgttttcacccactaagctttggggttatttgtcatacagcaatagtaactggaagcctgctgcatggtgtcactgtgaagattaaacaatattaatatgtaaagcattcagaagagtgtctacaaaaaggtgggcactgtattttagtcataatcataaaagacctgcattattcagtaagatagccactagccacatgtagctatttaaattcaaatttaagccaaatgaatttaaataaaattaaaaattcagttcctcagttgcattagccacatctcaagtgcccagtggccatgtgtggctaactgctaccatactggacggcccagataatgaacatttccaccatcccagaaagtttttttggacagccctgttgtgcattataaagaatagctaacaagaaagatgcagagtggagaatatattgtgatctaccttaacaattcaatgaaaaatagcttttaaataacaaagtaactgttcatacataatgtctaaaacatttataaacttcagtaggtttagctttccttcaatttacactaataatttgctgagaaacactgtatcccttcttctccttcacccctagctgaatcatgtctgaatcacgaacaagttacttagtccaaatagcaaaggttgttgcattatttataaaagtcaaaaaatagcaacacctgcatatttgcaatgagatagtaaaaacatatctaaatcatggtttcatttgatgaaataatatgcactatttaaagatctatgaaattttttgtgaagatacaggaaaacactatgatccaatattgaatttcaaaagctggattcaaaaccttacatgcaatatgatccaactagtttttttaaaaaataaaaacgcatgaaggtataaagccaaaaccaaaatgctaagtgattctcggtactaaaataatgaaataaatttaattttatctttatacttttctataactttctaaaattagtatgtggtacttttgtaccaagatggtagacactttaaaaagtatgtagagcagaggctgttagtcatttgagagtcacaaacccctttgtgaggtctgatggatgctaggattcctatttcaaaattttgcctcccggttctgtgacttcttgaacccaaattaatgtaagggcaagtgatgtaataaaaatgacgtccaagtttctgcttgagcaacatagtggacattggacccattcattgtgatgggaaatatatatatatatatataaaaagcaagtttgcttggtgttatggtttgaattttgtcaccccctcctaaatttatatgttgagctcctaacccccaatacctcagaatgtatttggagataggatctttacataggtcatctagttaaaatgaagtcatcagggtggaccccagtcccatatgattggtgtccttctgaaaaggggaaatgtgaagaaaaaggcagagatctggatgatgcttcttctacaagctaagggacaccaaagattgccagcaaatcaccagaacccaggagagaggcatgaaacagattctctcatagccctcagaaggaggaaactttgctgacacattcctcttggacttctctgttgctgaaaccaccctgtctgtggtactttgtgaggcagctctagcaaacgaattcacttggcatcttgaggacaatgtcacagttcagttttgaacacgcagaaatagaggtaagcaggtgacatccagatggaaataggcattgagcaactggatctgctccactcagaagctgaggaagaacagccagagctccagtctaggacagaaaggaatgagtttccagaagaggtaagtggtcagctgggtcagatgctgtaagagagcacaactaaaatacgaaggaactgcaaaatggtgccgctgctatgctggatagtattaagccttctcgaaaggttaaaaatagaactaccatgtgatctagaaatcccacttctgggtacatatccaaaaaaagaattgaaatcaggatcttgaggagatacctgcactcccatgttgtctgcagcattagttacaacagccaagatgtggaagccaccaaaattcccatcgatagacaaagggataaagaaatcgtggcatatgaaaatggaatattattcagctttataaagaagaaaatcctgccaaatgtgacaacatgggtaaaccctgaggacattaggctaaatgaaataagccagacaccaaaggacaaatactatacaattctgtttatatatggtatctaaaatagtcaaactcatagaaaccagagagtagaatggtgtttgccaggggctgggagggcaggggaatagggatagttgatgatcaacaggcacaaaatataaattttcagttacacgagattaataagttctagagatctcacaatactgtattgtgcacttaaaaatttgttcagagagtagacctcatgttaagtgtttttaccataatttttaaaaacagagagaaggaaagaaacaaacaacctgctatagtttgaatatgatctgtcccctccaaaacacacgttgaaatttggtccccaatgtaacagtgttgagctgtagtgggacctttaagaagtgcttgggtcttggggactccacgctcataaaggagttaacgttgttctcacagaagtgagttagttctcatgggagggggttagttattgggagtttggattgttataaaagcgagttcagcttcctcggcactttcttgcttcctctctcaccatgtgatttcttccattttgtcactgatgtcatgaagcagcaagaggcccttaccagatatggctatccaatcttggacttcccatcctccagaactgtgagcaaaataaacctctattctttataaattacccagtcttaggtattctgttatagcaacagaaaacaaatgaagacacaacccaagagaaatctttagaaagaggcttgagaagaactcagataaatcaggccacacagaaattcctaagaacacatgggaaaccttcagtttctaatttaggagcagcttgggattttttaacctttcccttcttggattttgctccctgtttctctgtagtttcctgaagtaaacattctttaaaaattctaaagataaagtaaaataaaaaaggaaataaacaggcaaaaataaaatagaaagaaaaacaatccacagaagctctttggtggccttgctggagcagttttccaatgaaatggacggcaagatgcaagctggattccctgggttcaggaacagagacactgagctcattgtgctccttccagaagctccttctgagcaagcaaggagggtagggtagttcaccctcagggtgaagggaagaaatttttgtttggggtttattttttaagtggatgaaaccaaagtatttatatgtagaagggaaggagcaaaagggagagacagagcgggagtatgaagcaatggccttgagatgacttccatatgaaggaggggagttaaatatctgaatagaaaaggatacagtttttcctgaggccttcctttatagtgggtggaagaaagttgcgggaacaggtgcttctgttgccttttaacataaaaagcaaggcctggtgtggtggcttacacctgaaatcccaagattttgggagggcaaggtgagattacacattttgtgaaacctcatctctacaaaaaaatccccaaaaaataagatagctaggagtgcttgtgcacacctgtagtcccagctacttgggtggctgagatgggaggatcaaatgaggccaggaggtggaggctgcagtgggccatgattgtgccactctactgggagggtgggtcagcctgggggacacagcgagaccctgtcacacacacacatatacacacacactaaacataaaaagcaatggcaaaccagtgtaaaatgtacctgcagtcccaactactggggaagcttgggtaggaggattacttgagcccaggagttcaaagccagcctaaggaacagccagggaggaagcaatgacatctgttggtaactaggagggtgaggacagaagaggggacttcagcagacaggaggcttagcagagagactgaaggcaggtgtcagtgaaaataatgcacaatggcattcaggacacagctgagatgtgcaccccaaatctctaactgtatgagaccactcagggcatgccatgcaggctggaaaccaagcagaataacaaatcaggatcagaatggaaagcagacagagctagagtacgaaagagaacagtttagggtgagatggctccagaatcgatgatatctgattcacactagtttattacagcactatcaatactaacaacagccaccaccacaactatggagcatgtatgagccaacactaagctaagcattgaatcttcacagtaaacctataaaatggttaccagtgttatcctcacattacagatggggaaacagaagcatagaaaggtcaggcaatattcccaacatcaaggtcacgtggctaccaagtggcagtgcctggattcaaaccaggcagtgtggatcctgcatgctcaaacacactttatgttactctcagtgtctgcatacgtaaaacacgacttgtaagagagtgctgttcatctaccaatgcctaaagtacattttcattatttttctttcaacaatatttcatcatttagccacttttctgttaaaatgctaaatgatggcctattctttcctatttcacaacttggtttagaataaagcctccacagacttcaaaaccatggattccaattagcacagcaagaagtaggataagttttgaaaatgttcccaccagactccaaagcagttttaccagataaacaacaaaaaactctactatttgcccttatcaccaatcaatctccctcccaactcccaaatcacagctcgccttatgcaggtcataacctgggatccctacagccttgctggctcttcaaaaacaagcccatcacttcattttgagagtcttttgcacacagcaagagccactgaaataggcagagcttggctctagctggtaagtgtgattctcttccacagcaccacaaataaaaaatgtccaacacaaaggccagtgtttgtcaaaattctttgggtttttcctgggcccagtaagctttggtaaatttgctgtattctgaggacccactaggtatgtgtgttttgccaagatcctgctgagattacaaaagaaaacgtgagatgaaaaagatcaaagacagcagggaactgaggaggaggcatgaagcatggctggaagtcaacctaaaaagtcaaaagcaattttctagcttgtttccaagtaatacttgtatttccaactgaccccaatggtcagaggagccgagacagaatggcggggaaatggcatttctcacacccagtgggcatggcttgagggttgctaacattttttggtctagattaccaagatggctaaatgtctaaatgttcatttctcaaaaggggtttttcttcatccacctttgccaccagctacctctgtgatactgaacaagtcacttcacctccctgggcctcagtttcctcatctgaaaaattagaagcaggagctgatgtccttcatggttctcagaattccactattccccaaccttctgcagcctcattcactctgggctgacactgctggagatgaagacacgagcccatcctccatgtccacaaggccaaatccaaacagctctcaaatccaaccacagactacagacaaggcagccgtcctaatctctcccaagcactttgtgctgaccaagatcaagatcaagaatggctctgatagcaattcttcctctccttaccaggaaagggtgcgcattctcagaagctagggtttcctggcaaactgaaccaacaaactcttgatgggaaaggaacttggctgataagtggataacccacatcaaggttagctggaaaatagtttttaagcacacacacacacccatttttatttatttatttatttatttttaagctaacattcaaatcacagtatctgagaagggtctattttttggtctagattaccaagatggctaaatgtctaaatgttcatttctctaaaggggtttttcttcatccaccatttccaccagctacctgtgtgatactgaacaaatcacttcacctccctgggcctcagtttcctcatctaaaaaattacaagcaggagctgatgttcttcatgattctcaaaattccactattccccaaccttctgcagcctcatccacaattcactctgggctgacactgctggagatgaagacacaagcccatcttccatgtccacaaggccaaatcccaacagctctcaaatccaattttttcataactcctttgacagcaacatcaaatctgacaaattcatctggtagcaaaccctgcactgacctgatgtgtggctatttacacacactctcctagtaaggagaggaagaattgctatcagagccattcttaatcttgattttggtcagcacaaagctcgggggaagtcacatcatttagagtttagactaccagtcccaagggtttccgactgtcacaactctaagagtaaggagattggtcagggtactgcacttgctcaaggtcacatggttaaaaactgttaagaggccgggcgcggtggctcacgcctgtaatcccagcactttgggaggccaaggcgggcagatcacaaggtcaggagatcaagaccatcctggctaacacggtgaaaccccgtctctactaaaaatataacagattagccaggcatggtggcgggcgcctgttgtcccagctactcgggaggctgaggcaggagaacagcgtgaacccgggaggcggagcttgcagtgagccgagactgtgccactgcactccagcctgggtgacagagtgagactctgtctcaaaaaaaaaaaacaaaaaacaaaaaaccacaaacaaacaaacaaaaactggtaagaacctgggacaaaaatcttgtttcaggacagaatctgtaactagtccacctagttatacctactaggtgtactagtccacctagtagcctctcagtcctactttggtagagctaggacctattatctagtcagtagctaacagcttactactagtgcaaaacaacctgttttaagttaattctgtttgtttgtttgtttgtttgtttgttttttgagacagagtcactctgtcacctacgccagagtgcagtagcacaatctcagctcactgcaacctctgcctcccaggttgaagcaattctcctgcctcagcctccagagtatctgggattacaggcgcacgctgccacacctggctaattttttgtattttagtagagacggagtttcaccatgttgcccaggctggtctcaaattcctgagctcaggcaatccacccaccttggcctttcaaagtgctaggattacaggcgtgagccaccgcacctagccaagttaattctttaaatacagtttaaatcaattgcccacaataataaaagaagagaaaccaaagcaaattctacaaaataaaatcatccccaaattattcctatttggttacagagataactaaagtcacagtctctaagaccatctacccacagtggcaatcataaagacacagcatttgcccaagctcaagaatatgttgtagagagaacaaatgggcttaaacagaattggagaacactgtaagtcagtatataaataagtgctgaactctgtagtgaaacttgaggcagctaccagcttccagacaattcctagacaaacagctgctacaaccccacctttccccgaaaaggcagctatgactgggcagggaggggacacccagatggcacccacctgccaaagtccacccacccatgaaacaaaaccccacccaacgccagctgcatacagtccctcaattacttttattttgttaaaattcctgaaatgctaccatgagtcatgagccctggagtctgattctgggttgcaaagaccactctgggaacagatggaagctcagacaacttccccaataaaacgtgcagaagtcagcaaagcctagctataaatccttattttcagatgcatttggctaatggatgccttgaaaaattatcattactaatgataattatcatttttaatgggaaaatgcatttcaacttacaatctacttactcaaaagtagtatttggggcataacctatccttaagctggggctttcttcttaaataccacatagattgagaagggaagtaacaaagatgatccagaaagaaaaaggactttatgctgagcctcaacagaataactgaatttggctggacaaaaagggaacaggacactcttgacaggcaggaggctggggcactcagagcattcctgaaccccgggttgctaccagaacaaaggactgaaacttgagtgatgtcaatataaagaaacatcttaaaaaaaaaaaaaaagatgaaatctaaatattaccatccctggcttcaatttgaactgaagagagaaaaataactttgcagagtcagataaagtccctagcctactccacactgtctcgggtttaccatttgaagttatttcttaaagccacagaactccaacacagatgacagctacagccacccccatccccccatcttcccccacctcccacctcgcccaaagctccgtcttgggaggaaattaactctaggatcccggtgtcttgagaggccaaggacctcaacttctggactcttccagagtatctcaaacaatggtttgcattcaggatacaacagaaggctcatctgacctggcctcaccccagactggagcaaggtcagcttgccagttatttgctttgggatacaggccaggaagccaccaactgtgcctctaagacagaagactgaggagattcccacagaccctcactgatggctgcacacatcagtggggtcctcagagaggggcgtgaggaaaagcaatacccgtggggctcaaggactgggagggctccctgctgactctctccccatcttcttttcctgttctccagcccctccctccctctttcgctgcccctcctccttttgctatttttggtgctgtccatttggggacttttccaaagtctttatttactgatagcaccgtctgtctcctgggaaggggctgggtggctgcacaacaggaatggagagagcctctgactaatggctcttgcgaacctttaaaattacacattatgtccactcaagaaagaaatggaattctgaagaagtcatttgtttgaagtgaccttaaagcaacagggcttcagaaatctaatatttgcttcagattatttctgaaaggtggtacgtcataaagaatgagttgctactttaattgtcaatcgcagcattcacacggggtgttagtggtgtcaggcagtgttctggatgcttcctgggcaatctcattcttccctcgcagcatctgtaaggaagcatctctcattacccccattcgcagatgaggaaaatgaggcacacgggttcaataacaagcctcggtgtgtaggaggacaggatccaacccagacaatggaatcccggggcccacactcttagccatgttgcttaacagtgtctgtaagtggcggtggccttgggttttatctagtgacacatgcatttaggtggctttgttaaactgtcaccaatgaaccacacagctgggctgcatacaggtcaacattcacccacccaaggcccttaaacactaagaagctgcctctctccaatgaccctatgatatacgattaacactggaacttgcacatatcttcttctggtgtaaaaatcatcttcataaaaaaaagactgaagtcagctgtaggtgaatgaaatttgtagtggcttcattttttaaaaaccttcatagcacaaaatttcccaatattaattttaactgcaaaaaacaaaagatcgaccgggcgcagtggctcatgcctgtaatcccagcactttgggaggccgaggcaggtggatcacaaggtcaagagatcaagaccatcctggccaacatggtgaaaccccgtctctactaaaaatacaaaaattagctgggcatggtggcacgtgcctgtagtcccagctgcttgggaggctggggcaggagaattgcttgaacccgggttgaacctgggaggcagggcttgcagtgagctgagatcccatcactgtgacagagtgagactccatctcaaaaaaaaaaaaaaatcactcatgtataactacttcatctccctctataactatcataaaggtaaaagtaaaagacctttctctagctattgaaaagcaccttattcacagatgcatgtgttcacattattgctcaaaaactgttattcagtggttgccacaaacataatttgtactagcaatgttaattacatggcatctaaaaatctttcagaaaaaatatttaaaaagaaaggagaggaataaagaaaattttcaatcatacacatgagatagggacacacagtacaagatataaaagttcccacccaaataacacacttttcaatgcactttcacattcattcttttatttgaaatccctaatcccaagaagttaggtaatatcatcattctgtaaataaatcagtggcctacatgatatcactgggtcgaggcagagaaatgagccaagcagaagaaccaaagcttaggaggacattttccccacccacctcactacaacagcgcaccactcagacataccacggtcaaaggcaggaatcccagcaggacacagaactcgccggaaaaccctgactgaagtcaaacacctctttccctaagtggaggtggggaagtgaaggtttgtacctctaatccctaacacagttcctgcaacacagtaggagtgcctgaaacatctgctgcagcaatgttatatgtgaaagcaaattctctcattgcagaagggctcctgggtaatcaatcaagtccccaagttcacagtaactttataagcagttttgttaagatcctatttggtagaacagaatatccagtgtacttacaccccatttgccaaatgccaacagtttttacaaacataaataagtagattcttttcagagctggacaactgatacaccccactgcttcacccccttgttgggtaagtcctttctgaaggatgtaaatataccagcatgctcctgggttcatcgaaatcaacagaagtttctagtttgcaaagatccaaaagaaaggctataaatagcagcacattcctaaacccagcttggggaactagctctcaactggattttcacaggactccaattcatccccaactgccagatccataaggggacgctaaatccgagcttacacaacctcaccaaaggctactgcccaatttccacgtggctgcgagtcctaacagaactgttcatgtatattccttgcaagaggccaaccaagaactaggttagaaattatttaaactatgggaggaagtctaagtagcaagggccagaaaaaaaccatcaaataggaggaaacacgccatctcagcctgtctccagtagcaacgggaagaaatggggtcaaaggggtgctcctttaggaaatcagtgaattccctgaagcttacagagagctggtgcaggaaaccagtccttggggagctagatccctggtttctgggcacaactggcacctgtcagggttagaagtccagccaagtcatttctaccctgcagaataggacataaactaatcacatggggaaaaaatgggtggtgctgagctggctggagggaagcaagggcgtcagaaaggaagactggcccagcacccgaccaggcagagggagaaagagagatggtgactgatgcccctgtggagtgttgggggtttatgatttccagatccagggcctctaggatgctcaactactttaccaccaactgctaacagccactaacctttactggaatttttacttacattatcatttcttatctctacaactctgagataggtgttaatattaaacccatcttagaaatggagatgatcaagaacaaagtattgaagctgaagtcactcatctgggaaatggctgggccaacatttgaaccaaggtctgttgcacgcagggccaactctgaagcaagactactccctatgaagcatggaagcaaaagcagaaactggcttttttcttggctgcactgtgttcaatttgtttcctagctgtgaagccccaggcaaggtcaattagcatctctgtgcctcagtttcctcatccataaaataataatagtttctaagccttatatgagattactagggtttatccaagttaagacttgataaatgctagccattattgctgtgattattattatctgtggtaataagagcaaagcagttgctatcctcaccaagctcacagctcagctggggatataaaatcaaacatccagaaaaggacaaggaatcacatgagctgggctggaaggggcagtgttaaatgtggggtgcagaaaagataagccctgggggtgagtgagcagcgaccacacagcactgctcaggtggtaccacaaggccaggcaggcacccacatccccacatgcaagccagtgtttctcttccttccaggaacaggaagcagataatgactaaacagagaactacaaaagtcctaaacgaagggttttccaattagtcacaggttaggtcgggcaatgttcctgcaagacaggcacgtgggctggcttctgagaacataggaactggaaaaggaaggtgagtaaatgttgagctccaaggatctgtcccggctgaagtcccctggtgtgaagtccccgctactgctgttagagaaagggcaaagtaaaggagggagtaggaaagaaaataaaggtcacttcagaaaaggcaaacgaaggaaagattgaacagaagtaaccaggaaaaccctagacgtagggaagtcaatgttaaagaagagaaatgaatgtcactagcatgaaacccaaacaagaactctgaaaaccagtagcaaccagtgagacacacagaaaaaaatactattaataatagtcacatattgatgtataatgtgtacagttactatttcaagcatttttcagatattaactcatttcatccttacaataactctatggggtagcttctattatttccagccccatttaaagatgtaaaactacagaacagagaggttaagtaacctatgccaggtcacacaggtagcaagtatcaaaggtgactttaatccaggcagcctggctccagaactccacactctgctccattactgctgaaatgtgagggctcacagtttcaacattcagtaaaagtccatggaatgggattctccatagctcatctctattatagatactacagggttcacgtagtagagttagagaaggtagaaaacctacagataatcattatccctgtaacacagcaataaatctacaatgacagaatggcatttcctagtgagtcagttattaggaagagaaggtacatttaaaagttacgttctttccaagtcaatttatctttttttttaaccaagtgctaattgttaaaaagtaattctgctgccatttgtaagatacaaaattaaaatgctaccctgatctacatataacactgatgaaacagttggttacttctcagaaatcctaaacttcctttgcactcttaaaacaatagaaacactttgtatgaagggatcagatttgtcatcacccactttgtccaaaatgatctcaattgtgaatgaaaaatgttaagtgaaaaaaaaacacatacaaagcagtatttagagcttaaatggtcccagtttttataagaaaaaaaaagacatcaaaatgttatcaaagtggtaagattataagtcattttttttctttagtgttttgtgtcttagcattccccacatttccttttattttaattattcacagtaaaatcacaaaatgtttttcaaaaaagggaggaggtatgcacagaaaaaaaggaaccccctccccctccccctccccctctccctctcccctctttccacggtctccctctgataccgagccgaagctggactgtactgctgccatgtcggctcactgcaacctccctgcctgattctcctgcctcagcctgccgagtgcctgcgattgtaggcccgcgccgccacgcctgactggttttcgtattttttgggtggagacggggtttcgctgtgttggccaggctggtctccagctcctaaccgcgagtgatccgccagcctcggcctcccgaggtgccgggattgcagacggagtctccttcactcagtgctcaatggtgcccaggctggagtgcagtggcgtgatctcggctcgctacaacatccacctcccagcagcctgccttggcctcccaaagtggcgagattgcagcctctgcccggccgccaccccgtctgggaagtgaggagcgtctctgcctggccgcccatcgtctgggatgtgaggagcccctctgcctggctgcccagtctggaaagtgaggagcatctctgcccggccgccatcccatctaggaagtgaggagcgcctcttcccggccgccaccccatctaggaagtgaggagcgtctctccccggccgcccatcgtctgagatgtggggagcgcctctgccctgtcgcctcgtccgggatgtgaggagcgtctctgcccggccgccccgtctgagaagtgaggagaccctctgcctggcaaccgccctgtctgagaggtgaggagcccctctgcccggccagccgccccatccaggagagaggtgggggggtcagccccccgcctggccagccgccccgtccgggagggaggtgggggggtcagccccccgcctggccagccgccccgtctgggaggtgaggggcgcctctgcccggccgcccctactgggaagtgaggagcccctctgcccggccagccgccccgtccgggagggaggtgggggggggggtcagccccctgcctggccagccgccccgtccgggagggaggtgggggtcagccccccgcccggccagccgccccatccgggaggtgaggggagcctctgcccggccgcctctactgggaagtgaggagcccctctgcctggccagccgctccctccgggagggaggtgggggggtcagtccccggcccggccagccgccccgtccgggagggaggtgggggggtcagccccccacccggccagccaccccgtccgggaggtgaggggcgcctctgcccggccacccctactgggaagtgaggagcccctctgcccggccaccaccctgtctgggaggtgtacccaacagctcattgagaacgggccatgatgacaatggcagttttgtggaatagaaaggggggaaaggtggggaaaagatggagaaatcggatggttgccgtgtctgtgtagaaagaggtagacatgggagacttttcattttgttctgtacgaagaaaaattcttctaccttgggatcctgttgatctgtgaccttacccccaacccaaccctgtgctctctgcaacatgtgctgtgtccactcagggttaaatggattaagggcggtgcaagatgtgctttgttaaacagacgcttgaaggcagcatgctcgttaagagtcatcaccactccctaatctcaagtacccagggacacaaacaatgcggaaggccgcagggtcctctgcctaggaaaaccagagacctttgttcacttgtttatctgctgaccttccctccactattgtcctgtgaccctgccaaatccccctctgcgagaaacacccaagaatgatcaataaaaaaataaataaataaatataaaaaaaaaaaaaagaaagaaaaaaaggaacctgttaaaaaaaatacctcccaagtataattaacatttatgttttcttgctggaactctggggcatttttttctctttttctactttttgcagtttctaaaatgtcctgatcataatcgatagtttttttttttaactgtaagtaacagtcaatgaggagccatcattactataaggttgaaccatatgaaattgtcactgtagtgtcagagtaatattaatagtgtagacagcggtaaaccaggatactggaaatcccttagtaaagagactactaaacctacaatccatcatattgacattttagatgtttccattggttggaggcagagacagtgctatgaaatctttggtgaaaaccacaggaaacaagagtcaaagaaaaccatatagtagtataacttctactttattacactataaaacacaatgtaaacacataaatagtaaagaacagcctgataattttttttctttcccactaaatctttttttttttttgagatggagtctcactctgtggcccaggctggagtgcagtggtgtgatctctgctcactgcaacctctgccttccaggttcaagtgattctcctgtctcagcctcccaagtagctgggactacaggcacgtgccaccatgcccagctgattttttgtatttttttagtagagacagggtttcaccatgttggccaagatgatctctatctcctgacctcgtgatctgcccgccttgacctcccaaagtgctgggataataggcatgagccaccgcacccggccgccccactaaatcttttaaaaacacttttgagcctttatcttctaaatagtaaactatgcaatttcagagagattattccagccccaacgttttcatattatgagttggtttttcccaataggaaagacttgtctgttccatttttcctaaacccagttctccaacaccaaccgggtgtcccacaattcaattaaattctgataccacctagcatttagtgcagactccacaggttaaatactcaatcccacaagactgaccccacttcagatgccagccgcaaatggggtccccaggctaactgcacttctgcctagggactacaaattgggggctttccatgacccccctcaataagtttggcattttgctagaattatcagaggcgtttgaaccagaataactccatcttgaataatggctgggtaaaatgaggctgagacctactgagttgcattccaggaggttaggcattctaagtcacaggatgagataggagatcagcataagatacaagtcacaaagaccttgctgataaaagggtgtggtaaagaagccagtgaaagtccaccaaaatcaagactcaatgaaagtgacctctggttatccttactgctcattatatgctaactataatacattggcatgctaagaaacactcccaccagcaccatgacagtttacagatgccatggcaatgttgggaagttacctatatggtctaaaaaaagtaggaagcctcagttctgagaattgctcaccctcttcctggaaaactcacgaataatccaccccttgttcggcgtataatcaagaagtaaccataaaaatagccaaccagcagccccgagggctgctgtggaatagcctgtggaatagccattctttattcctttactttccaataaccttgatttcactttactctacggatttgcccggaagtcttccttgcacgaggtccaagaaccctcttctggggtcaagatcgggactcttttgggcaacaatgactcacagaattcagaaaatccctacacttatgattacagttttattatgaagcatacaactcagatacagccaaatggtagagattcatagggcaaggtatggttggggagcaggcacgaaaacagaacttccaagccccctccaggcacaccatcctcccaacacatccatatgtcaccaacccagaagctcctagcctccttgctgcagttttaaccaagtttttatcacacaggtttgactgataaaatcactggctgttgttgagtgaacccaatctccagcccctttcccttcccagagatcagggattgcagctaaaagttctaaccctgtaatcacatggttggttcctccggcaactagtccccatcccgtagctacctgggggcccaccaagagtccaaggatcacattagcacaaactcaggtatggtctaaaggagctcattatgagtaacaaaaaatgttcctatcactcaagaaatcccaagggttatttttaggagtcccaggaatcagggacaagatcaaatatatcatttgtattacaccacattgactcaaagtcaagagtctttactcactaatatatcaagatgcagcactgaaccagtgtagaaaagatcaaccttctcaatcacaggtttgtggcggcaacagatcaactaccatatggttcatgcaaaagaattctctttccctccttcaagtcttctccatccctatccctcccacccacccaggaactaagatccaccagatctacttagtttgtgtaactactgtttccataatatgtaggcattggatgtatactgaattactttgaagctggttagttttccttcccccaaatctatttcatcacatcataagaaattaagggactgagaaaactcaccagaagtgacagagatggagcccttagccaagcaggatttacaaatcatcccaatgctgatatgcatggtttatttagagattgccttaacactgacagtcctccagactgggaaggagaagtaaacaaggacaagacccacagtagggccaaaaaatgaaaatataccaacatacttccaaaatataaatgtttaatggttgagaattcaatagtctggaccatgtgtggtggctcatgcctgtaatcaagaattcaatagacaagctgatttgtataatttgaaggtatttactctaacttaagaaaaatacataattagcgagctttaaccattaatgaacactccttggctttcacaccaccaagccatcaagactatatactttttttttctttttttttttttttttttttgagacagggtttcactctgtagcccaggctggagtgcagtggcactatcacagctcactgcagccttgcacctctgggcttaagtgatcctcctgcctcaacctcctgagtagctgggatgaaaggcacatgccaccatgcccagctaatttttgtcctatttttgtagagacggggtcttgctatggttttcgggctggtcctgaactcctggcctcaagcgatcctcctgcctcagcatcccaaagtgctgagattacaggcgtgagccaccacactaggccaaaactatatacttagcacttacttcatgattctcatttctcagcactccttaaactttgaaaaattgtttctatctgcatatcatatggattgcattaaatctattctgctgcatagatcctatttgtgttacttacaaaggactgtattatgtttgatggctcaccctctgcctccctaccacctacacttctgcagataaggaaatgggaatggcaatctgaactgccctgctgacagcacagggccctgtctcctttcggctcagcctctggggctcttctatcacatggaaatgcatgggggcctcttgttgtcccctatcctccgcaactacacagtaaagtgcagtttcaggggctctgtcgcctaacctcagtctcccctctgcagcctcatctcacatgacttccactgaggagtctctgccacacccagtctgcattaacttctctattcccacctccatgcctttgcacacaggctgtttcctttgctcagcacaccattccatacactcccttttaaggtccactgaaaatgccaagtttcaggctatgaatgaagtcttttccatcgcccttatcagaaggaaagtctccctccctttgatcccacacagcactttgtctgtagttctctgattacaccaaacacattctctactatactatagtgatttgtattcatagcttatctcccccttctcaatcacaagtttgtggagaacaaaaaagaagtttgttattcattttacatacctacatagcacctgacgatatctcaaataagagaaacctcatttttaaattaactgcacactgtaaagaatgatctacaagttttacctgcaatgactattaaaaagggctgagttgacaatcacgactgtgaaatgagtttcaccttcaaaacccagcttcttggctctatcacatagctttaaacaatatccaatgcttccctttttcttttggtggttgttctgtgttttgcctttagaaggaggatggaaagaactgaggaagcagtaaaagcattcaggccgtacgagcatatagaaaaaacttgcaaagaaaaatgaagaaacgcctgctcattagccatctgccacttcaccaatgccaggaaattccgggcagctgttttttataaagtggataattcacataattgtgttggggacttccagctatgaagaactgttagaacatttgaaaattagtgttcccaagttgtactgtgatacaaaagcccagtgaattcttcaaacttccacctcttacaggaatctgagaaaaccagataatgtttacatctacgcatggggaaggaaggcttggcagattattggtatcgaaaggaattctttttagttagtttttaaccctacctgtcttgtgaatgtgctatgtacaggctctttgtaagtcttcaaccatgcagcaaaatccatctagccactcaaagattggtaatagcataattgtctaatgtgtgtcttttcaggaaattgaaattgatatgttgtatctccctcatgccaaaattttataaaaatcatttctaagcctaatgacatgtaaactgaattaccccctccaaatatttactctaaaagcaagtggacaatttctgtagaattcctaagataatcatctcctgctaaaaacaaaatctacattcaatttataagatgcctttgtattctctttaagaagatgaacctatagtgaaaaagctcaaaaacaaattaaatataaaactttccttctactagtggtgctgggcaccgaatacctgcaatttcacataatgcaaagcacatttgagaacaatgaacacacacctcacgttgacttcccctcctctgacttgagcaagaaattccccttctcttcatcttggttattccctgtaagtctcagtttccacatctccacagaacagagaataacatgcaacctgctccacacagtggttgcaagaattaaatttgatcaggcaatcaaatattttgtacacatttcatatgctcagctgcctcaagaagctctagttagacaaaacaaacatggtggaaacaattgcatgtaactgagggctaaataacatggaaaagatgcaacatgtatccatagacttgtggacagtgtattcacaggaggcaataaaggcagtgagaatacctaggaaatgtttcctggaaatgctatccttgatctcagcttgaaggatggtcagaggacaggatacatacagccccaagaagaggagaggggattccatctactcttatctctttcactcccctgctcacagttgatacttagccagcatcacctggaaacatgagagttgaaaagcaaatctccagacccatcccagtcctatggactcagcactctcaggtggggctcagagatctgttttaaccagccttccagctggacttctgaacactcaagtttgggaaccactgctgttgctttgcttgatcttacctcctctcttcggtgaccacaagttctttccacctgaccaactcctgcagtttttgcagctgtaaatttcactttcatttcctccagagagcatgcccaacctgcactggagtctagtttgtccatgcatgtcccaaccccagccctaggttaggtattttggccctgtgtcatactttccttgacaaggtactcagggcatgtcattttgcttgtttaattgccttcctgataacctactagctccataaaggcaggtactgagtctattttgttcacatcacttcattctcagagccttgcacactgtaaggtactttgttaatacctgttggataaataagtaaatcaaagaagccacgaaacaattggttttgaatagtataaagtactataaaatcaggaatatgatacatatacaattaacagatgcatttgaagtaccggttgtagaaacacagctgagtttagtttgtctttgagaagagtttcatgaagagatttgggtttcgaaaatctctgcactgaaaatgctaccaatgtcacaccatatcacctgataaggtagtattgattgtttgttattatcattcttggcagtattgcttgtttgtcattatcattcatttttcctccatgaccagatttttctgcctttggagcaatttggcccacagaggctggcagacaaaacagcctctcaccagtgcaagagaagggctgtggggaggcttacatctaagatttgtgggtgaatattggaaacagtaactcttcactttattataaagaaaaagctttggaccaagagtcctaacacctgaattctaactctggcttccttccttccctcatttaaatatttaaatatttactctattccgggccctgtgcttggatctgagcctacaatggcgaacaagacatacacgtagtccctccctcaccaaacctaaaggtctgctcatctgctatgggctacagccactcctgactcctacaggacaccgaacctttctgggctagtttccccatctgcaaagagagggtgttaattacaagatgaccatcaaagtcccttctgaatctaaaatatgactaagaataacacaattactcccatgagtcagttagccaaagttcttcctagtcctcctcatcctacatccaaggagctgagaaaccaggcccttgagcatgaggatcaagggcatatgtagatcaaggaaacctgccataggcagcaaggctggatccacttccatagacagtctaacagaatgggaagagtcccagaatgaggaaagacactcacttaagtcctggctgtgccagctcagtttctgcatctgctaaataaaagcttggaggacacagtcaaggtctcttccagccctaatactacaggactctgcttcctcctcctaagagtctcattcattgaaacactcatcaaagagccacgagaagatgaacaataagcactcagaccctggataatcacaaagcatgtcatcatcaaatctacatcaaatactaaagaaaaactgtcacaattttgtgactacacctatagatcagctatctaagaataaaccaattggtgaatcttccaaagttcttccagaagaaaatgtcatgctctaccctacacattaggccattcttgcactgctataaagaaatacctgaggctgggcacggtggctcacgcctgtaatcccaacactatgagagcccaaggcaggtggatcacctgaggtcaggagttccagaccagcctagccaacatggtgaaacccagtctctacttaaaaatacaaaaattagccgggcatggtggcaggtgcctgtaatcccagctactcaggaggctgaggcagaagaatcacttgaacccaggaggcagaggttgcagtgagccgagatcacaccattgcactccagcagcctgagcaacagaacaagaccttgtccccccaaaaaagaaatacctgagactgagtaatttattttttaaaaaaagaggtttaattggctcacagttctgcaggctgtataggaagcatagtggcatctgcttctggggaggcctcagaagcttccagtcatggcagaaggcaacagaggagcaggcacatcacatggcggaagcaggagcaagagagagttgggggggaggtaccacacacttttaaacaaacagatctcttgtgaactcactcactatcgtgagggcagcacttctcatgatgatgctaaatcattcatgagaaatctacccccatgatccaatcaccttccaccaggccccacctctaatactggggattaccattcaacatgaaatttgggcagggacaaatatacagactatatcaccttataaaggtaatgctttccttccttctttgcttagttttggtggctaatggctctgccccacaaatcccctgcctcccaagagaactctgccaagcccatcagaccctactccttcgggcactgcccaacatcccctcctcaaagccccctctgccctttacacaaccagcacccagggctcaggagcaacaggtgacaggaaacccctcaagtaatggcagaggcccaaaaaggaaaattctggagtggttaggaactttgtctcattctttagctgtgataggttagtatctggtttagcctaggcaataataataatacactttttcatcacttactgtgtgccaagcactcactagttttatcttacataactgacacaacaatgctatgaggcagctcagccatattctctctataataccgataaggaaagtaatttaaagattttttttctctctgtacaacaggcacttttattagtggctggaatgcagttatccacaagagtgcacaaacaaaatgggagaggaggatcaggtagggctggcagctggcaagggaaatgggagatacctggctggcgggttctctctgtttgagatcctgggacagtgctatcaagtaaagagaagaagccgggggccttggggtattgcaggtgggaatggaaaaccaggtcctctgagttcaacaggtttggcaaaaggatccccaaggtaagatgtccggcccctctacccatccatcctccagaaaatcccttgggtagattcagtttctcttacaaagagaactgtgttagtaactggcaaaagaaagcagaggagaaatttggcccaaactctccatctagccgacaagtttccattctaattggcacccattcataaagtcacttggaataaacaaaatcttagttttttgggggtacccttattttcttagatttcacactagagtaccaaagttgtacttctttttctgaagtgtcactcatttgaggacttattttccccattggaaattttgctactttgagcagttttatatttgcctcctaacagacacaaataaatgagtcacagaagcgaaaatgcaggaccataatcccttatctgaaaacctggaagtcagatgtgcttcaaagttcaaaccttgtgattttaggaaggtaatgcaatgcatttagcgcacaacctgtaacactcaaatcaaattcattaatattattcagcagaacatgcaaatagtcaagatagaataatatataccatagaaccacacattaggctgggtgtggtggtgcatccctataatcccagcactttgggaggccgaggtgggtggatcacatgaggtcaagagttccagatcagcctggccaatatggtgaaaccccatctctactaaaaatacaaaaattagctgggcgtggtgcatgcctgtaatcccagctactcgggaggctgaggcaggagaatctcttgaacccgggaggcggagcttgcagtgacccgagatcacaccactgcactccagcctgggagacagagagagactccatctcaaaaaaaaaattaaaaacctcacattagttcaagttaagttttacaacctacagagggtatcaaaagcctacaagaaaaacttgttttcagagctttttacatttcagaattatccataaaggattacacacttgcaaatggctcaaaaactagaagaaaacaaaatcaacctgatagttaccaaccatgtacaaattaaaacaatcaaggtaccaatttttgcctaacaaattagcgaatatgtttttcagagaaaataacaagaatatgaaattgagtctttttggctattgctgtgagaatgtaacctgggatgaccttcagatcaacactgatgtcatcaattgcctcaaaaatgtgaacatctttgaccctcaaagtgccttttcaggaacccattttctgtggaagtcctctgatatttaggcaaagtttcatgcacagaggcattcattgaaatgagttttaaaactcacttaaaaataatgagcaactgaaatctcccaaatagatacatagaagtaaaatacagtgaatccatatagtggaacagtaggcagcccttttttgggtgtatagggaaatagagaaacatttctgtgtaacataaactgaaaaagtcatgatacaaagttatattgcattatgaacctatccgagttaaaaatgcaattaaagaacctatgcgagttaagaacgcaattacaggctcatgcctgtaatcccagcactttgggaggccgaggcgggcggatcatgaggtcagaagatcgagaccatcctggctaacacggtgaaacactgtctctactaaaaatataaaaacaaaattagccaagcatggtggtgggcgcctgtagtcccagctacttgggaggctgaggcgggagaatggcatgaaccctggaggcggagcttgcagtgagctgagatcgcgccgctgcactccagcctgggtgacagagcaacactccatctcaaaaaaaaaaaaaaaaaaaaaatgcaattagagaagaccagaatgaaatatgctaacaatggctagtgccttggagtaatggaatcaagggtgattctcgctccttcctcccacaaactttagatctttggggaaattttccaaaaatacctagtgcactgtattttagctaaagggaaatgagaaaagatggcttggctacttaactcctatgcaacagtagcaaactctaatctgaggtgtcactctgggctttttaaaaatccctatcattgcaaagctatcaccacctccagaataaaaactgtttaatatatgtggtccacatttatttgacagtttaaatgacgtaatataaatcaagcctaatgcgcactctggagaaaaaatactatattttttaaagatacacaggataaaagatatatgccactttgccatttacccagaactttcagagacaagagctcagtaagacagagcagccagtaggacagagagacaggtgttggcacaatgcccattttacaggtgaggaaatggaggtggacagaaccatatgctgcaggcatcagggtctccttctgttttttttttttttttttttttttttttgagacggagtcttgctctgtcacccaggctggagtgcagtggcacgatctcagctcactgcaacctccgcttcccaggttcgagtgattctcctgcctcagcctccccagtagctgggactacaggcatgtgccaccacatccaactaatttttgtatttctagtagagacggggtttcaccatattggccaggctggtcttgaactcctgacctcgtgatctgcccgccttggcctcccaaagtgctgcgattacaggcgtgagccactgcacccggcttccttctgatttttgacttcaagtccaaggccctgacttaaggcttggtgctctttccaccatagcatcccatgaccttgttacttactgattctttacaaatatgttagaataaaaagaattttcttactcaaaaaaatagtttagtaataataagcatggacttcaaaatcaaacagatctgactcaatggactccatgacaaaatccagcttacacatgagtgactttttcaacttctctgaggctcaatttcctcatctacaaacacaggaataaaattatgtatataactgacaggaaattaattgtaagaatgaaatgatctaggtatttagactaccgcctgcacacaaaccaggtaataataaaaattgaattcctttttcctaaaagagtaaagtgtctacagtgtactaacaccaaattctgattttagtttttataaatcacaccagaattattaatatacccgctttcagcagcacaccaaatctttacaaccacttaagtgtccgaaattattaggaaccactcaacctaatagtttataccaatgacaatttaatttattctttttgtcagctttaaatcatttctctattgtttcaataagtcattaaacttcaacattagggccaaagaatcatttttaaagaaacaataaaatctgttgtttgttcacttggggctttggtctctcacattcaaattcaactcttcaaatttccaaatagattcatttcatttccatttttagagggggtaggggcagggaattgacagagacttctcacatttttcatttccttttaaaattaaatgtagatatggactcccaagctccaaggtgtgctttttcaaaactttccaaacactatatattatgtggatgtacagcttcgcagctacctggctaagagagaccccagaatttaataaagcttatctttagtttctaaaaaggagtcagaatgctggagggaagcctgcagcccaaggacaatgcatttttcatctcaccagccccaggacctcttccacccactccttactcgagggctatgcccactgtctgagagagaaactaataaacctgaaggttgagtaaccagagaacttaaggacattaataagccaagacgtggaaaatcatccctttgggtgcttgtggtatatagtttcgaatgctgctgctaagagacaagtttaatgagattcttctactaggaaggaagtgaaaaaggcattgccactacccaccgtgaagctatctgcccttcttttctctacttgacaacttctgataaccacatgcttacaattttatgacgttctaaactatcttagaatctcagcgagattgcagaggttgactcatattctatttttcctctgcagagcagtggggtacagtggaaagggaatgaactttggaatcaagcaggctgggttatcccagataaagatacatataaaggtacacacatacacagacacctcctagtggttctgcttctctgaatgctgactggcacagtacctatgtgatgttcagccagttgtttaacctctcttgcctcagttgccttactggaagtaagtatttcacagggttatgagcaatgagtttaaaaatgcctatgaaggctgggcgcggtggctcacacctgtaatccctgcactttgggaggtcgagaagggcggatcacttgaggtcaggagttacaaaccagcatagccaacatggggaagccccgattctactaaaaaatacaaaaatttgccaggcatggtggcgggcgcctataatcccagctactagggaggctgaggcaggagaattgcttgagcctgggaggtggaggttgtagtgagctgagatcgcaccactgcacctcagcctgggagtcagagcaagactctgtctcaaaaaacaataaaaataaaaataaataaacaaataaaaatgcggccgggcgcggtggctcacgcctgtaatcccagcactttgggaggccaaggtgggcggatcacgaggtcaggagatggagaccatcctggctaacacggtgaaaccccgtctctactaaaaatataaaaaattagccaggcatggtggcgggcgcctgtagtcccagctactctggaggctgaggcaggagaatggcgtgaacccgggaggcggagcttgcagtgagatcgcgccactgcactccagcctgggcgacagagcaagactccgtctcaaaaagaaaaaaataaataaaaataaaaatgcatacaaagtactcaacccaaagcctggcacacagcaggcactcaacagtatttcccattcctttccctctacttccctatgctcaaggtacaaacattaacaccatctttggttgcaaggggatcagatgttggctggtcagagcatcttctctttacacacgcctcaagatactggcaaatttgtgctctgtatcctttcctttttagacacctgtttcttcttccgcattaattttcatcaaaaaaaaaaaaaggctgtcatgcaattagatgagagctttcatcagtcacattctagtcctgagacctgggtgttgctcagaggtcaaaccaaacacacacccactctagggatggatttctcctgctgatgatggctaattacatgcatcatgtgctgaatttttaataattttactcccagattaaactcttccccagattctgttgcaactgactctaaccctctaatgaatgtctccaacctcacatccaagtggaacctgattatgcacctatgtgtcccagcaatcaaacgcaggatgaaaatcaaaatgaaccagcagggcatggtggctcatgcctgtaataccagcactttgggaggccgaggcaggaggatcacttgaggtcgggagttcgagaccagcctggccaatatggcaaaaccccatctctactaaaaatacaaaaattagccgggcatggtggcacatgcctgtaatcccagctgctcagaaggctgaggcaggagaatcacttgaaccagagagctggaggttgcagtgagccgaggttgtgccactgcactccagtctgggtgacaaaatgagcccctgtatcaaaataaggaaaagaaaaaaaaaattgtcccatccagtaaaacatgtcactagctgccatttccccaggtggatggctaacggaaatacgggcctgctaaaaagactcaggagacaatattatccatctccttcccttccaacctgctctggtttctatgaaaaagtgaaggccaaactgctaagtcagtgtaaaagttgtaagcgactgaaatgttctcaggaggaagagtttatggatgtttatggaggagacagtcactgttgaaaggcttccagttgcttattatttgggcctgaggaggaaccaccgctgaaatcaagcttggaagagcttgctgacgtcagattcccagctgtagtaaccccaaatggccaagtaagtatgttttttttttaactgcagctgttaggtggcaattaagaggggaagcggtggtaaggaatccctagtgtctgtaattataaaagcaaggatgtgacataggacttccataaaacttacacctcctcttaagattgatttcaattaaaaactgcttcatcgttggtgacactttagcatctctgttggtggcttcctgccctgaccacacaaggttcctttcgtgacgacaggaatcaacaaaaagaagaaaaaaatgtaagtttaccaacgcgccttccctttttccgagcctgatttatacaggatatatgggaagaaatgtggactccttgacctgttacaagaatccatcaaccacccaaataaatggaaacgtggaaagagattcaaagtcctccaggttttaggatattttaaggtatttaaaagggagaaggaggcgccgacagcgcacccggtgctctgtgtcacgatcttccgctcgcggcgcctttgaggacaagggcggcgggaaacgggtccgcggggttccgaggcgagcggccgtggaggaagcgcccccgaagaaggcctggtccctacgccccgcactgcccagcgctggggaacacagatcctcggaggaggccccagggagggaaggcgggagcggggcccgcgggaggggagggacgggagccgttgccacgcaccgcgccctgcccggaccgccgcgggacagccagttgttcagtgccgggatcccgcggctgtgccagaaagcaggacgccgcggggctgccgtcccgacccctcgcttccttccgcgctcccgggaccgggctcagcacccggcgccccggctacgaccggacactcacccggagccaccagcggcgaactcacggcgcctcccacgaagacagcagcggctaggacggcggaccccgggagtgcccgcggagccatcgccgcgtcgcttcgccctcctcccccagggcgccgcgtcccgcgctcgggaaggcagagccgctccggagccggcgggctgatcgagtg

SEQ ID NO: 2470 - DNA, 9279 bp, Homo sapiens
cacacaaccttggacattagagcctgtccgtctgatctagagaaggaatgttgctggggaaggaaaactcagggcgaggtgagagaggacagaacctctaaccaggaagaggctgtccccgccaagctccggagaggcgcggaagcatgaccctcaggtatgggaccaggtctataggaaacccatgtggtgtgccctaatgggaggcaagccggggaggacccaaactggaaacctgattctgaaagaggaaaaccaccacaacatcctttgtaattgtgcagcttggaagaacagtatagatcctgtggttttcctggggaaggaggggagcctaaaagccgcaaatgatgtatatttccttcagaagcagggaaggggcagttttcgagtacggctgttaaatctcagcactcacttcattcggtgcaggctgctcctgtggtcttggctatagcagcagaaggcggggatggagggtgccccagggtcaatcttggtcagcctccgaggagctgggagtgcaaggtgtcactctggatgtgcctgcctgcttttcctcgccttcttgccctccttcgcctttcctccctcttttctttcctcctttctttcgccttcccctgtacacctcttgaattcaccatcataaagttgacctgagatgtttcaatgagtaatgttttatgattgcttcagttacattattacaatccagtctgccttccttgtttctcaaacagttctaagctcttttctccttttctttgacttgtttttttttttttttttactacctatcctcctgactagttgttgttgtttgttggttggtttgcttttaaagagtccaggataaacaaagtattgcaggcatgaaaagggtcaggatttcagagcgaattgtggagggggagggtcaggaggggaggggagaggaggggagaggagaggggagggtggaggagaggtattgagggaggggaggggagaggagaggtattgagggaggggaggggagaggagaggtattgagggaggggaggggagaggagaggtgttgagggagaggaggggagatcagaggtgttgagggagaggaggggagaggagaggtgttgagggaggggaggggagaggagaggtgttgagggaggggaggggagaggagaggtgttgagggaggggagggtagaggagaggtattgagggaggggaggggagaggagaggtgttgagggaggggagggtagaggagaggtattgagggaggggaggggagaggagaaatgttgagggaggggaggggagaggagaggtgttgaggaaggagaggggagaggagaggtgttgagggaggggaggggagaggagaggtgttgaggaaggagaggggtgaggagaggtgttgagggaggggaggaggtgcacgtgcttcttctcgcctgtcctatttatccagctcatctatgaattatcagcagaaaaggaaagtaaaggaggagtagaggctgggaataaaatcctgggctttagaaatggggtagtttaagagtattctgaaaggtacaatgttacacatgtgtacacagttccatagcaaaagcgatttttctgtctacgggactgttgttgtacttggggttttctatctttcaattggtgtcacagttgatagaaatataccatgtagcccttattccagaaacaagtcctacttgacattgttaatactcttgtttgtatgcataggttctggcaactagattatatctttcttggatactagacctccatctttttctttttggggggtgtgttttaatatgctgtatccaaatggggtggttaagacacccctggtctatgtttattatgaatgtttgctcatatgacccccagcaacactatatagtaggaatattattatccccatctacaggccaagtgactgaggcccaaagtcccacagtagcagggttttctgtctcctgagcccaccctcataacacctgggcgacacggctggcacaaactggaaatgtcttgattggttgcagacacacaacaggttcactgatagtgctctcgtttttaatccatagccattaaatcattcattcattccacatttattgactgcctgctctgtaccaggtgctgtcctaagtgctgagaattagacttgaagaagggtggagcacggtaaggaaagagggtggcaagagatgcacggctggtccgagggactcttctacattccatgagtcctcccaggaagagttggaaggacaaggggtttggtcctcaagcatgaagtgatttggggatgttactagttttctgtgctgctgcagcaaattactacgaacttagaggtttaaaaaaatggaagcagccgggcatggtggctcacgcctgtaatcccagcactttcagaggccaaggtggatggatcacctgaggtcaggagttcaagaccagcctggccagcatggtgaaacctcatctctactaaaaatataaaagttagctgggcgtgttggcaggcacctgtaatcccagctactggggaggctgaggcaggagaatcacttgaaccagggaggcagaggttgcagcgagccgagattgtgccattgcactccagcctgggcaacagagtgaggctctgtctcaaaaaaacaaacaaaacaaaacaaaacaatggaagtttattctctcccagttctagagaccagaagtctgaaattggtatcagtgggcttgatccaggggtgggtatcagggatcaaggtgtcaccggggccacactctttccagaggctccaggggtgaatctgttccttccctcttccagcttggggggctgccagtactcttggtttgtgacctccttgctccaatctctgcctttttggtcacattgcctcttcctcttctgtctataatcaaatgtccctccacctccttctcataagcatttatttaattgtatttagagtccacccagataaactaggcaaattgtaccatctgaaaatcctacacttaatcacatctgcaaatacctttaatttgggggctggggtggcatataaggtattatttataggttccagggattaggatgtggatatctttgggggccatttttcagcctaccatagggagttatttgtggattttatttttttaatgtaaatctagtcccttttaactaagcaaccaatctgtacttcttaaaaagcaccagtcatattcactgtggacaaaagcttatgaagcagcatccctggaaattcacctatgattgaaagaaggaaggagggacaacatgggagacagagacacagccagcaatgaatgatgtctctttctggtgcatgtgcttcatggagacagggagactggggatgcagattctgttttggcttgtctttttaaaggctgtaggcccgtcacagtggctcatgcctgtaatcccagacctttgagaggccaaggcaggcagatcacttgaggtcaggagtttgagaccagcatggccaacgtggcaaaaccctgtctctactaaaaatacaaagattagccaggcatggtggcacccgcctgtaaacccagctacttgggaggctgaggcaggagaatcgcttgaacctgggaggcagaggttgcagtgagccgagattgcgccactgcactccagcctgggcgacagagtgagactgtgtctcaaaaaaaaataataaataaaaataaaggctgtagatattagaaatgaataatatctaagagatgcttccatactcatttttaggatgttctgaggaaggaagaggccaacatggtcagttttatatgaagagaagattttgttccaaaggaaatgatggggaaaagcccagcttggggaggggtcagggaacagtgggcaagtgggaaatgagtccaccttctgccaggaagcccaagggggcatgtctttgagctgcaaaagaacaggtccacaaatcatagctgagattggcccagcggtaggaaaagcaacacagaatcaatttagtgtggttgaagcttgtgcgatgactcgggctatcacgctcctcagggcctgaatcatgggacacaatggatccgccagcttattccggcatcctttaactcttgaggagcaaatgccctggcaaggaatccgtcagaatctccttcccctcctgctgctgcgtgcagtgggccgtgccctggtgaggttcctgtgtcctctgtagaaggtaacagattagaaaagcagaagtcccttctctgtctagcatccttccaccttcttctcctcatctgcaaaatggggatgaaacacataaccccagggttgggagaaaggtctgacacagaggcaagtgtcagtgaacgtttgagaactctgaagcggtgatggaaatggggtattcctggtaaccagcaccctctctgacccacgtggtagttatccttttgccaaaatgtgtgactctcttaatacattttgagtctctagggaaaaaaaaaggcaaacttaattcctactaatatatcactcactgtgttctctaccttttacgctttcttttccaggtggtaacagaaaacaatccagatggggtgcaggtgctgtaaaataatacaaaggtaaagctggagaaatactacttctaaatggaggaatttgtgatgagcgtggggtcacttttaaagaccatgcgtgtattcagtgcatttatccagcttggggcatgatcaacattgccaacacattaagagtttggaattgttataatatcatttaaaagaacatgtgccctagatttttttaactttttttgctcacttctcaaagcatgttgggaacaccatcattttctgaggctgaatttggtctgggtttctgaggatgcctgaaatggcatcgctgaaaataaatcaccccaatcacatatgtgcttttaattttgtccacattgcatttcagaaaattgtgagtaacgtgaacataaacttctaactaagaaaaagggtaactgatgatcttgctttcttaacaaatatactgtctttttaatcatagttctattctagacctatatataaataagctgtattccactgtaatcatactgtgatgtttggctttattcaaaaactatgtattgtaagtatcattcctgtgactacagacttcatatttatcattttagtgactgcataatattccactgagaggatatactccttatggccctgttagtggacatttgttttatttgttttttattttaaaattctatgaaccactttgtattttacttcaccccttacccctccttcctccttttggctctcttcttaagagtatttcaggcagaaccttgtttatctttttcaagactgtctcgctctgtcatccaggctggagtgcaggggcgtgatctcagctcactgcagcctccgcctcccaggttcaagcgattctcctatctcagcctcccgagtagctgggattacaggtgcctaccacctcacccagctaatttttgtatttttagtaaagatggggtttcaccatgtcggtcaggctggtctcgaactcctgacctcaagtgatccacccgccttggccacccaaattgctgagattacaggcgtgagccaccaaacatttttataccaactatatctatttgatttagacatacttatctaggttgaaaagtaatcacagaaattaaattagcaggaatcgtagaaagaagcagggcctgtggtaaaaagcattaatgatggagcagacctgactggttttcattgtctttcctgaagctatctctttgatccagttcaagtgccctctcctggctatgtcaatgaagtcaacagctgcaagctagatgaagacgacactgataaattaaaaggcaaatggagcagtgaagtcttggtgcagaaaaatgaccctcagaggcagggctcaaagaagactgagagcagcagcaggacagctgatccatgggagccctgctggcctcaccaagggccgctcccacagggggacgctggaggggaacaccatgcctgcggtgtcaacggcatcggccctgctgccactccacagcccactgggaattccagccccacccaggatgacaggggctcctgggccagtactgcaaatactgttcccccaactcaacccttcctggaaggagggggcaccaggaaacaggactgtgtgctgctggcctcagaagggacccaagtcatgagaaatggagactccagagctccttctgaggcagaaagttttgccttggaagtacaagaccatgtcttccagataccagccccagattaccttcagcattggggcccagctggagacaacgttgatcataatgaaaaggactgtgttttcaagaaccatactgaggatgaatccctagagggaattcagcccccagtgggggagcatggtttgaatacgcccttctctgtgaggagaagctgggattcattgaatgaggatgtggaaacagaagttctaagcatctgctttaatgagaagggtcctgttcatgccatgcctgtggttgactcaggaaacaggcaggaggatacccatggctccgatggagatggggatggggagattgtggacgaggatgcagcggtggcggaggcccttgcagctttagaagctgctactgcaggagaagatttggatgagactgattaggggaggggatttgcacagggaggtaagctggtgtcatgctgagcatgcagatgcatttgctccctggatgcatagcaggtgattctgccagcatgcaccagtgcagccttaccagttgtttacatccagcatctgttctgattgtcagcatctgtcccatgctgcttgtcacatatctggagtttcactctgtgtagatgagctgtcattcaggacactaggagaaaaatctgagtgggtcattgtgcccatatccacagaaaatgcagaagttgaacagcttgcttgacaaccctcaaacatctttgagcacctggtacagatgtttatgagaatactctaagatctcaacccttgatcccaaaggcacacaatcacagagcattccttttgactgtaaactgtttaccttgcttttgagagccaaacattgtacccaacctggaaaaagtaactaccccaattaaagtgcctcatgtgtccccagagcatggcttaacttcagggacaatcacccagggaactaataactaaccagttgttcaacagcgggttaagctcagcagttttcacagtagagcagaagtccccaggaaacaaagggttagtcattagctgagatgttgattttaaaacaccttgaccttaacttttttacattattacttttaaatctcctttgggattggggaggctggccaaaataagtcttaaaactgcttatgtcatatttggattttaagttcatgacattcggaacagcaaagccatatatgcaatgtttttatgccattaaatgtctgattccaattaaaatataacaacgtatgtgtctttctagaagtcttaactcaaaggtggttctaattttctcagaatatcagtgaccctggatgttactttcaatgtaaagaactaatctagatggccgggcgtggtggctcatgcctgtaatcccagcactttgggaggccgaggcgggtggatcacaaggtcaggagttcaagatcagcctggccaacatagtgaaaccctgtctctactaaaaatacaaaaaattatccgggcacggtggcgggcgcctgtaatcccagctacttgggaggctgaggcaaggagaatcacttgaacctgggaggtggaggttgcagtgagctgagatcgtgccactgcactccagcctgggtgacagtgcaagactccatctcaaaaaaaaaaaaaaaaaaaagagctaagctaggcacagtggctcatgtctgtaatctgagcactttggaaggctgaggtgagaggattgccagggccaggaattcgagaccaacctgggcaatttagcgagaccccatctctatgaaaaaaaaaaaaaaaaaaagagctagactacaaaattatactcaaggaagggaccgagctggtttgcagagccatagctttggctttctctctgtcaaacttgatgccataactaaatgtcctgatcttacctcaaagatgaacaagccctctctggatttcagccttctaattcactgaaacaaggacaaccattctaacgtaactcaatggagaatttaaaggcattaaggatgctcaaaactatctagaaaaaaataaacatggaagatgctttagtttggtgttttgtaacacagaattgaaatctgactgaacttcatttgatttccagctttgccatgtgaccttggacaagttatgtatccctttacccatctgtaaagtgagaagaataattgtatgtgcttgtaaaggttaaatgagatgatgtaagtgtttagcacagtgcttggcacactaggcactcaaaaatgatgttttactagttgaaaacaattcctttaacaaacatttttacatccccacaactgaaaactctaaaactgggaagtatgtataatgtcattatttgactttggcaattatttagtataaaacatgatttctgagccttccagcacctttaaggacggcacccttacaaatgcttaatgagcctatgggtttgtttggtactgtaatgacaagccatcgcaagtgacctctatatacagggtcactcagagcccttaaaaagataaagtcttggcattgttaattgcattagaggtatgtctccttttgtatttagtacaccaaatacttaatatttcagaatgcttattccttcaatgatttcctaagtgtatcagttgagattatgttcagttgtatgggacgagtgttttatacaaatagaggcttatttacctcttatgtaaaagaagtctggagttagtgatccagggtggtagagaatgtatcactggcccgtgtatcaatgacccacatatcaatgacccacgtatcaatgacccgcatatgaatgacccatgctgcttcaatcattttggtttccttctcaagatcactttgtagtccataatggctgctgtggcttcagtcattacatttgcattccatgttggaaaaagaataaaggaataaaaacccca

SEQ ID NO: 2471 - DNA, 42142 bp, Homo sapiens
tttcaagtggtcataattttaatggtaaaattaggacataaaaataattttcaaagaattattttcaaagaacactagacataaaatataacaattttcaaattttcaaagaatactagaagaaaaaaattatacagtcaatccaacaaaaagcttaatagaaaaaaaccctaaacaatagtataactacaaataaaatagggcttccgaattatgtctaaataatacaataattacaaatatgaatgggttaaattagcctattaaaagataaaaccactcagataacaaaaacagacataagaaacactaacataaaacacaaagaattaaaatgaagatatagcaagcaaataatagaaagcttgcaacccagctatagctataaacacaaaaaatgaagttatcttttgacctaataattccattcctaatacttagaaatatttgcacatgtgcacaataatacttaaaggatctcaacactgtttttttttttttttgagacagtcttgctccgtcacccatgctcgagtgcagtggcgtgatctcggcacactgcagcctctgcttcctgggttcaagtgattctcctgctgcagcctcccaagtagctgggattacaggtgcacgtcattatgcccgggtaatttctgtattttttagtagagatggtgtttcaccatgttggccaggctggtcttgaactcctgacctctggtgatctgtctgccttgcctcccaaagtgctaggattacgggcctgagccaccttgcctggcctgcaaaatttgtttttaatagaagacacaagaaatgatttaaatattttatcaacagaaaaccagttctatcaactatgggcccagtatgcagcttttaaaaatgacagttctatatacattgatatgagaccatttcaaacaggtattcaataaagtatagaatggtaacatatcaccaactgtgtaaagaaaaatatataaacatatgaaatgatacattctgtgcctatgcaaacatatgatacattaaaaacaaaagaacatatagtgcctgtctctgaggggaactgtgaagctatggaaaggtgttgaagaaaacctttttatagtatgtattcttgtaattgaataaaaaataaaattacaaaaatcaggcttggaagtatttaatagcagacaaaatatagttcaatatgaaaagcattatatgagacaaaggcaattttcaaaaattgataaaacattccaccaaaaatcatgactacgcatctaacagcttcaaaatatagaaaatactcaaatgcaaaatcaacaaatctgcaattacagaaaaagacttcaacatacttttagaaagtagtaactcaagtagacaataatagctaacacttaccgggcacttcttatgtgagtggcactgaaacatgtgctttcatgcattacctaaggctagagaaaatgttaataacttagacaagtcatacatgtatcataaatatctttgtacctgacaaacagaataaacatctttttaaacaccattagataattatttaaagaccacatattgggaacctacccctaaagaacaataacaaccacaataacaactatcaccccagtaaacatggctggcaagaatacaattaaatgaacattatcactgatttggcaacagctcttatgaagaataatttggcattatgtatcaagtgcccatactctttgacaaagtaactgtctttctgataatctatcttaagtaatacaaaaatggggggaggggaataaaaatacaaaatattagaaacactatcgtcaaaatgaaagggcatggctgagtatggtacaaccgttcaacagaatattgtcattaaaaacatttatggaggctatattatatagtcaataacagaaaatgcttgaaaggttagaagtacatcatcaaattatgttttatatagctgtaaaataaacccaaatcatctttaatgaacacatactattatggtaaaaaaaagtctacaatttctaactttcaccttaggcagctttttattttgcatcctttttttcaactttgtcttctattagctgtgcaagaaatacatgtctgctaaagttacacgatcttcgcacaacagcaacctacacattagtctacaaaggggaacaaacccaaattcctcagaagtctgagtccactgttgccttctttctggccatctggcagttacaatatagcacagaatgactatgcaagttaaatattcatcttagacatggacatttgctttgggactcctaaagtggagtcaaatttgatctctacagaaactctacaatgtagcagagcactgtgcgtacttattgactcccagacaagccgaaaccccgaatttgtcatttctatcagtttttatataaattgttcttacctacttattgatgcttacaatttggcaattataaggggcaaaattggagcaagtgttttgggtaaataactccttacaatatattaaaaatacttacaaacaattcttagaatcaaacacttacgtaaatacttttttaaaaaaataggtccaaaagactcagcccagatcggctttgaagttatatcaagatttaagtctacttcatgccaatgagctactcctcaacaggggctggttttgccatttgaggaatgacagccactatgttgtgtacacaagagagctggatggcatcgacagaatctttatcgtggttctgaattttggagaatcaacactgttaaatctacataatatgatttcgggccttcccgctaaaatgagaataaggttaagtaccaattctgccgacaaaggcagtaaagttgatacaagtggcatttttctggacaagggagagggactcatctttgaacacaacacgaagaatctccttcatcgccaaacagctttcagagatagatgctttgtttccaatcgagcatgctattccagtgtactgaacatactgtatacctcgtgttaggcacctttatgaagagatgaagacactggcatttcagtgggattgtaagcatttgtaatagcttcatgtacagcatgctgcttggtgaacaatcattaattcttcgatatttctgtagcttgaatgtaactgctttaagaaaggttctcaaatgttttgaaaaaaataaaatgtttaaaagtaaattatggcttataggagcttataactttattcagatagcatcaatcagggatgaccagaacacattaggaccccagattattcaaaaactttaacgaattttaaggggaagaattttatcttttcccttaaaatgcagtcatagaaattagaggatgactcactgccacagtgtctaaaagcatttgctagcaaagaggcaggacactaatttgtaaactgctcaactgttctgactggaagggaggcctggagctctgctatcaccaatccttcccttccctctactccacatccttctaaggagcatgatttgaaaattactttcctaggttaatgggcatgtgcatcaatggagagaatagtataagcaagtgagatgtagactaagcaaaatttagatggagaagcacattttaaaaaattaataacttaaaagtctcaagttattaattttttttttgctaactcaattggaagtaagactatgaaatatttcagtgtgtttccaattcccagttgaatgcagtgtttcagaatttcaggtatttcttaagatcctcgaaaacactggtgctgtcaagtccaagttcctcgtacaggaatttaatttgggctgtaatctaaaagaaacacattaaaaaaattaaatagaaggcctttgtagtaaaatgccactgtttaagcttctctttatctatccatctttacctaaccgtgaagtcagcaatttatggcaagaatactttcattcgagagagaggcagaaggcttccaacaattaagattaaattattttctttaacagagctcacgtatcaagtacaagagagagacatttctcttgattgacacagtgtccctccctcccctcctgggtctcacccatagataggacatttgtgaagtggctttgtcataaacctgctgcaaccactgaaaatgtgaaaacaacatgtatctagttcgggaatctgtccactgagagggccttgataacatacctttttgtgagaatcctcaattacatgattgcctccaggctgaatatctagaataatattaggggtctgatagcctggaagagttaacatgtagaacaattagaagattgtatgggatcttctttggaagatcgagacccattcctcccctcttctttgagtactcagttcaaataatagtaaaggaataaaaagcaaaaaccaccatcatcaacaaaaagatgggaggggacaagcaacagaagacaaacttctgacacagcgaaagcaggaagaggccgtatggaaaagactatatggtgccacacggacaaggttgaaacccaggagatcatcaacctgccctgtggaatctgagagtcttatgccctggaaacaccaactacagcaatggatgggggtgacaaatggagatgaatacagggagactgatatggcatgtagtttcaaggcaaaagggagggattcttatctcataaagctgaaacagctagctagaggaaattcatgcagctaaacagtttgggcactgatggcccaaaacaaaaatctcagaatctgtcttttagagattcccaagaataacggctcaataaatattgttaaatgaattaataattgtatggcagtgcatctccaagttatatctgattcttaaatttcctgtttcctttgtgtcctgcctatctattttaatactgtcctttgaaaaagaggtgaggcagtgtatgtatagacatgtagttacgtacactttaactggggagtcaacatagcaaaataattgtttgccctaaatcctgggcagatgatttggctacagcctgaaatatattcctctgagcagtgtgctgtgggtagtagtctgtttggccatgttccctgcttctagggggtctcctaccttcacctgtgtccttagcatgctccgcgatggcttccttgagtttctcagtataacttacaattcctttcagaggtacccgttcatcgttttcatatgccgttatgtgaattgaaggataatgctgaaagaaaatacatgcacgaagagtttacattatttcttatggtcccttgccactatagagactatgaaaaataattacctccaatttttccctgtaagtgctctatgctttttctcacttgctatcttgagagcgcctcagtattacagtagtagactacttgttatctggaatagccttttcttgactaaaggaccttagctaatttagtaattaaggcatgataagtctattcccctgaggtattaaacatggagcatgagcagagatggtgctgaagatatttgggcatcataagtagaaacatctctaaagctcctatttttgcttcagcttggataagttttttttttattatcttctgtgtaaattcaggataatctaacacaattgtctttcactacctgaggtttaatattttgatagggacagtaacgttttatgtagttcttgtgtttttcatcagatgaaggattcccccattcttctaattcttctaatgtcagaggaagtgtagtgtccatcatggtgttgagaacatccaagaaaggtgcctaaaaaaaaggcaaagaaacttatacttcaagtaagaggttggtaagtgagtttcagaaaaacattctattttatgaatatacatactaatatgagagaaaataactcaagccatgtagattcctaggagctagaatactcagtccttaaccagggcctgtaatttataacctacttttaaagtcttcagattccttaaatgacatataacaagaaatggtttatcttctaatttcacaatatttatttttagcttagtaccttttattcatttatattttttcttatataaaagcaataaatgctactgtctcataccaattaggacagttagttattatattaaaacaacaacaacaacaacaagtattggcagtaatgtggagaaaccggaatcctgatacactggtggttggaatgtaaaatgggggagctgctttggaaaacagtatggtggttcatcaaagagttaagcttaagattaccatatgatccagcaattccactcctggcatataatccccaaaactgaaagcagggtcttaaagagatctgcatacctatgttcacagcagcatattcacaacagccaaaaggtggaagcaactcaagtgtccattaaccaaagaacgaataagcaaaatgtggtatacacatgcaatattacatggaatattattcagccttaaaaatgaataaaattctgatccacgctacaatatggatgaacctcaaggatataatctaagtgaaataagccagtcacaaaaaattttgtatgactccacctatgtgaggtgtttgagtagtcaaattcacagagacagaggctgtgggaagaagcaaatggagagctgtttaatcggtacagggtttcagttttgttaagatgaaaaacgagttctggagattgactgcataagcctatgagtgcacttaccactactgaactattcacttaaaaatggttgagatggtaaattttatggtattttaccataattaaaaatttttaaatgaaaaaaatacacaaggaataaagtctttttgaccagttggacattttatattaaaagcaaaaaacgctaagtaaagaaactctgcaaaatacccaaggtgaaagaagagaaaacaacccattggcttataattagtgttacaaaatttaataaaacgaaggctgggtcgcacatggtggctcatgcctgtaatcccagcacattgggaggctgaggtgggcaaatcacttgagcccaggagtttgaaactagcctgggtagcatggtaaaaccacatctctacaaaacaacaacaaaccacaaaaattagcagggcatggtggcacatgcctgtagtcccagatactcaggaggctgaggtgggaggatcacctgagccccagaggtcgaggctgtagtgagctgtgttcgtgtgccattgcattccagcctgggtgaaagagcaaaactctgactcaaaaaacaaaacaaaacaaaacaaaaaaacaaaaaccccacaaaaacaacaaaacaaaaatgaaggctgtatttttcacttagctttattttcttctgttaacatactttttagctttccctcatattaacattaaccaagtatagtgagtcatctgtaattctttttggctgcctaccatatgaacttttttgcatttgaaaaacctccaaccttatcagctagagcctgcctctcactgtggagatactaagtgctagacttctctttcccatttttccctgcagcttgggagtagctgtgtgacccatgtgtgacttgggtctatcaaccagacacatgtgctttacactctgcatggaaagttagtgattcaaagaagcagtgatcacagataatttattctggcaaaagtgccacagctatatccagctctagaagttgcactggcagtgtgaggtgatttgtgcttggcagtggcggcagtaatagtttcattgggccaattctatgcctttggctctgaagcctctaacactggtctgaagacacctacattttcctaatgccctttaatcccttttctgcttaaattagggttgatttttggtgcttataagaagaatttgacttatacatgtataaaaggttgtctcctagtcttcactataataagcaacctagcataaatatccttctcatcatttccttttaaatttctaaaagtcaaaatctagttgctttgtctttaaactgtaaataattctgccattatctttgtgcataggctattctccacatttttctgtttttaaaaaatagacttacaggtgactactatttaacacttatttacaagcccacagtataaactccccaacctcaaaataaaaaatcctgaaaataatttactctctcccatctcagtcattatttttcagagtaacctagaagtaggagaatgatagcagtgaaaccaactgctacaatgtaacttcgtaatttctgacactgggaaaagataatcattttcagaacagggtaagatatttcaattaaaatacggaaaaactatgcccaaacgaccattaagaatggactatctaaaaataaagagcctataaatctaggactgaaatgttgatgggcagtagcctgtcaaggtgaccaggagccaaaggactcagtgcattccagagtcacagcgtgctttgcctggctttctcaactgggactcatatatgcttcagtgctttttcaccaattctaaatgtccttacaaatacaaatgagcaatggaaatagccattaatatctttcagtggaaagccttaaagataataaagaacactgtatcagagaagaataacggttaatagttggattaaaataactttagaagttctcctcaagctataattctgagtttaaaacttaaaagctttgttatactcctatgctatggtaaaactgtaacagaaatgtttttctttccttttttttttttttttttgacaatgtctcactctgttgcccaggctggagcacagtggtccactgcagcctcaacctcttaagagatcctcttaccaacaagcctgggtaggtttttttttttttttaatttcttgcagagacagggtctcgccatgttgcccaggctggtctcgagctcctggtaagcaatctgcccacctcagtttcccgaagtgctgggattacaggcatgagccgctgtgccagcccaaaaacatttttcttagagtagcctatggcttcacacctcccccattctataaacagtagagacagagcgtactcacctccaaagtcaccgctctcaccagctctggattagaattacacaatgctcctgcaagcacccctccagcactgaaagcagtcagggttgttagacttggctgagaaaagccttggccatgaagcgtcttaatgcaagcctctaaatcagcaaggccattgagttttttagttaggcggccatcagcgtgccactggaggcctaactcaccaccacctctgaaattgaagggcaaaaaagttttagtggaaaaaaaaagttaatactgtaggctggggtcagcgaactacacctggaggcctgttttttgtgtggccctggagctaagactggtttttgctttttaaaggttgagtgaaaacaaggaatgtgcaacagaaactgtacgcggcctgcaaagcttaaaatgtgactatgtagctctttagagaaaaaggtttgccaactcctgatatagacaatccagaattgattcaacgaatatattttgagtgcctgcccatttatcagggattaagtacagaccttaaaagtagaaacaaacgaaaatcccctaccgtggagaagacagtaattttgtggggtaagaaaacaacgacttacccagcaatgtggtgtcattgctacaatacaagtgtatttaaggtattacaggagcagaggaaagaacatccatctgccaggtgaggggtatatacacgagtcaggaacacaaatgcttttaaggagatgatgcctaaactgagttgtgaaggaaaaatttgagtttccagagggcaaagaaaaggcattaagacacagatacgacacagcatgtataagggcaaggaggtgacagagcatgtcatttaaaagacatgactttgggggctggacacagtgcctcaagcctgtcatctcagcattttggtaggctgaggtgagcaggtcacttgaggtcaggagtttgagaccagactggccaacatggtgaaacccccgtctctcctaaaaatagaaaaaattagccaggtgtggtggtgcgtgcctataagcccaactactcgggaggctgaggcaagagaattacttgaacctgggaggcggaggttgcagtgagcggagattgcgccactgcactctagcctgggagacagagtgagactccatctcaaaaaaatacaaaacaaaataaaaaaaataaaaggacatgattttggaaggctgaggcgggcggactgcttgagctcaggagttcgagaccagcctgggcaacattggaaaaccctgtctctactaaaatacaaaaaaatcgggctggtacggtggctcatgcctgtaatcccagcactttgggaggctgaggcgggcggatcacttgaggtcaggagttcgagaccagcctggccaacatggtgaaaccccatcgctacaaaaatttcaaaaattagtcaggagttatggcaggcacctgtaatcccagctactcaggaggctgaggcaggagaatcgcttgaaccctggccaagatcatgccactgcacactccagcctgggcgacagagcaagattctatctcaaaaaaaaaaaaaaaaaaattcagacagtgtggtggtgtgcgcctgtagtcccagctactcaggagcctgaagcatgagaatcacttgaacctgggaggcagaggttgcagtgagccgagattgtgccactgcactccagcctgggcgacaaagcaaaactgtctcaaacaaaaaaaaaaaaaaaaaaaaaaaaagggtctgatgctaaatgccgctacagagatccatcagaccattaggagtattatactggggaatctggactgtgttctagagatggggaggtggagaagaattttaagcagaaatacaaaataatatttgtgtcttgaaaacagctgaaataaaatggaagttaaatggaaaacagttcagattcagaggctacttaaacctgaattcaggagaactgaaaggaaataataatattactaaataagtacagagtctggtacctctatgcaaaaatcctaaaaacctatccttttgctttttggatcaactaatctgttaaagaatcaagtttcaccagtgctggtttaggaatacaaaaattgaataataagaatgaaaaaaataagcttttgttccctgatatatattgttattcttgacatctctcacaatggtctagcacttacatgccaggtaaaatatactgactcaccgaacatggcagtatgctaatatccatccatcatccaccaggacccgcctctcaggcctgaaattcattttcaaatccattccataagctccatatacatgtaccaagagaggtttcttctgcaagtcctcagagtcagttttgtggaaaacagtcattggcactaattttccatcctagaaatgaagaattactatgtatgtaaagaagagtcttttataataactgttttatcccaatttaaaatacattgaggtgcactgtccccacttgtgtgctacctactgatgttgagcacaaatttgtttaagaaaaagaattatggtctctaaaaataaatcatggcttttggtttcagctaccttgctgtcctacagtattaaccagaaaagagcagcaagactggcctgaaaacattttattaaatgcagcttttcatgacaataatgtaattttaaagagttcttcactacctactataattttaaattttcagatgaaaccaaaatacttaccaaggttagaagtcctagtatagcactcttcctatgcctaagagctagatattggcatttttcacttttgagtatctacaaatatgctgactaaagtcttaccagctcaattttctatatcctctgtagtcggaattctcaaccattaagacctgaaatcttactgatgttactgataactaccacaatcctcttcaaaggcccatttaactttattaaaaaaaatttaaagtggtcttaaaatttttcggtaaaattctttgtagggttaaagtaagttaaattatttgtaaggttactaagttacttgtaggttatgtaaccatcccccaatgtagctcaaactcatcagttccagttgattgaaactaggcagtctctgaacagacaaaagaactaattctgatctacctttcacacaaaaaagataaagaaattggttttcaccctgcttaaactaatgaaatagcaccgtttacataaagaaaataaataatacatccaagtcactcttcatattttcattctcattttgaaaacttcactttggggcaataactggagacagcaaaatgtaatcaaataaggaggaaattctcctctcattcttctttaaaatacccaagttgttatgacattgttaactttcacttttagtaagattcacttttataaaacttgatgtagattaatttctataaaacactcttggtcttttcacttcccaactcttccccaacttcaattatacaatcagaaaaagttgcttgttgaaaagttttgaaaggaagaggtaaaacagtagctactcctgtgatgggctggatctgggtttgccagcagtactaaaatgcctgtggaaaggtatagcgcttccattcagcagctgcttcccttctcccctcttggctctccaagaacatggtgcttaactgttctttccatctcgggtccaataattgcaacattttgatagactagtctaattccatgtttgtaaaaccaaataaaacctatctaaaagataatacactaagtgggtaacaatgattatttctaagaggtgcagcaagcaaatggtactgagaagtagtcatttaagatttgttctgtatttttgcatctgttcaacaagcatgtattgcttttgtaatataaaaatattaatatttacttaaagattgtcagagaaaaataaatgaattaaagaaaaaaattcctaagaataaaaggcttgtgttgtaattcattgtgtcagcacatgtgaaattatctgatatatgatatgctaaagtctgaggtttccttaaattcaaggctatagtttacatattaatttgttccctacttgcataaatttgtatattctgtatattgagtatacctggaatatggatatttgttatttccttttctgtgtctcatctctctctactcctcaccctgccaatcttccctcttttacttgattttggccataatggcctcctttatatttgttctttttctgagacaggatcttactctgtcacacaggctggaatgcaatggcgcaatcacaactcactgcagcctcaacctcctgggctcaagcaatcctcccacatcaggttcccaagaagcagggactacaagcatatgccaccatgcctggctaatatttttggtttttgtagagatgaggtctcactatattgcccaggttggtttctaacttctgggctcaagtgatcctcccagcttggcctcccaaagtgttgggattacaagtttgagccactgtgcctagccctacacttcttctgtaggctggagagcagtggtgaggtcttggctcactgcaacctctgcctcctgggttcaaaggattctcctgcctcagcctcctgagtagctgacattacaggcacctgccaccacacccggctaattttttgtatttttagtagagatggggtttcaccatattggccaggctggtctcgacctcgtgatctgcccgcctcagcctcccaaagtgctgggattataggtgtgagccactgtgcccggccagccctacacttcttgaattgtataatttctccccaaattcagggcctctatacaaaatggaatcccctatctcctttctagtttactcttaatcatcctagtggtcttacctgagacataacttccttggagaaaacttccctgatctctctagactaggtaaaatccctttgctctatgctcccactgtactcagtatgtcctcctttgcagcagtcagtacattattaatgactttttaaacatgtcatctttcctgctagatgtatgctccatgagggcagggactgtatcagtctagtttactctagtcaactaccaccttcactatttttgccataactacataccaactctattaattttttcttaaaatcaactttaaaaaatcagacataaacaacatgtaaaataaaaagtttgacatgctataaattttcttttttttttttttttttgagacggagtcttgctctgtagcccaggctggagtgcagtggcacgatctaggctcactgcatgctccgcctcctgggttcacgccattctcctgcctcagcctcccaagtagctgggactacaggcgcccgccaccatgcccagctaattttgtgtatttttagtagagatggggtttcaccgtgttagccaggatggtctcgatctcctgacctcgtgatccacccgcctcggcctcccaaagtgctgggattacaggcgtgagccaccgtgcccggccgacatgctataaattttctaatccatgttaaaacaaacatgaatattaaggttaaaaaaaattcacctatccctaaagtcacttgggtattactgtggtctaagaaatctacattaggaaaccgtgctaatgtaactccaacaactgcatggcatctggcaaacggtatgctttcagtaaatgggagctgaaagtgaagattataagacctaccttgcttttggcttctagacgtaaaacgcgactagtctttgtgattgggtcttcatgcccagtttcctcaaacagtttgccttctgcaaacttgtatgtgtaatattttgggggacgtattggagagcaaagttgaaaggggcagttctttgggtcagaatttgtatccattatgaatccacaggcccaaggagggagctaaagaaatacaacagctatttttattctttatttaggccaccaagtatcattaattaaatttctaagtcttctccaaacaagatgatgtggatatctcgtttactttttgttaccacgtcatgcctcattcaaggattactttatcacaacaacatacatttcaaataaaaaacaaaactgtacattaatgaccaataaaataagacaaactataggaaaatgatttatcatgattctagctttacatgaaattgcctttaacataaaagtttattttggggtataatcttggataataaaatagtaaaatggaagaataagagcaaatcaaatagtaattccagaacccaccgacactgccaagatctctgttctcaaagaacgtgaaattcctcacatgcgtgtgtttttcataatttacccactagtccttaccctgctgcctggacagccacagtgatgacagttattatttcagggctataaacgggctcagcagcattaaggcatttgcaatttgtttctaacttttagctcctaggctaaccattgtgcagaacaaaacctcttctggcacatctactctgagagactcacagctattatactcaaggttcttaactttaagaaaaaaggaaaggaatcaaaatttattctctcagagcagcagggtccagcttcaagccttgcactaacatccctcttacaccttttaaagaactctggtaagcaggttgacagagcgttagaaatggtaccgagaggcagaacattaaaagaaaattgcctttcttttcctgagtaattgtagaaagagcaaattccttagaaaatcagaggcacagaaacatcactggtgggcactattgaaaaagggcagccggggatttgtgcgtaaaggggataccattccacctgcagcaactacagccagagtttacgttctctgagcaaatctcttattaataaaaaaaaaaaatctattttcatgaaacactagtaaggacacacatctgcaatctctaaaagctcctaatgtatgcttctcacattgagggttgttttaaaggataacttgtctatttaaatttaagccataactggagagtaaaatgtaaacaaaaattgagaaatctggtagcatagttataagcaagcaaactgagacttgagaggggaaaaaaaggaagcactgctacaaacctcataaccaggcctcagagcgagggtacaaggttccttagcccatggaagctcaagtttttctgccctttgatgagacttcaggacagtctctatgtgacccacgcagtaagctgtcttagctttagaccaagtggttccaataaatcaaaaagtatttttggtgtttttctaaaactaatgggaccaacattaatgttttaatcataataaaaactgtttcaaggctatggacttttagaagttcatccagctaatgcagatataagtattaactaactcaaggatatcttaagccacatttcctattcagataagcctgcagtgtatctgtgtatattaatggacagcaccagagagtaagtaggccaggagatagggagacattccttagatacctgagagaaacaggttcagttttagcactctaccagcaaactatagttatttcatcaaaagaataagacatacatgccgaaagaaaattggcctgaatatgcagactcctcctctaaataaaactgatgttagcatacagcaaaaaacgtcccaactggcctaaattaaatatcataacttctttttgtgacaaaaaaaaatacttccagaaaatactgatggcatggtgaccaaggatacgaggcaaatatgtgaagggttttacatttctgttgctaagatagaatttatttatttatttagagacggagtcttgctcttgcacccaggctggaatgcagtggcgtgatctcggctcactgcagcctccagctctcggcttcaagtgactctcctgcctcagcctccagaatagctcggactataggcacctgccaccacgcctggctagtttttgtatttttagtattctttgtattttatattttttgtatttttagtagagacagggttttgccatgttggccagggtggtcttgaactcctgacctcaggtgatccgcctgccttggtctcccaaagtgctgggattacaggctgagattgaatttaaaaagatcttttaatcaagtgcccaccaggcagagatactgcataaagaaatattttataatgcactcacgctatggttaaagattttgtctttcgtgtatggatggcactgtctatgtatattaattaatattattcaggctcataaaaagggtctgatctataaaattctctttattatataccaggtactaaccagaaagatcaagaagtatttaattccacttgatgatgactagaacattataaaagtcgtaataggtactatcatttgggaagggtcagaaaatgaagagatagaagatacagaataaattaaagacataatgtttgttccagtggaatttaaaaccatggaaactggggcatatctttaaaataagaatacttacaaaaaatataaaaggtcatatttacttagaagtcaaatcatatagcagagtaaactccacatgacatttctaactttcctgacatagaattttgttctaacaagtgcattgctagaaattacatattctctcccattcttattcatacagactgaaataataatagatgctccaccagtttcccaactgaagatgtctaaatttggcaccagttaacatgtaaatggttagccataggcagaagattgaaaactggaccccttccttacaccatatatacaaatcaactcaagatgaattaaagacttaaatgtaaaacctaagactataaaaacccttgaagaaaacctaggaaatataattctacagaaaggcaaagattttatgacaaagatgccaaaagcaattgcaacaaaaacaaaaatcagcaactggaaactaaagagttcctgcacagcaaaataaactatcaacagagtaaatagacaacctacagaatgggagaaaatatttacaaactatgcatctgacaaagatctagtatccagaatttataaggaacttatattaacaagcaaaacaaacaaaaacagaaaaaaaccccaacaccataaaaaagtgggcaaaggacatgaacagatatttttaaaagaagacatacatgcagccaacaagcatatgaaaaaaatgctcaacatcactaaccattagaggaatgcaaatctaaaccacaacgagataccatctcacatcagttagaatgactgtagttaaaaagtcaaaatataacagatgctggtgaggctgtagaaaaaagggaaagcttatacactgctagtggaaatgtaagttcagccactgtggaaagcagtttgggaatttctcaaagaatgtaaaacagaactactatttgactcagcaatcccattattggatatataaccaaaggaatacaaatcgctctaccataaagacacatgcacacattatgttcatcacaatagcaaagacatggaatcaacctaaatgtccatcaatgatagactggatacagaaaatgtggtacatatataccatagaatactacacagccataaaaaagagataatgttctttgcagcaacatggatgaagctggaggccattatcctaagcaagccaacagaggaacagaaaatcaaacaccccatgttctcacttataagtgggagctaaacattgtgtccacatggacacaaggaagagaataacagacactggggcctacctgagggttgaaggagggtgaggattgaaaaactacctattgggtactatacttattacctgggtgacaaaataatacgtatatcaaacccctgtggcagacaatttatctattaaaccaacctgcacatgtacccctgaaagtaaaagttaaaaaaaaagaaatgctatctaaaataataatattaaaatttttaaaattagcaagtgaaaagaaatactttgcactccagcagatgaagacaataaggacatccctccaagtcagtcaccattttggttttaggacacttacatagtgttctaagagactggacattacatttgatcttttgattttagggagtagctggagatttcagttatttcaggcccttgttatttcttatttataccaataaaacaatctcaaaactagcttcctgccccttacttctttttggtttagtgtatcctaatatggctgccactcctcaaaccattcccctgctcaaaaacttcaaatgttacctttcataattaataaattcctcatattgacactcacaaaaagtcaaatcatgacttcatcccccagaaatgtatagcgctttaataaaacagaataattaacagtttcctgaacattttctgaatgtcagagcatacagcttcatttgatggctttctcatcttggaataccatcccctctccacctgtcaaaatcctatctctcttctctggtttatttcacattcaaccaactttaccaaaagctttcctgggccttcttctctagtttgagccccacagcacattttatgtttttgatactacttattcaaatccatgatacacttaacctttatgtactagtttaatcttgtgattaactatatcttccttaaggctaggatattctgctttaacagctttcgattctataatgcccgatacagtattgtgcacatgaaagttcaataaaaagccactgaattgactgaaattgcatttttacaggagttttaagaatattggagttagggaggtataaatggtctatgctgtttgctcatcaactggctcagtaactcttttcatatcaaacaaaatggaagccatcctcttcccttcagtgcctactacctcaactcacatgttaatgctgctttaaaactaggcaataaggttgtcattcaccaattttaggaagttcacttgtgaaggcaggttatctttcctggtagccacaagcagtatcaactagtcagcttgccaagcagtcttgccactattagccttctgtgctgctgtggagaccactgctactcctacactgaaagaaaccaaagtttgttccctgcatcccctgcggataagaaaactggcagacagaagatgatgcagacaaaagcatgtagtggctaaaaacacagtggataccactactgtccctgttggggatgtgggatgggggaacagcagtcagtgtttaggcactagctaccaactttggcctgagtttttactatatctcaagttgcagagatatgtgaggtagagagatatacagaaagagaaatattagcactcaactctacttgtgaagtccatgccataagacactatcttaagtaaaactgcataaaaagcaagatcctctaagtaattctaagataaccctcctaaacccaagagtgactttgctaaattccatttaagttacattcctttcaagaaaaagaacactgctgccactattcaaaatgtgatgttctgttaagctaaactgcataaatattttgattaacagtattaacttctgaaaattaaacatacctttagagaccgaactgaatcatcagccagaccaatcacattaacataaaggagattgctgtgcttcagaaatagaacacagtgatccttaaacatgtccaagtctatcacttttgtatttctcttcattgtaaaaaataaatcccaattcataattgcaggggtatcagccgctgttctcattagctacgtggaacaaagttagaagacatataggtaagaaaacacgaaggctgcagcatccagagatgcaatcactgagaactagaccatactagtcctcactgttttatgaagagctgaaggaactaacgctgcatcagggataaagtgtgaccatcaaccatatgaatgagtcctgactagcctgctgggtggtgagacagtatatccagtgcttagccaaccactggacatttgagtgagggcactgacagctagctgactacagatacatcagtgagcttagctgatatcagcagaagaactgcctagctgagatcaatccaaattgccaactcataaaatcacgagtttgtaagtttgctcttttaagctactaagtttgattttgttaacataaactcaggacagaatatgttttatttactaactttttaggcacaattaaaatatgtagaggcattagctctaagggaaaagaaatgggattggttatacataggaaggtggcatcaatttataaaacaatgagctcttggagcaagaaatgttgttgatcgaagtgtgacacttcttaacagcccaaataggaacaacgagcatccaggattaccttaaattctgtaggttctccaacattagtgagaatgtataattcatcatctctgtgttcaacatagtaaaggaccccatgtattcgcttctggataagtactggtgggtcccaagggctcaggccatctatcaaccacacttcagaagtagtcttgttcataatatttatggtgaggaaacgactgtcttttgtaagataaaggaaaacaaagtagctagagagagagagagagacatgagatcacagtttatttcagatgcatgctaccttgttaaggacagtatctcagaggtggtcagtatacatgttgatttataatgcagataggaaattaaaataattccttagtgaatatcacttgtaactttaacaattagctattatttttctcattttctcctaaagggcattcaaaataatttacttctaacattttatcataaatgtttttcaaaaatacagaaaagttgaaaaaaccatcttgattccatcattgctaacattttgctacatttactttattacatatctatgcacctattaatccatctttatttggatgcatttcaaggtaaactacaaacgtcatttctcaatcacatgagtagataacatagctttttgctgagaagaggaaataaactttctataggagacacaaatagggaataaaagggacacggagttatttttattttcttctttctctgcatgcattttggatttttttttcctttctcccagtttttacaacaaaatagaataggaagaaaacccctcacaatcttactaacgtaacacatttaaaacattaacatagctattttactttttaaatttttccttctaagttatatttatatttcatgtgtgtctttaaatagatgtaattatagatacaatttttgattctgtatttcttacttcatatatcaattttctccctacatgagttgaaagtctttgtgattattatttttaaaggctacctaatattataacaggtttaatggctacctaatatatcataattcttaaaaatttagattttaatgtttcattataataaacaatataacaagaaacatattcatgaagatattttccccttccatgatcttcacaattattttcccaagacaaatttttagaaatggaaatactaatttaataagtgtatttttatgacttgatgaatataatcaaataatatcctagaagcactatactaacataatgagtggctttaaatgttatatttatatttttccttattataaaagtaatttatactgaaactactgaaaaacgtaaagaatcccaatgcccccaaataacaactgcttatagtttggtaaaatttcttctgtattggatcacattaccatgtttatttgtcaatcgttatttcttttgtgaaatgtgtgtctattttaaactttgaatgtagcttaaattattagtatgtaaatagctctttaaaaattaagaatattggctgggcacagtggctcacaactgtaatcccagcactctgggaggccaaagctggcagatcacctgagatcaggagttcaagaccaccctggccaacatggtgaaaccccgtctccacaaaaaatacaaaaattagccaggcatggtggcaggtgcctgtaatcccagctacttgggaggctgaggtagaagaatcacttgaacctgggacgcagaggttgcagtgagctgagattgcgccactgcactccagtctgggtgacagagtgagactctgtttcaaaaaaaaaaaaaaaaaattaagaacattaacttgtctttttgttgaaaacactttcctccattttgttacctagattttaactatttacaatagtttttgtggtttttgacttgagtttaatattttacgtaatcgagactgctactaccctttgtaatttcttatattgattttatgtttcaaaaatattccaaccaagctgactaaaaagcttatattttcatcttattaaaaaattatttttctcaatgggttctttaaatctcttaggaatgtatgctgacatatacaatgatgaaaattattttttcccaaatagtatttcccattgcattataaaataacaccgattcatttttcattagtttgtgatgccttttatcatataaattttcacatagactaggatctatgttttagagttattctaagctctattatttgtctatcaatttgtattatttttactgttattgctttatatgctttaatatataattgtagggcaagtcccctaccctactttgctctttattttcaacactttcttcgctgtttttatatatttttgtttgcttagtttggtgatgacaaattaaaaataaactacttgaccaaatagttgttagatatgtggttacaggaagtgagaacacaagtggctctagggtaaaatgtgtctaagagaatatacgaaatataaagaactagacattaatctttttttccaattatttctatcgacaattatttttaaatttaaaatgtattataaaaataataatgcttattacaaaaagaaaaaaagaaaagtaaaaaaaaaaccattgttagtactttgggtgtatttcctttcaatcttttaaaaatgcatcttttttccttgatacccaattgaaaccatagcatatatttaattttttcacctagcacaataatacatttttgagttagttttaatttataatttagtagcaacacatactttaaattcttctatatattactaagaatttaatggttaaaaggtactcaacaatcatcaggaacaaggggttttagtttgaaagagagatacctatctaagtatataccatttatttaagcaatagatactgactaaatagcactatacaaacctggcaccctgcttatcaattaagatgcaaaggtgaaacagactcagtctgttcacaatctagcagttctaggtcatctttatgaatttacatgaatgaactatgttgtaattcacaaaatcaatttcagtttttaataaaatattagtgatatatctgtatttactctgattttgaatattaccagactccaattttgaatacaaacaactaataaaagaatgatcgttttagccttattattcctggttccaaccaaaataaacgttttaagtcaaccaaagtcagtactttaaataactggaggaaggttctggagagaaagatttaattatattattctagtaccttgggtctttttctgtgtaaaagcgttcattacgtttgttatcaccaaaagtggctcgatatacgtcatgacagcgaaggttcctctggaaggtgtagaataaaacatcttcatcttcctcgtcctttacccattctgaaagaaaataatgagataattatacataatcacctacactccattaaaaaaaaaaaaaaagcacagcacattctaattttgaatgccagtgagaacatgtgcaagtttatccctggaaatctaaatatttgactgtatctaatctgtgctgtatataagccagagagctttcctgagaataaaccactactacaccattccaaggtttcaagtagttatcagtctcagggtactcaggtttctaaataagagctaaatgctcaatatttaggaaagacattggtaaagtcacatttgcttttaggaggtgaattccgtctcaatctacaacttgaaactgtaagtctgaaggaatattgcatctttctctcatgtgtaaaccttctctgtctgctttcaagccacaggatatctccaactaccaaacacaatttaatgctgattcttgatcccaccagaagctgtcaacagaagtttgcacacaattacaccatgactgccacctggctgacagtgattgtaagtcatcattgtataatatgcaccatgattttaaaggttataaaatgtacaaaatatatgtcttagaattcaatagttagggtataatttcaattcactgcaacaacatttagttaaacaatggagaaaatgatggctgaaaatgaaaagggaggacaaaatgtaacatatgtaccactcaatgataaatttaaagttagttctattactaaaaatgtcacagcttccattgataaacaggttagttcaacacataccaagttctttggtagtgactttatgctgtaacagctctataagataacatgaaattaaaaaaatacattcaagcttaaagttgaataaaatattaagatgcaacttacgtgtaaaaatttattctagataataatttggcaaataattctgataaatcaaaacatattgtatgacatggactctaattataacacttttaaaaacatgagtattttaaaattacccatctagatatataattaaataagggaaggtctcctgaataagaggtacataggaagatgtatagtccatagggatacatgaatcaggcattcaccttctccctccctcacatgcgacaaaaaaatgtttcaaaagtgttaccgttgcctttcaacacagaggactattttggttggtggcttaccaaaactggacacattcgggaaagaagcttccattacgggctgatcgctgagctttataattacacaggtagatgcttcagaatcttcagttcttatcttggcagccacatatttttcatctggagcaactctgatacaatcaatgaagggctggtctaacttaagttcctccaaattgaataaaacttcataattatcattgtctgctgtataaagaaaaatacgaaagtgataacttcaaaggatgtactttaaaaaattaaaactgtattttaatgttttaaattagaattcccattctgtaagaggccatatcctagcttctttcaacaatgatggcagcttaacttgcacatcaactgacaataagttatttaatattaccttatactattcaatactattctgtgcatcaacctatgagacattatttgatattgttatagtctagtttagtatttacagaccatacagaacctagaaagtaagtgaatataaatgacaatcaacaatatatgccaagtgcctagcatagtacccaagacacagcagatgctcaaaaaatgctggatgccgtctccattctccctgccaaagcttctgagtctaactatatcttacacaaacccagatattaaaaactagtcattaaaaaaaaattcagaaataatctttaaaaaaatcttttctctatctttgagaaattaataaatttcctataaaaaatatgaaatctgaaaattagagcacgtaaaaagaaaaattgtggtgtaccttcttcatctttggaacgaaccaagcaacaaccttcttggtaataaacaaaaccaccatgtttaacctgacaaaagaaacatgcagtttacttaataataatttaattaaccttttcatagtctgactattcaagatgaagatgaaatgaagactcttataaaaaacagacctgttgaagtatatgaatgaacacatatgaaatataaaattgaccatttttacaatgtagttgataagatatggttttcgtatgttcataaccactagaggggtttttaatacataaatacaagaggcaataaagaaaaggtataacaaaatctgtcagttctcacaactgtacaaaccacttctgctacattttagaaacatctgatacctgtacagtgggagtcaattaacagaaatcaagtggcatctttaagacaatccaaaatgatgcagatgaggaaactgtggctcagactagcctgaaaacccagtctataactttctgagactccttcctttaaaatatgctgtcaccaacaactatacacagtcttgacttaacacaaactatttcacctgctgtagggtgacaaatacaatttgaaattgagagaattaatattacccaaatataaatagtgttcttgtctaatgcctacatattaaatgtaattgattggttgatatgatttcagtggcttacgtttattatctgttagttggtggcgtaatttgaatctggagatccttattcttaacctactatttccactctactatgtatgtgattttcacctattgcggttcaattttccaatcttattgaaaaattcaattcattttttcttttttttttgagacagagtcttgctctgtcacccaggctggagtgcagtggtgcaatcttggctcagggcaacctctgcatcctgagttcaagtgattctcctgcctcggcctcctgagtggctgggactacaggcgcctgccaccatgcctaatttttgtatttttagtagagatggggtttcaccatgttggctaggctggtcttgaactcttgacctcaggtgatctgcccaccttgacctcccaaagtgctgggattacaggcgtgagccactgcacgcacagccctcaattcatttcgactgactatttatgactgtgataaccataaaatggttaaacagatacttggctttcatggtattatactacttaaagtgaattccttttattaaaaaatttagacaaaacaatcaagtaattttcaaataataacaaagtatgaactactttcatttgaacttctccttagaatgattaaaaaatttttaaatcagtgctgggcatggtggctcacacctataatctcagcactttgggaggctgaggtgggagggttgcttgagcccaggagttcaagatcagccagggcaacacagtgagaccctgtctcttgaaattttttttttttaaatcggaactgattgtttgcaaaaaccagaattaatatattacagttgaaaattcatcttactttcgatctttacatttattaaaagatgtaaaggatcacattctgtgatcacaatctctgaaatctttgctttttaagtttttcagcatattttaaaggccaaaagcagtataatcttgatgtggactatgtctctaaatcaccaagtatctcatttgcatcttgattggtaatatcaaaaatttttttttaaagacatgagatatcttacttccacattgatgatttcatattcttcttgtggctgtgtttctaattttgttctcactttttcaaatgcatccatgttttctggaaggggtttttcgttttcttgtttaacaggctgaagatcctggaaaaagttttgttatgatcaaaatatttcaaactagggaaaaaaaacttttgctttttaaagataagtaggtctataccgtagacttaacgttgtacaaaaaagaaataagattaaatagtaggtatttcacagattgtaaatgttctttcctaggctcatcaataaaatgatctttttcgttaaaaaaagtaaacaaagtaagatagacatttgatggttatactattattttagatgaataagtccttaagaagcaggaatactaagaagctcagaagaatgttcagaaatactatggggaaaatttatacacaattaaggagaaaataaaattccatgaacttttacatatttaataggaaaatcaggtagagaaaaaaatctttcgcgtttaggaagtactgaagtacttcctaaaagaagggaaatatcaaagaagtggaagacattatcactactaataaatgttcactattattttattcacagccagagtgataagaaatatttccctacttcattaactataattttttactttttaaattttttaaatttaaatgggtctgagaaccaagggatataattttcttttcttgtgggaataactaagccccaaaacagaactgtttatcacatcaaaaagtaaactggcgaggcgcagtggctcatgcctgtaaccccagcattttgggaggccaaggagaatggatcacttgagcccaggagctcaagaccagcctgggcaacatagcgagaccccgtctctataaaaaaatacaaaaaaatttagccaggtgtggtggcacacacctgtagtcccagctacttgggaagctgaggtgggagggatcacctgagcccaggaggttgaggctgcagtgaagcatgatcatgccattgcactccagcatgcagagtgagaccctgtctcaacaacaacaaaaaaaagggaattaatgcctaatgaaacagagcttctttttcagtttctttgaggaaaaataacatgttcactttatgaaaggaagaaccaggaaaaataatagaaaataatgaacatgagtggagatatagatgaaagctaaataagcattcactgtgtcttatcaagagtgactaataagctgacagctttatttgagttctggtaagcaaattaatatcatataaatcattacaatttggataaagcaaaacctgttatcaaatttaaaaactgtttaataattcaacactccagtggtttgccttgtttaagcaaaaggattctggccaagatattttacttcagctctctgccaaagatgacaattgtacagtgatttgtaccagaggggggacttaagtctttggtaaggatcgccaacagctggaaagtatttattgcataaaatatgtccatgatactttaccaacattgtagagaatgtaagctataaatacagtttatattacaaagagtttacaatctaaaattaaacacaagaatataacggaaaaatcaccaaaacaaattaaatggaaaataatcattttcacaaaggttttccttttagatttttttgggacacattattatttgaattagattaaaattagcaataatggttgttatgatagtctcaatcatttagcctctacttactatcatataattttctgaattttttttaagagacagggtctcactatgttgcccaggctggactcaaactcctgggctcaagcaatcttcctgcctcagcctcccaagtagatgggactatagataggtgtgtgcctcctcattccatacagttaattttttgagtaattatttgaagatcaaatactggaggcttatatatttatttttcattcatttttaaagcatttctacaaaatctacagttgatctttaaagtggtgagacatgatatctgtatcaataatcccctcatatcaccatcataagtcagaagatgactaaaaatctattctgaaactgtaaaatagcaataggagctgcctttgcatttctagattcaggattgtctgttctgtaatttccattaaaacttttgaagtagagtcaggattatctctctactaccctgtagcttctagcacattctaggtcatggagctgggttctgtcacttttaaatactcattcttactgagagtcatagccaacacagagccaaaagcaacagagcgggctccaaaactcatcttcttaactttacattccttcctgattaacattttttctgtcatatatccaaataaactgagcttatctgaaccaaaataactctgaaagcaataggatttttgactcccttaacgaaattcaagcagaactcaacagctttctaagtaactcttctaaaggaattactcccatggaaactgaggttttatataatattcattaagtactccaggttacttttggtttttgttgcgtcccagggatacctgctcagtgttttaagctttcatttcaatttcagctagcaatatcattagcgtacacagctaaagccatccattttagccaggtatcttagtccagttgtttcaaaggcatatactacccaatggagctgaggtaaggatggctttaccttcagattttgagaaggttactggtacagtatcactccattagtggtaaaaagaagcactccttcccactccccaagtgacccaccactaaatcattttaacaatgaaagctgttataaaatagaaggagaatgatatgtgttaactttatcatggcaaagatgctgaactctaaagatagaaaaaatggtgaagtagaaagacaccggacagcccttcagtcaagactaattagccattagtaaatggctaattctaaggctagagcagggagaaaatacatggtaggtttgggaaatcttatgccagaaaataaggaagtgctcaaagtttaatggagacatgtcaaaagaatacaagtgtcaactgaaggggtttctacaggccacattttggacaactggagcctcaaaaagaataataaataataaataatacattgaaaaaacataaatccacagcaattgaaaaacagaatgcaatatgaagcatttcaatttaggaaaacagaaaaagagtaagtcttaaggaagtagaagaaaggtaagaaaattaatttttgaaattaaattgataacaaagaaactaaagagaatcaaattaaaagttggttcttttagaaacctattaaaaaacaaacatcacaaaactgatagaaaaaagaatacgaggccgggcgcggtggctcacgcctgtaatctcggcacttcgggaggccaaggcgggtggatcacgaggtcaagaaaaaagaatacgaggagagaaaaaggcataattacagatacaacagagatttttaaaaattacaataagctttatgtgaatctatttgaaaataaatgaaatgggtaattttccaggaagaaaaattaccaaaattgacccaagaaatagaaaagctatataagtcactaactcttaaagaaattaaattgctaactaaatgtccccttcttgaaagaaacaccaagcccagatgctttcaaatgtagctttcttggatcttcaagaaacagctaatcttttcatacgtcaactatttaaaaaaatagtaaaagaggtaaaactactcattttattaggctaatataaccttgacatcaaaattagacaatgatgatatgagacaattaaaaaaatcaatcttattctaaaataaaacttgataaaatcaaatttttaattttaaaaagcacaaaataagaacagtaatagtaataccaattaaacttaatgtgaccaagaaggattttttcctaagaatgaaaggatggtccaacatcagaaaaaaatctatcaatgtaatctaacacaaataaaggagataaatcttagagccatttttgataaatgcagggaaaaaataaaaaataatcacactttaaaaaaatgataaaaccttaaattaggaatagagaggaacttccttaatagtttctgtcagttatcttacacagaaatatactaaatctgtaatcaaaatacctgaaattaattcatattagcatatacatggtatttagcaaccatgaaacaccaatgagatttccaaaattttaataatgttcatgtaaaacaactaattgtatttgctgttaactcattttattttttaaaagcaactgttaaatgaaggaaacttgttcctttcatcttctgcctccaattcttctccttaccccttctctagagcccagacttttgctcttcttatgccactgactgctcctgtcaaggtcactcaatggctaccacattgcaaagtgcaaaagttaatgttcagtattcatattacttgacctgtcaggatcatgatacaattgatcacttcctcctcctaaaaacacttttctttacttggcttccaggacacctcattctccttgttttcctcttacttcactggcccttccttctcagtatctttagctagttccttctcaactccctggctttttttttgtttgagatgggatttcggctccctgcaacctctgcctcctgggttcaagcgattctcctgcctccgcctcctgagtagctgggattacaggcacttgctcaccacgctggctaatttttttttttttttttgtatttttagtagagatggggtttcaccatattggctaggctggtctgaaactcctgacctcaggtgaaccacccgcctcagcctcccgaagtgctgggattacaggcgtgagccactgggcctggcatctccctggctttttaacactggcagagctcaattcctgcactaagtacttctcttctttgcagtctgcactaattcccttggtgatctcatccagtcatgaccttaaataccatttatatgctaaggactcccaaatttacagctgtagcctgaacaatcctgaccaagatgaacttgtatatccaactgactacccaacatttttacttagatgtctaatatgccaaaaaatgtccgaatctgaactttaaatctccccatatatccctcgccctattaaaaaaaaaaaaaacaaaaccctgttctccaggcaatctttccaatttacataaatgacaaatctgtcctcccagctactcaggcttaaaaacattacagttggatttgtctttttctcttgccacaaacaactggtctgctaaatcctctcaattctactttcaacatatatttagaatctgaccacttctcacacttggactggactacttggctagtatcatcatcatttctcccttggattactgcaaaagcccaaaagctttctctgcttctgcgcttgcctcctggtctattttcaacaaaggagcttgtgtgagtctgaagtcagattatgttactccactcaaaaccctccagtggtttcccatcttgctcaagaggaaaagcaaaaattcttacaatggtctacaaagtcctaaagaatcttgtcccattacattgctgacctaatctactgctacacgccaagcccacttattccagttaatccatacttgatgtttcttgaacatatcaagcttgctcccatatcagtttcttagaacttgggccctatgcccaaatacctccttaaagctattgctcaaatgtcatcttctaagttaggcctttcctaaccattttactaaaataacacccctccctatccccacactgcctattcacatcttccccgtcttttttttcttttcttcttcgccataactatcgcttttgacccactttgtatttcattcatgtaattctttttatttttttgagagatgaggacttgcttgtgtccacctcagctggagtgcagtggcatgatctcggctcattgcaacctctgcctcctgggctcaagcaattgatccttgatctcagctctcaagtagctgagactacaggcgccaccatgcccagctaatttttgcattgtttgtagagacagggttttgccatgttgcccaggctgttcttgaacttctgggctcaagcaatgagcccacctcagcctcccaaagtatattacaggcatgacccattgcacctagccttgttcatgtaattctttattctttctcttttcctttctcaagtaggatggtaagcttcacaaaggcagggatttttgtttattttgttcagtgttatatctccagtgcctagaatggtgcatagcaggtgttcaacaaatatttgctgagttgaataaaattcagacagcataaaacataaaatgaaaaaaacatatttaacaaaagatatcacaaagtgaaaaaaataataatagaacaaatatggagaagatatctacagcacatataaaagacaaaggacacgtaaagaaatcttatgaatcagtaagaaaaggacagacaattaaaagaaggtcaaaagacaagaataggcattcaagaagaaaaactataggatcaataagtgtaagaaaagatgctcactggccatgagtggcagctcatgcctgtaatcccagcactttgggaagctgagacaggaggattgcttgagcccaagagcttcagaccagcctgggcaacatagcaagactctgtctctatttaaaaaagttttggattttggagcatttcagattttgtattagggatggtctacctgtactacaagatattaaaaaagaaaggtactgtgaatgaggctaacttaggtctacttctgactctactagttttcttacttaactttaggctctgtggctttagtttcttcatttgtttagaaagaatacacacgcttcctgattttaagacttattacaggccaggcgcagtggctcatgcctgtaatcccagcactttgggaggccaagttgggcagatcaccctgaggtcaggagtttgagaccagcctggccaacatggtgaaaccctgtctctactaaaaataaaaaaaaaattagctgggcatggtggcaggcacctgtaatcccagctactcggggggccttggcaggagaattgtttgaatctgggaggcagaggttgcagtgagctgagatggcaccactgcactccaacctgggcgacagagcgagactccatctcaaaaaataaataaataaataaataaaacttattacaaagctatagtaattaaatgtgtagtactggcataacgacagacatatacaaaaatgagatgaaagtgagagtcaagaataaaccattgaatttatggtcagttgattttcagaaaggacaccaagacaattcaatggaaaaagaacactcttttcaacaaatgttgctcagacaatggatatccacaagcaaaataataaagttgtaccccaatcccttgcactataaacaaaatgaactcaaaatgggtcatagggctgggcatggtgggtcacacatgtaatgccagcactctgggaggctgaggcaggaggattacttgagcttaggagtttgagacaagcccgcacaacaaagtgagaccctgtctccacacacacaaaaaatcaaaaaattagctgggcatagttgtgggcccagctacttgcaaggtaaggcaggaagacagcacgagcccaggaggttgaggctgcagtaagccatgtttgtgcctctgcactccagcctgagcaacagagtgaggccctctctcaacaacaacaacaacaaaaaaagtatcaaagacctaaagaaagagctcagatgggatgatttctggggtatgttttctagcaataaaatttatggttatatgaaaagaaaaaatgcattaatttaactattaattcattctataaacacgttgcttatctacaatgtggcagtcgttatgctatgtgctggcaagatgtgtattataaaattcttgtctttaaggacctcccaatataatggggagacaggaaaagtttaaaatgatgtagtaatagcagagaggtaaatatagtgatttgactcctatggcttcaactactatctacatgtaacaactctccccaaattccagactcatatatccaactgctactgaaatctccactttactagtgagttatatttatcctttcctcctctcttttttttttttgagatggagcctcgctcccatcacaccaggctggagtgcagtggcacgatctcagatcactgcaatctccacctcccgggttcaagtgattctccttcctcagcgtcccgagtagctgggattacaggcatgcgccaccaggcccggctaaaatttttggattttcagtagcaatggggttctgccatgttggtcaggctggtcttgaacttctgacctcaggcaatccacccgcctcagcctcccaaagtgctaggattataggcgtgaggcgccacgcccggccttcttcacccttaagatctgaatatcagtaagattacatacatgactgtgaaataagtccatctgaaacataaagataaaccaggtacgttttagaattttgagattttggaatgttaactgggtaccttatctcagtttacaggggaacaacactctaatcaaatgcagtaacattttagagctaaacatctactaattgggataaagatcataatagctttgtgtcagtttaggtcaggttttgcccattctcaacagcctccaatcagttaaaaaaaatcatttgttttctaacaggcttttggattttagaatccaaagagatgaggaattatcactcaagctctctagtcttccattaagatgtctcaaataaaatgtaatcagggccagctgcggtggctcatgcctgtaatcccagcactttgagagggcaaggcaggtggattgcttgaggctgggcttccagaccagcctagccaacatggcgaaaccctgtctctacttaaaatataaaaaaattagctgggtgtggtggcacatgcctgtaattccagttactcaggaggctaaggcacgagaatcacttgagcctgggaggtggaggttgcagtgagcagagactgtgccactgcactacagactgggtgacagagtgagacactgtctcaaaaaaaagcaatcaccctgtaaagactctcatcttcactcatctgagttactgacaaggcttcctacttccaatttattctctattctgtcagagtgattcttctaaaatgcaaatctgattgcgcctacatttttcaataacattctattgcttaaaaggatgtagctcaaactttttgcaagatatacaaaactacatattatatatatatatatatatatatatatacacacacacacacatatgaatatgagactattgcaggagctgctaacctgtattgtagaaataggcaaatgacatgtttaaccaaaggatttagtcttctctctttaattatacaatttcattttgtatcttgttcaaattatcactattaaagattttgggaattattttttaggcagagcagagcaggatgatgtggaagataaagaaatgtgatatctggatggatggatgctagtctttgaatatcactggctggcttgtaagtataatagagtaagttcatcttgccatctggctaatgtaaaatggaaagcagaggtacttgccaataagaactgcagaactgaatgaattcaataaggtttagatcggcaacacttgatcatcaaacatttccaatttctaaattcaggtccagtgtcagtcaagttgtgagttccagaattacctgatgtgaacttcaaaaaacagatctggggccgggcatggtggctcactcctgtaatcccagcactttgggaggccgaggcaggtggatcacctgaagtcaggagttcgagaccagcctgaccaacgtggtgaaaccctgtctctactaaaaaatacaaaaaaatttagctgggcatggtggtggacgcctgtaatcccagctacttggcagctgaggcaggagaattgcctgaatctgggaggtggaggttgcagtgagccaagatcatgccattgcactccggcctgggcaacaaagcaagactccgtctcaaacaaacaaacaaacaaacaaacaacagatgtgtaggcctcaaccatagagattttcattacgcagatgtggggtgagatccaggaatccgcatttctaaaaagctctccaggatttctgatatacagttagactgcagaagttgatactgaagagtccccaaacttttaggcagtaatttgttgctaaggtaacaagaggtatagaatcatgaaattttagcacctctaagactttctacagaatgacaagttgaaactccctatttttttttttttgagacagggtatccttctgtcacccaggctgaagatctcactgtgcctcaacctcactgcagcctcgacctcccaggctgaatcaatcatcccacatcagccttccaagcagctgggattacaggcgtgcgccaccatacccagctaatttttagtctttttggtagagttggggttttgccatgttgccaaggctggtctcgaattcctgagctcggacaatctgctcgccttggcctcccaatgttctgggattactggcgtgagccagtatgcctgatcagaactccctatttttttcagtcaggaaaattaggagtcctgattagttcagtcacaccaatcgtggctggatcttttgccttctaacattcccactacacatgctacttttctgttccttagttaacttatataggtaatagctctttaagcagacattttaatttacctaaaagcagtaactactttttctactttattacaccctataaaagtggacagagttggaaatcagtggatgcttgctgaaagaaggaaatgtgcattcttctctacaggtgttttcacagctgccggggcatctttataaagcttccccaggtctcagtgataaagaccatggcttttacattacatcatttctcatagagggaatggttgatacatgacatgtgacagcaggattactttatcaggtaaaggaattactaaatgaactattaatacttggagttattgagtcaggttaaagtttccaggtagtgggaatctataaaagagaacggaaaagttgcttcaggaacaaatggagggaagaaatagtcaaccttctgtttagaatgtgagctaatatcacagctgttactctgatggtaattcctgtctactatttataaactaagtgttaagacaaagtacgacatgacaaaatgttctaaacacaatgcaaaataaaataacctaaaggtccaaaatttagttcaataggtgaaattaaaaattttatctttctgaagtaggaaagatgtacaaaaaacacaaaaatgaaataaaaagaagttataaagaatttctaaatgagtaaagaaagtactaaactaaggcaagacactacaaaaaggaaaagaatttcaaagactaaaacataaacagtaaaagtctaggaagactagggggctaacatataaaatgttaaaagcaaaagagacacacacaacacctaaataggtatcagctaagatagcggcaaaaattgaacaaaaactagaaaaactgagaaaaattagattgaaaagatagtttctaaaatgagaagaatctgcccaagtgtccatcaattacaggaatggataaacaaaatgtggtttatacatacaaaggaatattattcaactataaaaagaaatgaagttatgatacatgcatacaacacagatgaactttgaaagccactgaattgcatactttaaaatggatcaagtggaaaactttgttatacatatattttacccgaagaaaggaggaagccaaaacagactaaaagaaaaatcagtatgcgacaaaaccagaaattaaaataaaaaaaatattaaaatcataaatttgtgaaactattgcaagaataccacccccaaatatcattaaggaacctaaggaacataagaagtaaaaggtaggagagggatgtcaaagcagcagcagcacaaatagatcatttaatcctacttactgtaggatgaccatataatttaccattctaaccaggacacttttgagaggaaaggggacactattaataattacacagggacaacaggtgtaggctggagctgtgccaggcaaaagtggttatgtggttactctctatataagggcaatcaggtccttaaggttgagttcacgcccacagcttggggtctggcagaagtacaatactctgacagtgtcttcctgaatgactcaagtggtcaaaaacgcaagattatttttcatttttttacagagaaataaaatacaattcatggcctttactgaagtttactgatttgtgattcataaaacaattagcgtatcattagattttattaagagctataatttagtgttctaggaaatttagaaggccgaattatactttgaaatgcactggcaggcatactaaggaagtcctgaggtgaatcattttttataaacctacatttttatatattacattagagccctataaatatatgtatacactttttttttttttttttttttcagacagagtctccctgtcacccaggctggagtgctgtggtgcgatctcagctcaccgcaacctctgcctcctgggttcaagagattctctgcctcagcctcccaagtagctgggattacaggtgggtgccatgacgcctagctaacttttgtatttttagtagagacagggttttaccatgttggccaggctggtctcgaactcctgacctcaggtgatctgcctgcctcgatgtatatactcttttatacttacttttgactagagacaattgagacttgaaaattagaaaaatcaagttagaattactgagaaaattagtagctctgatattctacccattctttatttttaaattaaaattaatcttaatgacctacaaataggttaacttaaacagtccataccttacatgagaagctccgacttgggatgtttcttgctaactctgatatcttgggtttattctgaagacacttggttaggtgatattttttcaattttattctattgtaacaatgatcagcgaagttatagtgattcaaatgctgtttctgcatgcattttccaaggtgaggaatactatacttcaaagcttggagaaataatttggtcttctgctgcatgatatcaaagtccctggtttatgctccttttggg

SEQ ID NO: 2472 - DNA, 44255 bp, Homo sapiens
tttcaagtggtcataattttaatggtaaaattaggacataaaaataattttcaaagaattattttcaaagaacactagacataaaatataacaattttcaaattttcaaagaatactagaagaaaaaaattatacagtcaatccaacaaaaagcttaatagaaaaaaaccctaaacaatagtataactacaaataaaatagggcttccgaattatgtctaaataatacaataattacaaatatgaatgggttaaattagcctattaaaagataaaaccactcagataacaaaaacagacataagaaacactaacataaaacacaaagaattaaaatgaagatatagcaagcaaataatagaaagcttgcaacccagctatagctataaacacaaaaaatgaagttatcttttgacctaataattccattcctaatacttagaaatatttgcacatgtgcacaataatacttaaaggatctcaacactgtttttttttttttttgagacagtcttgctccgtcacccatgctcgagtgcagtggcgtgatctcggcacactgcagcctctgcttcctgggttcaagtgattctcctgctgcagcctcccaagtagctgggattacaggtgcacgtcattatgcccgggtaatttctgtattttttagtagagatggtgtttcaccatgttggccaggctggtcttgaactcctgacctctggtgatctgtctgccttgcctcccaaagtgctaggattacgggcctgagccaccttgcctggcctgcaaaatttgtttttaatagaagacacaagaaatgatttaaatattttatcaacagaaaaccagttctatcaactatgggcccagtatgcagcttttaaaaatgacagttctatatacattgatatgagaccatttcaaacaggtattcaataaagtatagaatggtaacatatcaccaactgtgtaaagaaaaatatataaacatatgaaatgatacattctgtgcctatgcaaacatatgatacattaaaaacaaaagaacatatagtgcctgtctctgaggggaactgtgaagctatggaaaggtgttgaagaaaacctttttatagtatgtattcttgtaattgaataaaaaataaaattacaaaaatcaggcttggaagtatttaatagcagacaaaatatagttcaatatgaaaagcattatatgagacaaaggcaattttcaaaaattgataaaacattccaccaaaaatcatgactacgcatctaacagcttcaaaatatagaaaatactcaaatgcaaaatcaacaaatctgcaattacagaaaaagacttcaacatacttttagaaagtagtaactcaagtagacaataatagctaacacttaccgggcacttcttatgtgagtggcactgaaacatgtgctttcatgcattacctaaggctagagaaaatgttaataacttagacaagtcatacatgtatcataaatatctttgtacctgacaaacagaataaacatctttttaaacaccattagataattatttaaagaccacatattgggaacctacccctaaagaacaataacaaccacaataacaactatcaccccagtaaacatggctggcaagaatacaattaaatgaacattatcactgatttggcaacagctcttatgaagaataatttggcattatgtatcaagtgcccatactctttgacaaagtaactgtctttctgataatctatcttaagtaatacaaaaatggggggaggggaataaaaatacaaaatattagaaacactatcgtcaaaatgaaagggcatggctgagtatggtacaaccgttcaacagaatattgtcattaaaaacatttatggaggctatattatatagtcaataacagaaaatgcttgaaaggttagaagtacatcatcaaattatgttttatatagctgtaaaataaacccaaatcatctttaatgaacacatactattatggtaaaaaaaagtctacaatttctaactttcaccttaggcagctttttattttgcatcctttttttcaactttgtcttctattagctgtgcaagaaatacatgtctgctaaagttacacgatcttcgcacaacagcaacctacacattagtctacaaaggggaacaaacccaaattcctcagaagtctgagtccactgttgccttctttctggccatctggcagttacaatatagcacagaatgactatgcaagttaaatattcatcttagacatggacatttgctttgggactcctaaagtggagtcaaatttgatctctacagaaactctacaatgtagcagagcactgtgcgtacttattgactcccagacaagccgaaaccccgaatttgtcatttctatcagtttttatataaattgttcttacctacttattgatgcttacaatttggcaattataaggggcaaaattggagcaagtgttttgggtaaataactccttacaatatattaaaaatacttacaaacaattcttagaatcaaacacttacgtaaatacttttttaaaaaaataggtccaaaagactcagcccagatcggctttgaagttatatcaagatttaagtctacttcatgccaatgagctactcctcaacaggggctggttttgccatttgaggaatgacagccactatgttgtgtacacaagagagctggatggcatcgacagaatctttatcgtggttctgaattttggagaatcaacactgttaaatctacataatatgatttcgggccttcccgctaaaatgagaataaggttaagtaccaattctgccgacaaaggcagtaaagttgatacaagtggcatttttctggacaagggagagggactcatctttgaacacaacacgaagaatctccttcatcgccaaacagctttcagagatagatgctttgtttccaatcgagcatgctattccagtgtactgaacatactgtatacctcgtgttaggcacctttatgaagagatgaagacactggcatttcagtgggattgtaagcatttgtaatagcttcatgtacagcatgctgcttggtgaacaatcattaattcttcgatatttctgtagcttgaatgtaactgctttaagaaaggttctcaaatgttttgaaaaaaataaaatgtttaaaagtaaattatggcttataggagcttataactttattcagatagcatcaatcagggatgaccagaacacattaggaccccagattattcaaaaactttaacgaattttaaggggaagaattttatcttttcccttaaaatgcagtcatagaaattagaggatgactcactgccacagtgtctaaaagcatttgctagcaaagaggcaggacactaatttgtaaactgctcaactgttctgactggaagggaggcctggagctctgctatcaccaatccttcccttccctctactccacatccttctaaggagcatgatttgaaaattactttcctaggttaatgggcatgtgcatcaatggagagaatagtataagcaagtgagatgtagactaagcaaaatttagatggagaagcacattttaaaaaattaataacttaaaagtctcaagttattaattttttttttgctaactcaattggaagtaagactatgaaatatttcagtgtgtttccaattcccagttgaatgcagtgtttcagaatttcaggtatttcttaagatcctcgaaaacactggtgctgtcaagtccaagttcctcgtacaggaatttaatttgggctgtaatctaaaagaaacacattaaaaaaattaaatagaaggcctttgtagtaaaatgccactgtttaagcttctctttatctatccatctttacctaaccgtgaagtcagcaatttatggcaagaatactttcattcgagagagaggcagaaggcttccaacaattaagattaaattattttctttaacagagctcacgtatcaagtacaagagagagacatttctcttgattgacacagtgtccctccctcccctcctgggtctcacccatagataggacatttgtgaagtggctttgtcataaacctgctgcaaccactgaaaatgtgaaaacaacatgtatctagttcgggaatctgtccactgagagggccttgataacatacctttttgtgagaatcctcaattacatgattgcctccaggctgaatatctagaataatattaggggtctgatagcctggaagagttaacatgtagaacaattagaagattgtatgggatcttctttggaagatcgagacccattcctcccctcttctttgagtactcagttcaaataatagtaaaggaataaaaagcaaaaaccaccatcatcaacaaaaagatgggaggggacaagcaacagaagacaaacttctgacacagcgaaagcaggaagaggccgtatggaaaagactatatggtgccacacggacaaggttgaaacccaggagatcatcaacctgccctgtggaatctgagagtcttatgccctggaaacaccaactacagcaatggatgggggtgacaaatggagatgaatacagggagactgatatggcatgtagtttcaaggcaaaagggagggattcttatctcataaagctgaaacagctagctagaggaaattcatgcagctaaacagtttgggcactgatggcccaaaacaaaaatctcagaatctgtcttttagagattcccaagaataacggctcaataaatattgttaaatgaattaataattgtatggcagtgcatctccaagttatatctgattcttaaatttcctgtttcctttgtgtcctgcctatctattttaatactgtcctttgaaaaagaggtgaggcagtgtatgtatagacatgtagttacgtacactttaactggggagtcaacatagcaaaataattgtttgccctaaatcctgggcagatgatttggctacagcctgaaatatattcctctgagcagtgtgctgtgggtagtagtctgtttggccatgttccctgcttctagggggtctcctaccttcacctgtgtccttagcatgctccgcgatggcttccttgagtttctcagtataacttacaattcctttcagaggtacccgttcatcgttttcatatgccgttatgtgaattgaaggataatgctgaaagaaaatacatgcacgaagagtttacattatttcttatggtcccttgccactatagagactatgaaaaataattacctccaatttttccctgtaagtgctctatgctttttctcacttgctatcttgagagcgcctcagtattacagtagtagactacttgttatctggaatagccttttcttgactaaaggaccttagctaatttagtaattaaggcatgataagtctattcccctgaggtattaaacatggagcatgagcagagatggtgctgaagatatttgggcatcataagtagaaacatctctaaagctcctatttttgcttcagcttggataagttttttttttattatcttctgtgtaaattcaggataatctaacacaattgtctttcactacctgaggtttaatattttgatagggacagtaacgttttatgtagttcttgtgtttttcatcagatgaaggattcccccattcttctaattcttctaatgtcagaggaagtgtagtgtccatcatggtgttgagaacatccaagaaaggtgcctaaaaaaaaggcaaagaaacttatacttcaagtaagaggttggtaagtgagtttcagaaaaacattctattttatgaatatacatactaatatgagagaaaataactcaagccatgtagattcctaggagctagaatactcagtccttaaccagggcctgtaatttataacctacttttaaagtcttcagattccttaaatgacatataacaagaaatggtttatcttctaatttcacaatatttatttttagcttagtaccttttattcatttatattttttcttatataaaagcaataaatgctactgtctcataccaattaggacagttagttattatattaaaacaacaacaacaacaacaagtattggcagtaatgtggagaaaccggaatcctgatacactggtggttggaatgtaaaatgggggagctgctttggaaaacagtatggtggttcatcaaagagttaagcttaagattaccatatgatccagcaattccactcctggcatataatccccaaaactgaaagcagggtcttaaagagatctgcatacctatgttcacagcagcatattcacaacagccaaaaggtggaagcaactcaagtgtccattaaccaaagaacgaataagcaaaatgtggtatacacatgcaatattacatggaatattattcagccttaaaaatgaataaaattctgatccacgctacaatatggatgaacctcaaggatataatctaagtgaaataagccagtcacaaaaaattttgtatgactccacctatgtgaggtgtttgagtagtcaaattcacagagacagaggctgtgggaagaagcaaatggagagctgtttaatcggtacagggtttcagttttgttaagatgaaaaacgagttctggagattgactgcataagcctatgagtgcacttaccactactgaactattcacttaaaaatggttgagatggtaaattttatggtattttaccataattaaaaatttttaaatgaaaaaaatacacaaggaataaagtctttttgaccagttggacattttatattaaaagcaaaaaacgctaagtaaagaaactctgcaaaatacccaaggtgaaagaagagaaaacaacccattggcttataattagtgttacaaaatttaataaaacgaaggctgggtcgcacatggtggctcatgcctgtaatcccagcacattgggaggctgaggtgggcaaatcacttgagcccaggagtttgaaactagcctgggtagcatggtaaaaccacatctctacaaaacaacaacaaaccacaaaaattagcagggcatggtggcacatgcctgtagtcccagatactcaggaggctgaggtgggaggatcacctgagccccagaggtcgaggctgtagtgagctgtgttcgtgtgccattgcattccagcctgggtgaaagagcaaaactctgactcaaaaaacaaaacaaaacaaaacaaaaaaacaaaaaccccacaaaaacaacaaaacaaaaatgaaggctgtatttttcacttagctttattttcttctgttaacatactttttagctttccctcatattaacattaaccaagtatagtgagtcatctgtaattctttttggctgcctaccatatgaacttttttgcatttgaaaaacctccaaccttatcagctagagcctgcctctcactgtggagatactaagtgctagacttctctttcccatttttccctgcagcttgggagtagctgtgtgacccatgtgtgacttgggtctatcaaccagacacatgtgctttacactctgcatggaaagttagtgattcaaagaagcagtgatcacagataatttattctggcaaaagtgccacagctatatccagctctagaagttgcactggcagtgtgaggtgatttgtgcttggcagtggcggcagtaatagtttcattgggccaattctatgcctttggctctgaagcctctaacactggtctgaagacacctacattttcctaatgccctttaatcccttttctgcttaaattagggttgatttttggtgcttataagaagaatttgacttatacatgtataaaaggttgtctcctagtcttcactataataagcaacctagcataaatatccttctcatcatttccttttaaatttctaaaagtcaaaatctagttgctttgtctttaaactgtaaataattctgccattatctttgtgcataggctattctccacatttttctgtttttaaaaaatagacttacaggtgactactatttaacacttatttacaagcccacagtataaactccccaacctcaaaataaaaaatcctgaaaataatttactctctcccatctcagtcattatttttcagagtaacctagaagtaggagaatgatagcagtgaaaccaactgctacaatgtaacttcgtaatttctgacactgggaaaagataatcattttcagaacagggtaagatatttcaattaaaatacggaaaaactatgcccaaacgaccattaagaatggactatctaaaaataaagagcctataaatctaggactgaaatgttgatgggcagtagcctgtcaaggtgaccaggagccaaaggactcagtgcattccagagtcacagcgtgctttgcctggctttctcaactgggactcatatatgcttcagtgctttttcaccaattctaaatgtccttacaaatacaaatgagcaatggaaatagccattaatatctttcagtggaaagccttaaagataataaagaacactgtatcagagaagaataacggttaatagttggattaaaataactttagaagttctcctcaagctataattctgagtttaaaacttaaaagctttgttatactcctatgctatggtaaaactgtaacagaaatgtttttctttccttttttttttttttttttgacaatgtctcactctgttgcccaggctggagcacagtggtccactgcagcctcaacctcttaagagatcctcttaccaacaagcctgggtaggtttttttttttttttaatttcttgcagagacagggtctcgccatgttgcccaggctggtctcgagctcctggtaagcaatctgcccacctcagtttcccgaagtgctgggattacaggcatgagccgctgtgccagcccaaaaacatttttcttagagtagcctatggcttcacacctcccccattctataaacagtagagacagagcgtactcacctccaaagtcaccgctctcaccagctctggattagaattacacaatgctcctgcaagcacccctccagcactgaaagcagtcagggttgttagacttggctgagaaaagccttggccatgaagcgtcttaatgcaagcctctaaatcagcaaggccattgagttttttagttaggcggccatcagcgtgccactggaggcctaactcaccaccacctctgaaattgaagggcaaaaaagttttagtggaaaaaaaaagttaatactgtaggctggggtcagcgaactacacctggaggcctgttttttgtgtggccctggagctaagactggtttttgctttttaaaggttgagtgaaaacaaggaatgtgcaacagaaactgtacgcggcctgcaaagcttaaaatgtgactatgtagctctttagagaaaaaggtttgccaactcctgatatagacaatccagaattgattcaacgaatatattttgagtgcctgcccatttatcagggattaagtacagaccttaaaagtagaaacaaacgaaaatcccctaccgtggagaagacagtaattttgtggggtaagaaaacaacgacttacccagcaatgtggtgtcattgctacaatacaagtgtatttaaggtattacaggagcagaggaaagaacatccatctgccaggtgaggggtatatacacgagtcaggaacacaaatgcttttaaggagatgatgcctaaactgagttgtgaaggaaaaatttgagtttccagagggcaaagaaaaggcattaagacacagatacgacacagcatgtataagggcaaggaggtgacagagcatgtcatttaaaagacatgactttgggggctggacacagtgcctcaagcctgtcatctcagcattttggtaggctgaggtgagcaggtcacttgaggtcaggagtttgagaccagactggccaacatggtgaaacccccgtctctcctaaaaatagaaaaaattagccaggtgtggtggtgcgtgcctataagcccaactactcgggaggctgaggcaagagaattacttgaacctgggaggcggaggttgcagtgagcggagattgcgccactgcactctagcctgggagacagagtgagactccatctcaaaaaaatacaaaacaaaataaaaaaaataaaaggacatgattttggaaggctgaggcgggcggactgcttgagctcaggagttcgagaccagcctgggcaacattggaaaaccctgtctctactaaaatacaaaaaaatcgggctggtacggtggctcatgcctgtaatcccagcactttgggaggctgaggcgggcggatcacttgaggtcaggagttcgagaccagcctggccaacatggtgaaaccccatcgctacaaaaatttcaaaaattagtcaggagttatggcaggcacctgtaatcccagctactcaggaggctgaggcaggagaatcgcttgaaccctggccaagatcatgccactgcacactccagcctgggcgacagagcaagattctatctcaaaaaaaaaaaaaaaaaaattcagacagtgtggtggtgtgcgcctgtagtcccagctactcaggagcctgaagcatgagaatcacttgaacctgggaggcagaggttgcagtgagccgagattgtgccactgcactccagcctgggcgacaaagcaaaactgtctcaaacaaaaaaaaaaaaaaaaaaaaaaaaagggtctgatgctaaatgccgctacagagatccatcagaccattaggagtattatactggggaatctggactgtgttctagagatggggaggtggagaagaattttaagcagaaatacaaaataatatttgtgtcttgaaaacagctgaaataaaatggaagttaaatggaaaacagttcagattcagaggctacttaaacctgaattcaggagaactgaaaggaaataataatattactaaataagtacagagtctggtacctctatgcaaaaatcctaaaaacctatccttttgctttttggatcaactaatctgttaaagaatcaagtttcaccagtgctggtttaggaatacaaaaattgaataataagaatgaaaaaaataagcttttgttccctgatatatattgttattcttgacatctctcacaatggtctagcacttacatgccaggtaaaatatactgactcaccgaacatggcagtatgctaatatccatccatcatccaccaggacccgcctctcaggcctgaaattcattttcaaatccattccataagctccatatacatgtaccaagagaggtttcttctgcaagtcctcagagtcagttttgtggaaaacagtcattggcactaattttccatcctagaaatgaagaattactatgtatgtaaagaagagtcttttataataactgttttatcccaatttaaaatacattgaggtgcactgtccccacttgtgtgctacctactgatgttgagcacaaatttgtttaagaaaaagaattatggtctctaaaaataaatcatggcttttggtttcagctaccttgctgtcctacagtattaaccagaaaagagcagcaagactggcctgaaaacattttattaaatgcagcttttcatgacaataatgtaattttaaagagttcttcactacctactataattttaaattttcagatgaaaccaaaatacttaccaaggttagaagtcctagtatagcactcttcctatgcctaagagctagatattggcatttttcacttttgagtatctacaaatatgctgactaaagtcttaccagctcaattttctatatcctctgtagtcggaattctcaaccattaagacctgaaatcttactgatgttactgataactaccacaatcctcttcaaaggcccatttaactttattaaaaaaaatttaaagtggtcttaaaatttttcggtaaaattctttgtagggttaaagtaagttaaattatttgtaaggttactaagttacttgtaggttatgtaaccatcccccaatgtagctcaaactcatcagttccagttgattgaaactaggcagtctctgaacagacaaaagaactaattctgatctacctttcacacaaaaaagataaagaaattggttttcaccctgcttaaactaatgaaatagcaccgtttacataaagaaaataaataatacatccaagtcactcttcatattttcattctcattttgaaaacttcactttggggcaataactggagacagcaaaatgtaatcaaataaggaggaaattctcctctcattcttctttaaaatacccaagttgttatgacattgttaactttcacttttagtaagattcacttttataaaacttgatgtagattaatttctataaaacactcttggtcttttcacttcccaactcttccccaacttcaattatacaatcagaaaaagttgcttgttgaaaagttttgaaaggaagaggtaaaacagtagctactcctgtgatgggctggatctgggtttgccagcagtactaaaatgcctgtggaaaggtatagcgcttccattcagcagctgcttcccttctcccctcttggctctccaagaacatggtgcttaactgttctttccatctcgggtccaataattgcaacattttgatagactagtctaattccatgtttgtaaaaccaaataaaacctatctaaaagataatacactaagtgggtaacaatgattatttctaagaggtgcagcaagcaaatggtactgagaagtagtcatttaagatttgttctgtatttttgcatctgttcaacaagcatgtattgcttttgtaatataaaaatattaatatttacttaaagattgtcagagaaaaataaatgaattaaagaaaaaaattcctaagaataaaaggcttgtgttgtaattcattgtgtcagcacatgtgaaattatctgatatatgatatgctaaagtctgaggtttccttaaattcaaggctatagtttacatattaatttgttccctacttgcataaatttgtatattctgtatattgagtatacctggaatatggatatttgttatttccttttctgtgtctcatctctctctactcctcaccctgccaatcttccctcttttacttgattttggccataatggcctcctttatatttgttctttttctgagacaggatcttactctgtcacacaggctggaatgcaatggcgcaatcacaactcactgcagcctcaacctcctgggctcaagcaatcctcccacatcaggttcccaagaagcagggactacaagcatatgccaccatgcctggctaatatttttggtttttgtagagatgaggtctcactatattgcccaggttggtttctaacttctgggctcaagtgatcctcccagcttggcctcccaaagtgttgggattacaagtttgagccactgtgcctagccctacacttcttctgtaggctggagagcagtggtgaggtcttggctcactgcaacctctgcctcctgggttcaaaggattctcctgcctcagcctcctgagtagctgacattacaggcacctgccaccacacccggctaattttttgtatttttagtagagatggggtttcaccatattggccaggctggtctcgacctcgtgatctgcccgcctcagcctcccaaagtgctgggattataggtgtgagccactgtgcccggccagccctacacttcttgaattgtataatttctccccaaattcagggcctctatacaaaatggaatcccctatctcctttctagtttactcttaatcatcctagtggtcttacctgagacataacttccttggagaaaacttccctgatctctctagactaggtaaaatccctttgctctatgctcccactgtactcagtatgtcctcctttgcagcagtcagtacattattaatgactttttaaacatgtcatctttcctgctagatgtatgctccatgagggcagggactgtatcagtctagtttactctagtcaactaccaccttcactatttttgccataactacataccaactctattaattttttcttaaaatcaactttaaaaaatcagacataaacaacatgtaaaataaaaagtttgacatgctataaattttcttttttttttttttttttgagacggagtcttgctctgtagcccaggctggagtgcagtggcacgatctaggctcactgcatgctccgcctcctgggttcacgccattctcctgcctcagcctcccaagtagctgggactacaggcgcccgccaccatgcccagctaattttgtgtatttttagtagagatggggtttcaccgtgttagccaggatggtctcgatctcctgacctcgtgatccacccgcctcggcctcccaaagtgctgggattacaggcgtgagccaccgtgcccggccgacatgctataaattttctaatccatgttaaaacaaacatgaatattaaggttaaaaaaaattcacctatccctaaagtcacttgggtattactgtggtctaagaaatctacattaggaaaccgtgctaatgtaactccaacaactgcatggcatctggcaaacggtatgctttcagtaaatgggagctgaaagtgaagattataagacctaccttgcttttggcttctagacgtaaaacgcgactagtctttgtgattgggtcttcatgcccagtttcctcaaacagtttgccttctgcaaacttgtatgtgtaatattttgggggacgtattggagagcaaagttgaaaggggcagttctttgggtcagaatttgtatccattatgaatccacaggcccaaggagggagctaaagaaatacaacagctatttttattctttatttaggccaccaagtatcattaattaaatttctaagtcttctccaaacaagatgatgtggatatctcgtttactttttgttaccacgtcatgcctcattcaaggattactttatcacaacaacatacatttcaaataaaaaacaaaactgtacattaatgaccaataaaataagacaaactataggaaaatgatttatcatgattctagctttacatgaaattgcctttaacataaaagtttattttggggtataatcttggataataaaatagtaaaatggaagaataagagcaaatcaaatagtaattccagaacccaccgacactgccaagatctctgttctcaaagaacgtgaaattcctcacatgcgtgtgtttttcataatttacccactagtccttaccctgctgcctggacagccacagtgatgacagttattatttcagggctataaacgggctcagcagcattaaggcatttgcaatttgtttctaacttttagctcctaggctaaccattgtgcagaacaaaacctcttctggcacatctactctgagagactcacagctattatactcaaggttcttaactttaagaaaaaaggaaaggaatcaaaatttattctctcagagcagcagggtccagcttcaagccttgcactaacatccctcttacaccttttaaagaactctggtaagcaggttgacagagcgttagaaatggtaccgagaggcagaacattaaaagaaaattgcctttcttttcctgagtaattgtagaaagagcaaattccttagaaaatcagaggcacagaaacatcactggtgggcactattgaaaaagggcagccggggatttgtgcgtaaaggggataccattccacctgcagcaactacagccagagtttacgttctctgagcaaatctcttattaataaaaaaaaaaaatctattttcatgaaacactagtaaggacacacatctgcaatctctaaaagctcctaatgtatgcttctcacattgagggttgttttaaaggataacttgtctatttaaatttaagccataactggagagtaaaatgtaaacaaaaattgagaaatctggtagcatagttataagcaagcaaactgagacttgagaggggaaaaaaaggaagcactgctacaaacctcataaccaggcctcagagcgagggtacaaggttccttagcccatggaagctcaagtttttctgccctttgatgagacttcaggacagtctctatgtgacccacgcagtaagctgtcttagctttagaccaagtggttccaataaatcaaaaagtatttttggtgtttttctaaaactaatgggaccaacattaatgttttaatcataataaaaactgtttcaaggctatggacttttagaagttcatccagctaatgcagatataagtattaactaactcaaggatatcttaagccacatttcctattcagataagcctgcagtgtatctgtgtatattaatggacagcaccagagagtaagtaggccaggagatagggagacattccttagatacctgagagaaacaggttcagttttagcactctaccagcaaactatagttatttcatcaaaagaataagacatacatgccgaaagaaaattggcctgaatatgcagactcctcctctaaataaaactgatgttagcatacagcaaaaaacgtcccaactggcctaaattaaatatcataacttctttttgtgacaaaaaaaaatacttccagaaaatactgatggcatggtgaccaaggatacgaggcaaatatgtgaagggttttacatttctgttgctaagatagaatttatttatttatttagagacggagtcttgctcttgcacccaggctggaatgcagtggcgtgatctcggctcactgcagcctccagctctcggcttcaagtgactctcctgcctcagcctccagaatagctcggactataggcacctgccaccacgcctggctagtttttgtatttttagtattctttgtattttatattttttgtatttttagtagagacagggttttgccatgttggccagggtggtcttgaactcctgacctcaggtgatccgcctgccttggtctcccaaagtgctgggattacaggctgagattgaatttaaaaagatcttttaatcaagtgcccaccaggcagagatactgcataaagaaatattttataatgcactcacgctatggttaaagattttgtctttcgtgtatggatggcactgtctatgtatattaattaatattattcaggctcataaaaagggtctgatctataaaattctctttattatataccaggtactaaccagaaagatcaagaagtatttaattccacttgatgatgactagaacattataaaagtcgtaataggtactatcatttgggaagggtcagaaaatgaagagatagaagatacagaataaattaaagacataatgtttgttccagtggaatttaaaaccatggaaactggggcatatctttaaaataagaatacttacaaaaaatataaaaggtcatatttacttagaagtcaaatcatatagcagagtaaactccacatgacatttctaactttcctgacatagaattttgttctaacaagtgcattgctagaaattacatattctctcccattcttattcatacagactgaaataataatagatgctccaccagtttcccaactgaagatgtctaaatttggcaccagttaacatgtaaatggttagccataggcagaagattgaaaactggaccccttccttacaccatatatacaaatcaactcaagatgaattaaagacttaaatgtaaaacctaagactataaaaacccttgaagaaaacctaggaaatataattctacagaaaggcaaagattttatgacaaagatgccaaaagcaattgcaacaaaaacaaaaatcagcaactggaaactaaagagttcctgcacagcaaaataaactatcaacagagtaaatagacaacctacagaatgggagaaaatatttacaaactatgcatctgacaaagatctagtatccagaatttataaggaacttatattaacaagcaaaacaaacaaaaacagaaaaaaaccccaacaccataaaaaagtgggcaaaggacatgaacagatatttttaaaagaagacatacatgcagccaacaagcatatgaaaaaaatgctcaacatcactaaccattagaggaatgcaaatctaaaccacaacgagataccatctcacatcagttagaatgactgtagttaaaaagtcaaaatataacagatgctggtgaggctgtagaaaaaagggaaagcttatacactgctagtggaaatgtaagttcagccactgtggaaagcagtttgggaatttctcaaagaatgtaaaacagaactactatttgactcagcaatcccattattggatatataaccaaaggaatacaaatcgctctaccataaagacacatgcacacattatgttcatcacaatagcaaagacatggaatcaacctaaatgtccatcaatgatagactggatacagaaaatgtggtacatatataccatagaatactacacagccataaaaaagagataatgttctttgcagcaacatggatgaagctggaggccattatcctaagcaagccaacagaggaacagaaaatcaaacaccccatgttctcacttataagtgggagctaaacattgtgtccacatggacacaaggaagagaataacagacactggggcctacctgagggttgaaggagggtgaggattgaaaaactacctattgggtactatacttattacctgggtgacaaaataatacgtatatcaaacccctgtggcagacaatttatctattaaaccaacctgcacatgtacccctgaaagtaaaagttaaaaaaaaagaaatgctatctaaaataataatattaaaatttttaaaattagcaagtgaaaagaaatactttgcactccagcagatgaagacaataaggacatccctccaagtcagtcaccattttggttttaggacacttacatagtgttctaagagactggacattacatttgatcttttgattttagggagtagctggagatttcagttatttcaggcccttgttatttcttatttataccaataaaacaatctcaaaactagcttcctgccccttacttctttttggtttagtgtatcctaatatggctgccactcctcaaaccattcccctgctcaaaaacttcaaatgttacctttcataattaataaattcctcatattgacactcacaaaaagtcaaatcatgacttcatcccccagaaatgtatagcgctttaataaaacagaataattaacagtttcctgaacattttctgaatgtcagagcatacagcttcatttgatggctttctcatcttggaataccatcccctctccacctgtcaaaatcctatctctcttctctggtttatttcacattcaaccaactttaccaaaagctttcctgggccttcttctctagtttgagccccacagcacattttatgtttttgatactacttattcaaatccatgatacacttaacctttatgtactagtttaatcttgtgattaactatatcttccttaaggctaggatattctgctttaacagctttcgattctataatgcccgatacagtattgtgcacatgaaagttcaataaaaagccactgaattgactgaaattgcatttttacaggagttttaagaatattggagttagggaggtataaatggtctatgctgtttgctcatcaactggctcagtaactcttttcatatcaaacaaaatggaagccatcctcttcccttcagtgcctactacctcaactcacatgttaatgctgctttaaaactaggcaataaggttgtcattcaccaattttaggaagttcacttgtgaaggcaggttatctttcctggtagccacaagcagtatcaactagtcagcttgccaagcagtcttgccactattagccttctgtgctgctgtggagaccactgctactcctacactgaaagaaaccaaagtttgttccctgcatcccctgcggataagaaaactggcagacagaagatgatgcagacaaaagcatgtagtggctaaaaacacagtggataccactactgtccctgttggggatgtgggatgggggaacagcagtcagtgtttaggcactagctaccaactttggcctgagtttttactatatctcaagttgcagagatatgtgaggtagagagatatacagaaagagaaatattagcactcaactctacttgtgaagtccatgccataagacactatcttaagtaaaactgcataaaaagcaagatcctctaagtaattctaagataaccctcctaaacccaagagtgactttgctaaattccatttaagttacattcctttcaagaaaaagaacactgctgccactattcaaaatgtgatgttctgttaagctaaactgcataaatattttgattaacagtattaacttctgaaaattaaacatacctttagagaccgaactgaatcatcagccagaccaatcacattaacataaaggagattgctgtgcttcagaaatagaacacagtgatccttaaacatgtccaagtctatcacttttgtatttctcttcattgtaaaaaataaatcccaattcataattgcaggggtatcagccgctgttctcattagctacgtggaacaaagttagaagacatataggtaagaaaacacgaaggctgcagcatccagagatgcaatcactgagaactagaccatactagtcctcactgttttatgaagagctgaaggaactaacgctgcatcagggataaagtgtgaccatcaaccatatgaatgagtcctgactagcctgctgggtggtgagacagtatatccagtgcttagccaaccactggacatttgagtgagggcactgacagctagctgactacagatacatcagtgagcttagctgatatcagcagaagaactgcctagctgagatcaatccaaattgccaactcataaaatcacgagtttgtaagtttgctcttttaagctactaagtttgattttgttaacataaactcaggacagaatatgttttatttactaactttttaggcacaattaaaatatgtagaggcattagctctaagggaaaagaaatgggattggttatacataggaaggtggcatcaatttataaaacaatgagctcttggagcaagaaatgttgttgatcgaagtgtgacacttcttaacagcccaaataggaacaacgagcatccaggattaccttaaattctgtaggttctccaacattagtgagaatgtataattcatcatctctgtgttcaacatagtaaaggaccccatgtattcgcttctggataagtactggtgggtcccaagggctcaggccatctatcaaccacacttcagaagtagtcttgttcataatatttatggtgaggaaacgactgtcttttgtaagataaaggaaaacaaagtagctagagagagagagagagacatgagatcacagtttatttcagatgcatgctaccttgttaaggacagtatctcagaggtggtcagtatacatgttgatttataatgcagataggaaattaaaataattccttagtgaatatcacttgtaactttaacaattagctattatttttctcattttctcctaaagggcattcaaaataatttacttctaacattttatcataaatgtttttcaaaaatacagaaaagttgaaaaaaccatcttgattccatcattgctaacattttgctacatttactttattacatatctatgcacctattaatccatctttatttggatgcatttcaaggtaaactacaaacgtcatttctcaatcacatgagtagataacatagctttttgctgagaagaggaaataaactttctataggagacacaaatagggaataaaagggacacggagttatttttattttcttctttctctgcatgcattttggatttttttttcctttctcccagtttttacaacaaaatagaataggaagaaaacccctcacaatcttactaacgtaacacatttaaaacattaacatagctattttactttttaaatttttccttctaagttatatttatatttcatgtgtgtctttaaatagatgtaattatagatacaatttttgattctgtatttcttacttcatatatcaattttctccctacatgagttgaaagtctttgtgattattatttttaaaggctacctaatattataacaggtttaatggctacctaatatatcataattcttaaaaatttagattttaatgtttcattataataaacaatataacaagaaacatattcatgaagatattttccccttccatgatcttcacaattattttcccaagacaaatttttagaaatggaaatactaatttaataagtgtatttttatgacttgatgaatataatcaaataatatcctagaagcactatactaacataatgagtggctttaaatgttatatttatatttttccttattataaaagtaatttatactgaaactactgaaaaacgtaaagaatcccaatgcccccaaataacaactgcttatagtttggtaaaatttcttctgtattggatcacattaccatgtttatttgtcaatcgttatttcttttgtgaaatgtgtgtctattttaaactttgaatgtagcttaaattattagtatgtaaatagctctttaaaaattaagaatattggctgggcacagtggctcacaactgtaatcccagcactctgggaggccaaagctggcagatcacctgagatcaggagttcaagaccaccctggccaacatggtgaaaccccgtctccacaaaaaatacaaaaattagccaggcatggtggcaggtgcctgtaatcccagctacttgggaggctgaggtagaagaatcacttgaacctgggacgcagaggttgcagtgagctgagattgcgccactgcactccagtctgggtgacagagtgagactctgtttcaaaaaaaaaaaaaaaaaattaagaacattaacttgtctttttgttgaaaacactttcctccattttgttacctagattttaactatttacaatagtttttgtggtttttgacttgagtttaatattttacgtaatcgagactgctactaccctttgtaatttcttatattgattttatgtttcaaaaatattccaaccaagctgactaaaaagcttatattttcatcttattaaaaaattatttttctcaatgggttctttaaatctcttaggaatgtatgctgacatatacaatgatgaaaattattttttcccaaatagtatttcccattgcattataaaataacaccgattcatttttcattagtttgtgatgccttttatcatataaattttcacatagactaggatctatgttttagagttattctaagctctattatttgtctatcaatttgtattatttttactgttattgctttatatgctttaatatataattgtagggcaagtcccctaccctactttgctctttattttcaacactttcttcgctgtttttatatatttttgtttgcttagtttggtgatgacaaattaaaaataaactacttgaccaaatagttgttagatatgtggttacaggaagtgagaacacaagtggctctagggtaaaatgtgtctaagagaatatacgaaatataaagaactagacattaatctttttttccaattatttctatcgacaattatttttaaatttaaaatgtattataaaaataataatgcttattacaaaaagaaaaaaagaaaagtaaaaaaaaaaccattgttagtactttgggtgtatttcctttcaatcttttaaaaatgcatcttttttccttgatacccaattgaaaccatagcatatatttaattttttcacctagcacaataatacatttttgagttagttttaatttataatttagtagcaacacatactttaaattcttctatatattactaagaatttaatggttaaaaggtactcaacaatcatcaggaacaaggggttttagtttgaaagagagatacctatctaagtatataccatttatttaagcaatagatactgactaaatagcactatacaaacctggcaccctgcttatcaattaagatgcaaaggtgaaacagactcagtctgttcacaatctagcagttctaggtcatctttatgaatttacatgaatgaactatgttgtaattcacaaaatcaatttcagtttttaataaaatattagtgatatatctgtatttactctgattttgaatattaccagactccaattttgaatacaaacaactaataaaagaatgatcgttttagccttattattcctggttccaaccaaaataaacgttttaagtcaaccaaagtcagtactttaaataactggaggaaggttctggagagaaagatttaattatattattctagtaccttgggtctttttctgtgtaaaagcgttcattacgtttgttatcaccaaaagtggctcgatatacgtcatgacagcgaaggttcctctggaaggtgtagaataaaacatcttcatcttcctcgtcctttacccattctgaaagaaaataatgagataattatacataatcacctacactccattaaaaaaaaaaaaaaagcacagcacattctaattttgaatgccagtgagaacatgtgcaagtttatccctggaaatctaaatatttgactgtatctaatctgtgctgtatataagccagagagctttcctgagaataaaccactactacaccattccaaggtttcaagtagttatcagtctcagggtactcaggtttctaaataagagctaaatgctcaatatttaggaaagacattggtaaagtcacatttgcttttaggaggtgaattccgtctcaatctacaacttgaaactgtaagtctgaaggaatattgcatctttctctcatgtgtaaaccttctctgtctgctttcaagccacaggatatctccaactaccaaacacaatttaatgctgattcttgatcccaccagaagctgtcaacagaagtttgcacacaattacaccatgactgccacctggctgacagtgattgtaagtcatcattgtataatatgcaccatgattttaaaggttataaaatgtacaaaatatatgtcttagaattcaatagttagggtataatttcaattcactgcaacaacatttagttaaacaatggagaaaatgatggctgaaaatgaaaagggaggacaaaatgtaacatatgtaccactcaatgataaatttaaagttagttctattactaaaaatgtcacagcttccattgataaacaggttagttcaacacataccaagttctttggtagtgactttatgctgtaacagctctataagataacatgaaattaaaaaaatacattcaagcttaaagttgaataaaatattaagatgcaacttacgtgtaaaaatttattctagataataatttggcaaataattctgataaatcaaaacatattgtatgacatggactctaattataacacttttaaaaacatgagtattttaaaattacccatctagatatataattaaataagggaaggtctcctgaataagaggtacataggaagatgtatagtccatagggatacatgaatcaggcattcaccttctccctccctcacatgcgacaaaaaaatgtttcaaaagtgttaccgttgcctttcaacacagaggactattttggttggtggcttaccaaaactggacacattcgggaaagaagcttccattacgggctgatcgctgagctttataattacacaggtagatgcttcagaatcttcagttcttatcttggcagccacatatttttcatctggagcaactctgatacaatcaatgaagggctggtctaacttaagttcctccaaattgaataaaacttcataattatcattgtctgctgtataaagaaaaatacgaaagtgataacttcaaaggatgtactttaaaaaattaaaactgtattttaatgttttaaattagaattcccattctgtaagaggccatatcctagcttctttcaacaatgatggcagcttaacttgcacatcaactgacaataagttatttaatattaccttatactattcaatactattctgtgcatcaacctatgagacattatttgatattgttatagtctagtttagtatttacagaccatacagaacctagaaagtaagtgaatataaatgacaatcaacaatatatgccaagtgcctagcatagtacccaagacacagcagatgctcaaaaaatgctggatgccgtctccattctccctgccaaagcttctgagtctaactatatcttacacaaacccagatattaaaaactagtcattaaaaaaaaattcagaaataatctttaaaaaaatcttttctctatctttgagaaattaataaatttcctataaaaaatatgaaatctgaaaattagagcacgtaaaaagaaaaattgtggtgtaccttcttcatctttggaacgaaccaagcaacaaccttcttggtaataaacaaaaccaccatgtttaacctgacaaaagaaacatgcagtttacttaataataatttaattaaccttttcatagtctgactattcaagatgaagatgaaatgaagactcttataaaaaacagacctgttgaagtatatgaatgaacacatatgaaatataaaattgaccatttttacaatgtagttgataagatatggttttcgtatgttcataaccactagaggggtttttaatacataaatacaagaggcaataaagaaaaggtataacaaaatctgtcagttctcacaactgtacaaaccacttctgctacattttagaaacatctgatacctgtacagtgggagtcaattaacagaaatcaagtggcatctttaagacaatccaaaatgatgcagatgaggaaactgtggctcagactagcctgaaaacccagtctataactttctgagactccttcctttaaaatatgctgtcaccaacaactatacacagtcttgacttaacacaaactatttcacctgctgtagggtgacaaatacaatttgaaattgagagaattaatattacccaaatataaatagtgttcttgtctaatgcctacatattaaatgtaattgattggttgatatgatttcagtggcttacgtttattatctgttagttggtggcgtaatttgaatctggagatccttattcttaacctactatttccactctactatgtatgtgattttcacctattgcggttcaattttccaatcttattgaaaaattcaattcattttttcttttttttttgagacagagtcttgctctgtcacccaggctggagtgcagtggtgcaatcttggctcagggcaacctctgcatcctgagttcaagtgattctcctgcctcggcctcctgagtggctgggactacaggcgcctgccaccatgcctaatttttgtatttttagtagagatggggtttcaccatgttggctaggctggtcttgaactcttgacctcaggtgatctgcccaccttgacctcccaaagtgctgggattacaggcgtgagccactgcacgcacagccctcaattcatttcgactgactatttatgactgtgataaccataaaatggttaaacagatacttggctttcatggtattatactacttaaagtgaattccttttattaaaaaatttagacaaaacaatcaagtaattttcaaataataacaaagtatgaactactttcatttgaacttctccttagaatgattaaaaaatttttaaatcagtgctgggcatggtggctcacacctataatctcagcactttgggaggctgaggtgggagggttgcttgagcccaggagttcaagatcagccagggcaacacagtgagaccctgtctcttgaaattttttttttttaaatcggaactgattgtttgcaaaaaccagaattaatatattacagttgaaaattcatcttactttcgatctttacatttattaaaagatgtaaaggatcacattctgtgatcacaatctctgaaatctttgctttttaagtttttcagcatattttaaaggccaaaagcagtataatcttgatgtggactatgtctctaaatcaccaagtatctcatttgcatcttgattggtaatatcaaaaatttttttttaaagacatgagatatcttacttccacattgatgatttcatattcttcttgtggctgtgtttctaattttgttctcactttttcaaatgcatccatgttttctggaaggggtttttcgttttcttgtttaacaggctgaagatcctggaaaaagttttgttatgatcaaaatatttcaaactagggaaaaaaaacttttgctttttaaagataagtaggtctataccgtagacttaacgttgtacaaaaaagaaataagattaaatagtaggtatttcacagattgtaaatgttctttcctaggctcatcaataaaatgatctttttcgttaaaaaaagtaaacaaagtaagatagacatttgatggttatactattattttagatgaataagtccttaagaagcaggaatactaagaagctcagaagaatgttcagaaatactatggggaaaatttatacacaattaaggagaaaataaaattccatgaacttttacatatttaataggaaaatcaggtagagaaaaaaatctttcgcgtttaggaagtactgaagtacttcctaaaagaagggaaatatcaaagaagtggaagacattatcactactaataaatgttcactattattttattcacagccagagtgataagaaatatttccctacttcattaactataattttttactttttaaattttttaaatttaaatgggtctgagaaccaagggatataattttcttttcttgtgggaataactaagccccaaaacagaactgtttatcacatcaaaaagtaaactggcgaggcgcagtggctcatgcctgtaaccccagcattttgggaggccaaggagaatggatcacttgagcccaggagctcaagaccagcctgggcaacatagcgagaccccgtctctataaaaaaatacaaaaaaatttagccaggtgtggtggcacacacctgtagtcccagctacttgggaagctgaggtgggagggatcacctgagcccaggaggttgaggctgcagtgaagcatgatcatgccattgcactccagcatgcagagtgagaccctgtctcaacaacaacaaaaaaaagggaattaatgcctaatgaaacagagcttctttttcagtttctttgaggaaaaataacatgttcactttatgaaaggaagaaccaggaaaaataatagaaaataatgaacatgagtggagatatagatgaaagctaaataagcattcactgtgtcttatcaagagtgactaataagctgacagctttatttgagttctggtaagcaaattaatatcatataaatcattacaatttggataaagcaaaacctgttatcaaatttaaaaactgtttaataattcaacactccagtggtttgccttgtttaagcaaaaggattctggccaagatattttacttcagctctctgccaaagatgacaattgtacagtgatttgtaccagaggggggacttaagtctttggtaaggatcgccaacagctggaaagtatttattgcataaaatatgtccatgatactttaccaacattgtagagaatgtaagctataaatacagtttatattacaaagagtttacaatctaaaattaaacacaagaatataacggaaaaatcaccaaaacaaattaaatggaaaataatcattttcacaaaggttttccttttagatttttttgggacacattattatttgaattagattaaaattagcaataatggttgttatgatagtctcaatcatttagcctctacttactatcatataattttctgaattttttttaagagacagggtctcactatgttgcccaggctggactcaaactcctgggctcaagcaatcttcctgcctcagcctcccaagtagatgggactatagataggtgtgtgcctcctcattccatacagttaattttttgagtaattatttgaagatcaaatactggaggcttatatatttatttttcattcatttttaaagcatttctacaaaatctacagttgatctttaaagtggtgagacatgatatctgtatcaataatcccctcatatcaccatcataagtcagaagatgactaaaaatctattctgaaactgtaaaatagcaataggagctgcctttgcatttctagattcaggattgtctgttctgtaatttccattaaaacttttgaagtagagtcaggattatctctctactaccctgtagcttctagcacattctaggtcatggagctgggttctgtcacttttaaatactcattcttactgagagtcatagccaacacagagccaaaagcaacagagcgggctccaaaactcatcttcttaactttacattccttcctgattaacattttttctgtcatatatccaaataaactgagcttatctgaaccaaaataactctgaaagcaataggatttttgactcccttaacgaaattcaagcagaactcaacagctttctaagtaactcttctaaaggaattactcccatggaaactgaggttttatataatattcattaagtactccaggttacttttggtttttgttgcgtcccagggatacctgctcagtgttttaagctttcatttcaatttcagctagcaatatcattagcgtacacagctaaagccatccattttagccaggtatcttagtccagttgtttcaaaggcatatactacccaatggagctgaggtaaggatggctttaccttcagattttgagaaggttactggtacagtatcactccattagtggtaaaaagaagcactccttcccactccccaagtgacccaccactaaatcattttaacaatgaaagctgttataaaatagaaggagaatgatatgtgttaactttatcatggcaaagatgctgaactctaaagatagaaaaaatggtgaagtagaaagacaccggacagcccttcagtcaagactaattagccattagtaaatggctaattctaaggctagagcagggagaaaatacatggtaggtttgggaaatcttatgccagaaaataaggaagtgctcaaagtttaatggagacatgtcaaaagaatacaagtgtcaactgaaggggtttctacaggccacattttggacaactggagcctcaaaaagaataataaataataaataatacattgaaaaaacataaatccacagcaattgaaaaacagaatgcaatatgaagcatttcaatttaggaaaacagaaaaagagtaagtcttaaggaagtagaagaaaggtaagaaaattaatttttgaaattaaattgataacaaagaaactaaagagaatcaaattaaaagttggttcttttagaaacctattaaaaaacaaacatcacaaaactgatagaaaaaagaatacgaggccgggcgcggtggctcacgcctgtaatctcggcacttcgggaggccaaggcgggtggatcacgaggtcaagaaaaaagaatacgaggagagaaaaaggcataattacagatacaacagagatttttaaaaattacaataagctttatgtgaatctatttgaaaataaatgaaatgggtaattttccaggaagaaaaattaccaaaattgacccaagaaatagaaaagctatataagtcactaactcttaaagaaattaaattgctaactaaatgtccccttcttgaaagaaacaccaagcccagatgctttcaaatgtagctttcttggatcttcaagaaacagctaatcttttcatacgtcaactatttaaaaaaatagtaaaagaggtaaaactactcattttattaggctaatataaccttgacatcaaaattagacaatgatgatatgagacaattaaaaaaatcaatcttattctaaaataaaacttgataaaatcaaatttttaattttaaaaagcacaaaataagaacagtaatagtaataccaattaaacttaatgtgaccaagaaggattttttcctaagaatgaaaggatggtccaacatcagaaaaaaatctatcaatgtaatctaacacaaataaaggagataaatcttagagccatttttgataaatgcagggaaaaaataaaaaataatcacactttaaaaaaatgataaaaccttaaattaggaatagagaggaacttccttaatagtttctgtcagttatcttacacagaaatatactaaatctgtaatcaaaatacctgaaattaattcatattagcatatacatggtatttagcaaccatgaaacaccaatgagatttccaaaattttaataatgttcatgtaaaacaactaattgtatttgctgttaactcattttattttttaaaagcaactgttaaatgaaggaaacttgttcctttcatcttctgcctccaattcttctccttaccccttctctagagcccagacttttgctcttcttatgccactgactgctcctgtcaaggtcactcaatggctaccacattgcaaagtgcaaaagttaatgttcagtattcatattacttgacctgtcaggatcatgatacaattgatcacttcctcctcctaaaaacacttttctttacttggcttccaggacacctcattctccttgttttcctcttacttcactggcccttccttctcagtatctttagctagttccttctcaactccctggctttttttttgtttgagatgggatttcggctccctgcaacctctgcctcctgggttcaagcgattctcctgcctccgcctcctgagtagctgggattacaggcacttgctcaccacgctggctaatttttttttttttttttgtatttttagtagagatggggtttcaccatattggctaggctggtctgaaactcctgacctcaggtgaaccacccgcctcagcctcccgaagtgctgggattacaggcgtgagccactgggcctggcatctccctggctttttaacactggcagagctcaattcctgcactaagtacttctcttctttgcagtctgcactaattcccttggtgatctcatccagtcatgaccttaaataccatttatatgctaaggactcccaaatttacagctgtagcctgaacaatcctgaccaagatgaacttgtatatccaactgactacccaacatttttacttagatgtctaatatgccaaaaaatgtccgaatctgaactttaaatctccccatatatccctcgccctattaaaaaaaaaaaaaacaaaaccctgttctccaggcaatctttccaatttacataaatgacaaatctgtcctcccagctactcaggcttaaaaacattacagttggatttgtctttttctcttgccacaaacaactggtctgctaaatcctctcaattctactttcaacatatatttagaatctgaccacttctcacacttggactggactacttggctagtatcatcatcatttctcccttggattactgcaaaagcccaaaagctttctctgcttctgcgcttgcctcctggtctattttcaacaaaggagcttgtgtgagtctgaagtcagattatgttactccactcaaaaccctccagtggtttcccatcttgctcaagaggaaaagcaaaaattcttacaatggtctacaaagtcctaaagaatcttgtcccattacattgctgacctaatctactgctacacgccaagcccacttattccagttaatccatacttgatgtttcttgaacatatcaagcttgctcccatatcagtttcttagaacttgggccctatgcccaaatacctccttaaagctattgctcaaatgtcatcttctaagttaggcctttcctaaccattttactaaaataacacccctccctatccccacactgcctattcacatcttccccgtcttttttttcttttcttcttcgccataactatcgcttttgacccactttgtatttcattcatgtaattctttttatttttttgagagatgaggacttgcttgtgtccacctcagctggagtgcagtggcatgatctcggctcattgcaacctctgcctcctgggctcaagcaattgatccttgatctcagctctcaagtagctgagactacaggcgccaccatgcccagctaatttttgcattgtttgtagagacagggttttgccatgttgcccaggctgttcttgaacttctgggctcaagcaatgagcccacctcagcctcccaaagtatattacaggcatgacccattgcacctagccttgttcatgtaattctttattctttctcttttcctttctcaagtaggatggtaagcttcacaaaggcagggatttttgtttattttgttcagtgttatatctccagtgcctagaatggtgcatagcaggtgttcaacaaatatttgctgagttgaataaaattcagacagcataaaacataaaatgaaaaaaacatatttaacaaaagatatcacaaagtgaaaaaaataataatagaacaaatatggagaagatatctacagcacatataaaagacaaaggacacgtaaagaaatcttatgaatcagtaagaaaaggacagacaattaaaagaaggtcaaaagacaagaataggcattcaagaagaaaaactataggatcaataagtgtaagaaaagatgctcactggccatgagtggcagctcatgcctgtaatcccagcactttgggaagctgagacaggaggattgcttgagcccaagagcttcagaccagcctgggcaacatagcaagactctgtctctatttaaaaaagttttggattttggagcatttcagattttgtattagggatggtctacctgtactacaagatattaaaaaagaaaggtactgtgaatgaggctaacttaggtctacttctgactctactagttttcttacttaactttaggctctgtggctttagtttcttcatttgtttagaaagaatacacacgcttcctgattttaagacttattacaggccaggcgcagtggctcatgcctgtaatcccagcactttgggaggccaagttgggcagatcaccctgaggtcaggagtttgagaccagcctggccaacatggtgaaaccctgtctctactaaaaataaaaaaaaaattagctgggcatggtggcaggcacctgtaatcccagctactcggggggccttggcaggagaattgtttgaatctgggaggcagaggttgcagtgagctgagatggcaccactgcactccaacctgggcgacagagcgagactccatctcaaaaaataaataaataaataaataaaacttattacaaagctatagtaattaaatgtgtagtactggcataacgacagacatatacaaaaatgagatgaaagtgagagtcaagaataaaccattgaatttatggtcagttgattttcagaaaggacaccaagacaattcaatggaaaaagaacactcttttcaacaaatgttgctcagacaatggatatccacaagcaaaataataaagttgtaccccaatcccttgcactataaacaaaatgaactcaaaatgggtcatagggctgggcatggtgggtcacacatgtaatgccagcactctgggaggctgaggcaggaggattacttgagcttaggagtttgagacaagcccgcacaacaaagtgagaccctgtctccacacacacaaaaaatcaaaaaattagctgggcatagttgtgggcccagctacttgcaaggtaaggcaggaagacagcacgagcccaggaggttgaggctgcagtaagccatgtttgtgcctctgcactccagcctgagcaacagagtgaggccctctctcaacaacaacaacaacaaaaaaagtatcaaagacctaaagaaagagctcagatgggatgatttctggggtatgttttctagcaataaaatttatggttatatgaaaagaaaaaatgcattaatttaactattaattcattctataaacacgttgcttatctacaatgtggcagtcgttatgctatgtgctggcaagatgtgtattataaaattcttgtctttaaggacctcccaatataatggggagacaggaaaagtttaaaatgatgtagtaatagcagagaggtaaatatagtgatttgactcctatggcttcaactactatctacatgtaacaactctccccaaattccagactcatatatccaactgctactgaaatctccactttactagtgagttatatttatcctttcctcctctcttttttttttttgagatggagcctcgctcccatcacaccaggctggagtgcagtggcacgatctcagatcactgcaatctccacctcccgggttcaagtgattctccttcctcagcgtcccgagtagctgggattacaggcatgcgccaccaggcccggctaaaatttttggattttcagtagcaatggggttctgccatgttggtcaggctggtcttgaacttctgacctcaggcaatccacccgcctcagcctcccaaagtgctaggattataggcgtgaggcgccacgcccggccttcttcacccttaagatctgaatatcagtaagattacatacatgactgtgaaataagtccatctgaaacataaagataaaccaggtacgttttagaattttgagattttggaatgttaactgggtaccttatctcagtttacaggggaacaacactctaatcaaatgcagtaacattttagagctaaacatctactaattgggataaagatcataatagctttgtgtcagtttaggtcaggttttgcccattctcaacagcctccaatcagttaaaaaaaatcatttgttttctaacaggcttttggattttagaatccaaagagatgaggaattatcactcaagctctctagtcttccattaagatgtctcaaataaaatgtaatcagggccagctgcggtggctcatgcctgtaatcccagcactttgagagggcaaggcaggtggattgcttgaggctgggcttccagaccagcctagccaacatggcgaaaccctgtctctacttaaaatataaaaaaattagctgggtgtggtggcacatgcctgtaattccagttactcaggaggctaaggcacgagaatcacttgagcctgggaggtggaggttgcagtgagcagagactgtgccactgcactacagactgggtgacagagtgagacactgtctcaaaaaaaagcaatcaccctgtaaagactctcatcttcactcatctgagttactgacaaggcttcctacttccaatttattctctattctgtcagagtgattcttctaaaatgcaaatctgattgcgcctacatttttcaataacattctattgcttaaaaggatgtagctcaaactttttgcaagatatacaaaactacatattatatatatatatatatatatatatatacacacacacacacatatgaatatgagactattgcaggagctgctaacctgtattgtagaaataggcaaatgacatgtttaaccaaaggatttagtcttctctctttaattatacaatttcattttgtatcttgttcaaattatcactattaaagattttgggaattattttttaggcagagcagagcaggatgatgtggaagataaagaaatgtgatatctggatggatggatgctagtctttgaatatcactggctggcttgtaagtataatagagtaagttcatcttgccatctggctaatgtaaaatggaaagcagaggtacttgccaataagaactgcagaactgaatgaattcaataaggtttagatcggcaacacttgatcatcaaacatttccaatttctaaattcaggtccagtgtcagtcaagttgtgagttccagaattacctgatgtgaacttcaaaaaacagatctggggccgggcatggtggctcactcctgtaatcccagcactttgggaggccgaggcaggtggatcacctgaagtcaggagttcgagaccagcctgaccaacgtggtgaaaccctgtctctactaaaaaatacaaaaaaatttagctgggcatggtggtggacgcctgtaatcccagctacttggcagctgaggcaggagaattgcctgaatctgggaggtggaggttgcagtgagccaagatcatgccattgcactccggcctgggcaacaaagcaagactccgtctcaaacaaacaaacaaacaaacaaacaacagatgtgtaggcctcaaccatagagattttcattacgcagatgtggggtgagatccaggaatccgcatttctaaaaagctctccaggatttctgatatacagttagactgcagaagttgatactgaagagtccccaaacttttaggcagtaatttgttgctaaggtaacaagaggtatagaatcatgaaattttagcacctctaagactttctacagaatgacaagttgaaactccctatttttttttttttgagacagggtatccttctgtcacccaggctgaagatctcactgtgcctcaacctcactgcagcctcgacctcccaggctgaatcaatcatcccacatcagccttccaagcagctgggattacaggcgtgcgccaccatacccagctaatttttagtctttttggtagagttggggttttgccatgttgccaaggctggtctcgaattcctgagctcggacaatctgctcgccttggcctcccaatgttctgggattactggcgtgagccagtatgcctgatcagaactccctatttttttcagtcaggaaaattaggagtcctgattagttcagtcacaccaatcgtggctggatcttttgccttctaacattcccactacacatgctacttttctgttccttagttaacttatataggtaatagctctttaagcagacattttaatttacctaaaagcagtaactactttttctactttattacaccctataaaagtggacagagttggaaatcagtggatgcttgctgaaagaaggaaatgtgcattcttctctacaggtgttttcacagctgccggggcatctttataaagcttccccaggtctcagtgataaagaccatggcttttacattacatcatttctcatagagggaatggttgatacatgacatgtgacagcaggattactttatcaggtaaaggaattactaaatgaactattaatacttggagttattgagtcaggttaaagtttccaggtagtgggaatctataaaagagaacggaaaagttgcttcaggaacaaatggagggaagaaatagtcaaccttctgtttagaatgtgagctaatatcacagctgttactctgatggtaattcctgtctactatttataaactaagtgttaagacaaagtacgacatgacaaaatgttctaaacacaatgcaaaataaaataacctaaaggtccaaaatttagttcaataggtgaaattaaaaattttatctttctgaagtaggaaagatgtacaaaaaacacaaaaatgaaataaaaagaagttataaagaatttctaaatgagtaaagaaagtactaaactaaggcaagacactacaaaaaggaaaagaatttcaaagactaaaacataaacagtaaaagtctaggaagactagggggctaacatataaaatgttaaaagcaaaagagacacacacaacacctaaataggtatcagctaagatagcggcaaaaattgaacaaaaactagaaaaactgagaaaaattagattgaaaagatagtttctaaaatgagaagaatctgcccaagtgtccatcaattacaggaatggataaacaaaatgtggtttatacatacaaaggaatattattcaactataaaaagaaatgaagttatgatacatgcatacaacacagatgaactttgaaagccactgaattgcatactttaaaatggatcaagtggaaaactttgttatacatatattttacccgaagaaaggaggaagccaaaacagactaaaagaaaaatcagtatgcgacaaaaccagaaattaaaataaaaaaaatattaaaatcataaatttgtgaaactattgcaagaataccacccccaaatatcattaaggaacctaaggaacataagaagtaaaaggtaggagagggatgtcaaagcagcagcagcacaaatagatcatttaatcctacttactgtaggatgaccatataatttaccattctaaccaggacacttttgagaggaaaggggacactattaataattacacagggacaacaggtgtaggctggagctgtgccaggcaaaagtggttatgtggttactctctatataagggcaatcaggtccttaaggttgagttcacgcccacagcttggggtctggcagaagtacaatactctgacagtgtcttcctgaatgactcaagtggtcaaaaacgcaagattatttttcatttttttacagagaaataaaatacaattcatggcctttactgaagtttactgatttgtgattcataaaacaattagcgtatcattagattttattaagagctataatttagtgttctaggaaatttagaaggccgaattatactttgaaatgcactggcaggcatactaaggaagtcctgaggtgaatcattttttataaacctacatttttatatattacattagagccctataaatatatgtatacactttttttttttttttttttttcagacagagtctccctgtcacccaggctggagtgctgtggtgcgatctcagctcaccgcaacctctgcctcctgggttcaagagattctctgcctcagcctcccaagtagctgggattacaggtgggtgccatgacgcctagctaacttttgtatttttagtagagacagggttttaccatgttggccaggctggtctcgaactcctgacctcaggtgatctgcctgcctcgatgtatatactcttttatacttacttttgactagagacaattgagacttgaaaattagaaaaatcaagttagaattactgagaaaattagtagctctgatattctacccattctttatttttaaattaaaattaatcttaatgacctacaaataggttaacttaaacagtccataccttacatgagaagctccgacttgggatgtttcttgctaactctgatatcttgggtttattctgaagacacttggttaggtgatattttttcaattttattctattgtaacaatgatcagcgaagttatagtgattcaaatgctgtttctgcatgcattttccaaggtgaggaatactatacttcaaagcttggagaaataatttggtcttctgctgcatgatatcaaagtccctggtttatgctccttttggggctgccagcacacgaatgattttataggtatgattacagagtagtgggttctcagagtaactaagatcagcagttctcatccctccttttcagggccatgccccacttaggttatgaataacttcagacagctgataacttaggctaactaaatctaaaaacctgtgtaagttaaagtttcattcaaatcataattcttggcagatgtgacttaaatgtctcatttgtaaagttaatcctatcaggctcaaactatgcagcactgactctggcacacataggggttaaactaaaacaaaaaacaaaacaagaaacaaaatataaatttgcaaataagtacacagacttaatggggtatctcaggaactcagggctgtaaaaggtaaaaagccctttggtcttacataattatgaacgtatctttggtatatatgtggaagataaactggaaaagcctaattatttaataaaggtgggggagggaagattaattattgttgagtgttaactaactgccaggtgcttttatcttgtttgtctaatttaaattttatatggacttaataaagtagatattaccatgcacattttacaggttgccaaactgtggctgtgggaggttctaagcaactgttccaggtcacttgtacagtaagctgtatagcaaaaaatccaatttggttcggttccaaatactggacatactcaacttcggatttttaatgttaaaaaggtatttagcgctttaattaaaaacaacaaaaaacccctgcaagatgcacaaataaaatgtaaggccatctctggtttgtcaggaggtagcttttattaaccttgattgctaataagtagttaagagtcagagagacctgggttgaggtcttagctcctacacttaactgtgtctccgggcctcagtttcttcatctgcaaaaatgaaatgacaccatttaccttctagggttgttgttgtaaagacaaaatgagacagcttaacattaagaccatacagtgcctggcacatagtgaccactcaataaatggcagttgctattatttacgacaggaataatctaggtatgttgcacaccgctgaatgtcattatggaagtcttccacaaaatgccccctggtatcaaaggtagaatgctgcgtcaaatttaccatagatcagatgcgctacgacgcccccgccccccttaatccctttccatgtcgcagcaaaataatgggcgattgggggtaggggagcaacactagtttactagccgacactagtaaaaaaaggggaaaaaagacccgaataacaaggacctgcaaaggtcctacatcaccacgttcccacagcctttatccatccatctttcatccccaagaagacagtatgcaaggctaggatgggggtggggtagataaatgggtgttctcaggagaacctattcgtttaccccgtgcaactctccaccccagggatgaggcgatctgaatgcaacagggagagggaccaggtgacacgcacgcagtgccgggacattagtcaaaaagcgaggacctggggactgaggggtgggtggctgggcggggggagaaaggggagaaggaaagagaccagcacaccccccatacatacgcaaattgagagaatcagtccggctctggacacaaaccagtgaaggcaggccggagaacctgaagctctcagaggggagcaggtgtcaccgcaggcaagtccagccgaagtctgcgttccgcagcccacagaacgacaacttacccagagccgcctagagctggtttgcagcacgccaatctacgtaacctcaatctagcacgagcaacaggcagatttcgccatctttgttgtggtcaaggagtcttcttgggttcctgggttctttagtctcgaaatatataagacttttcgttcttcgctagtcttctgagctcgagatgaagcacagaaggctaaaacaatgagggacagcgttccagtagccctgccacagctctctcatcctctggtccgccctcactcaagatggctaccagcaagaatggtgcaatggcgtgacagctcggccctggttgccaaggagatgcgagtaccggaaat

SEQ ID NO: 2473 - DNA, 42142 bp, Homo sapiens; identical to SEQ ID NO: 2471

SEQ ID NO: 2474 - DNA, 44255 bp, Homo sapiens; identical to SEQ ID NO: 2472

SEQ ID NO: 2475 - DNA, 43954 bp, Homo sapiens
tttcaagtggtcataattttaatggtaaaattaggacataaaaataattttcaaagaattattttcaaagaacactagacataaaatataacaattttcaaattttcaaagaatactagaagaaaaaaattatacagtcaatccaacaaaaagcttaatagaaaaaaaccctaaacaatagtataactacaaataaaatagggcttccgaattatgtctaaataatacaataattacaaatatgaatgggttaaattagcctattaaaagataaaaccactcagataacaaaaacagacataagaaacactaacataaaacacaaagaattaaaatgaagatatagcaagcaaataatagaaagcttgcaacccagctatagctataaacacaaaaaatgaagttatcttttgacctaataattccattcctaatacttagaaatatttgcacatgtgcacaataatacttaaaggatctcaacactgtttttttttttttttgagacagtcttgctccgtcacccatgctcgagtgcagtggcgtgatctcggcacactgcagcctctgcttcctgggttcaagtgattctcctgctgcagcctcccaagtagctgggattacaggtgcacgtcattatgcccgggtaatttctgtattttttagtagagatggtgtttcaccatgttggccaggctggtcttgaactcctgacctctggtgatctgtctgccttgcctcccaaagtgctaggattacgggcctgagccaccttgcctggcctgcaaaatttgtttttaatagaagacacaagaaatgatttaaatattttatcaacagaaaaccagttctatcaactatgggcccagtatgcagcttttaaaaatgacagttctatatacattgatatgagaccatttcaaacaggtattcaataaagtatagaatggtaacatatcaccaactgtgtaaagaaaaatatataaacatatgaaatgatacattctgtgcctatgcaaacatatgatacattaaaaacaaaagaacatatagtgcctgtctctgaggggaactgtgaagctatggaaaggtgttgaagaaaacctttttatagtatgtattcttgtaattgaataaaaaataaaattacaaaaatcaggcttggaagtatttaatagcagacaaaatatagttcaatatgaaaagcattatatgagacaaaggcaattttcaaaaattgataaaacattccaccaaaaatcatgactacgcatctaacagcttcaaaatatagaaaatactcaaatgcaaaatcaacaaatctgcaattacagaaaaagacttcaacatacttttagaaagtagtaactcaagtagacaataatagctaacacttaccgggcacttcttatgtgagtggcactgaaacatgtgctttcatgcattacctaaggctagagaaaatgttaataacttagacaagtcatacatgtatcataaatatctttgtacctgacaaacagaataaacatctttttaaacaccattagataattatttaaagaccacatattgggaacctacccctaaagaacaataacaaccacaataacaactatcaccccagtaaacatggctggcaagaatacaattaaatgaacattatcactgatttggcaacagctcttatgaagaataatttggcattatgtatcaagtgcccatactctttgacaaagtaactgtctttctgataatctatcttaagtaatacaaaaatggggggaggggaataaaaatacaaaatattagaaacactatcgtcaaaatgaaagggcatggctgagtatggtacaaccgttcaacagaatattgtcattaaaaacatttatggaggctatattatatagtcaataacagaaaatgcttgaaaggttagaagtacatcatcaaattatgttttatatagctgtaaaataaacccaaatcatctttaatgaacacatactattatggtaaaaaaaagtctacaatttctaactttcaccttaggcagctttttattttgcatcctttttttcaactttgtcttctattagctgtgcaagaaatacatgtctgctaaagttacacgatcttcgcacaacagcaacctacacattagtctacaaaggggaacaaacccaaattcctcagaagtctgagtccactgttgccttctttctggccatctggcagttacaatatagcacagaatgactatgcaagttaaatattcatcttagacatggacatttgctttgggactcctaaagtggagtcaaatttgatctctacagaaactctacaatgtagcagagcactgtgcgtacttattgactcccagacaagccgaaaccccgaatttgtcatttctatcagtttttatataaattgttcttacctacttattgatgcttacaatttggcaattataaggggcaaaattggagcaagtgttttgggtaaataactccttacaatatattaaaaatacttacaaacaattcttagaatcaaacacttacgtaaatacttttttaaaaaaataggtccaaaagactcagcccagatcggctttgaagttatatcaagatttaagtctacttcatgccaatgagctactcctcaacaggggctggttttgccatttgaggaatgacagccactatgttgtgtacacaagagagctggatggcatcgacagaatctttatcgtggttctgaattttggagaatcaacactgttaaatctacataatatgatttcgggccttcccgctaaaatgagaataaggttaagtaccaattctgccgacaaaggcagtaaagttgatacaagtggcatttttctggacaagggagagggactcatctttgaacacaacacgaagaatctccttcatcgccaaacagctttcagagatagatgctttgtttccaatcgagcatgctattccagtgtactgaacatactgtatacctcgtgttaggcacctttatgaagagatgaagacactggcatttcagtgggattgtaagcatttgtaatagcttcatgtacagcatgctgcttggtgaacaatcattaattcttcgatatttctgtagcttgaatgtaactgctttaagaaaggttctcaaatgttttgaaaaaaataaaatgtttaaaagtaaattatggcttataggagcttataactttattcagatagcatcaatcagggatgaccagaacacattaggaccccagattattcaaaaactttaacgaattttaaggggaagaattttatcttttcccttaaaatgcagtcatagaaattagaggatgactcactgccacagtgtctaaaagcatttgctagcaaagaggcaggacactaatttgtaaactgctcaactgttctgactggaagggaggcctggagctctgctatcaccaatccttcccttccctctactccacatccttctaaggagcatgatttgaaaattactttcctaggttaatgggcatgtgcatcaatggagagaatagtataagcaagtgagatgtagactaagcaaaatttagatggagaagcacattttaaaaaattaataacttaaaagtctcaagttattaattttttttttgctaactcaattggaagtaagactatgaaatatttcagtgtgtttccaattcccagttgaatgcagtgtttcagaatttcaggtatttcttaagatcctcgaaaacactggtgctgtcaagtccaagttcctcgtacaggaatttaatttgggctgtaatctaaaagaaacacattaaaaaaattaaatagaaggcctttgtagtaaaatgccactgtttaagcttctctttatctatccatctttacctaaccgtgaagtcagcaatttatggcaagaatactttcattcgagagagaggcagaaggcttccaacaattaagattaaattattttctttaacagagctcacgtatcaagtacaagagagagacatttctcttgattgacacagtgtccctccctcccctcctgggtctcacccatagataggacatttgtgaagtggctttgtcataaacctgctgcaaccactgaaaatgtgaaaacaacatgtatctagttcgggaatctgtccactgagagggccttgataacatacctttttgtgagaatcctcaattacatgattgcctccaggctgaatatctagaataatattaggggtctgatagcctggaagagttaacatgtagaacaattagaagattgtatgggatcttctttggaagatcgagacccattcctcccctcttctttgagtactcagttcaaataatagtaaaggaataaaaagcaaaaaccaccatcatcaacaaaaagatgggaggggacaagcaacagaagacaaacttctgacacagcgaaagcaggaagaggccgtatggaaaagactatatggtgccacacggacaaggttgaaacccaggagatcatcaacctgccctgtggaatctgagagtcttatgccctggaaacaccaactacagcaatggatgggggtgacaaatggagatgaatacagggagactgatatggcatgtagtttcaaggcaaaagggagggattcttatctcataaagctgaaacagctagctagaggaaattcatgcagctaaacagtttgggcactgatggcccaaaacaaaaatctcagaatctgtcttttagagattcccaagaataacggctcaataaatattgttaaatgaattaataattgtatggcagtgcatctccaagttatatctgattcttaaatttcctgtttcctttgtgtcctgcctatctattttaatactgtcctttgaaaaagaggtgaggcagtgtatgtatagacatgtagttacgtacactttaactggggagtcaacatagcaaaataattgtttgccctaaatcctgggcagatgatttggctacagcctgaaatatattcctctgagcagtgtgctgtgggtagtagtctgtttggccatgttccctgcttctagggggtctcctaccttcacctgtgtccttagcatgctccgcgatggcttccttgagtttctcagtataacttacaattcctttcagaggtacccgttcatcgttttcatatgccgttatgtgaattgaaggataatgctgaaagaaaatacatgcacgaagagtttacattatttcttatggtcccttgccactatagagactatgaaaaataattacctccaatttttccctgtaagtgctctatgctttttctcacttgctatcttgagagcgcctcagtattacagtagtagactacttgttatctggaatagccttttcttgactaaaggaccttagctaatttagtaattaaggcatgataagtctattcccctgaggtattaaacatggagcatgagcagagatggtgctgaagatatttgggcatcataagtagaaacatctctaaagctcctatttttgcttcagcttggataagttttttttttattatcttctgtgtaaattcaggataatctaacacaattgtctttcactacctgaggtttaatattttgatagggacagtaacgttttatgtagttcttgtgtttttcatcagatgaaggattcccccattcttctaattcttctaatgtcagaggaagtgtagtgtccatcatggtgttgagaacatccaagaaaggtgcctaaaaaaaaggcaaagaaacttatacttcaagtaagaggttggtaagtgagtttcagaaaaacattctattttatgaatatacatactaatatgagagaaaataactcaagccatgtagattcctaggagctagaatactcagtccttaaccagggcctgtaatttataacctacttttaaagtcttcagattccttaaatgacatataacaagaaatggtttatcttctaatttcacaatatttatttttagcttagtaccttttattcatttatattttttcttatataaaagcaataaatgctactgtctcataccaattaggacagttagttattatattaaaacaacaacaacaacaacaagtattggcagtaatgtggagaaaccggaatcctgatacactggtggttggaatgtaaaatgggggagctgctttggaaaacagtatggtggttcatcaaagagttaagcttaagattaccatatgatccagcaattccactcctggcatataatccccaaaactgaaagcagggtcttaaagagatctgcatacctatgttcacagcagcatattcacaacagccaaaaggtggaagcaactcaagtgtccattaaccaaagaacgaataagcaaaatgtggtatacacatgcaatattacatggaatattattcagccttaaaaatgaataaaattctgatccacgctacaatatggatgaacctcaaggatataatctaagtgaaataagccagtcacaaaaaattttgtatgactccacctatgtgaggtgtttgagtagtcaaattcacagagacagaggctgtgggaagaagcaaatggagagctgtttaatcggtacagggtttcagttttgttaagatgaaaaacgagttctggagattgactgcataagcctatgagtgcacttaccactactgaactattcacttaaaaatggttgagatggtaaattttatggtattttaccataattaaaaatttttaaatgaaaaaaatacacaaggaataaagtctttttgaccagttggacattttatattaaaagcaaaaaacgctaagtaaagaaactctgcaaaatacccaaggtgaaagaagagaaaacaacccattggcttataattagtgttacaaaatttaataaaacgaaggctgggtcgcacatggtggctcatgcctgtaatcccagcacattgggaggctgaggtgggcaaatcacttgagcccaggagtttgaaactagcctgggtagcatggtaaaaccacatctctacaaaacaacaacaaaccacaaaaattagcagggcatggtggcacatgcctgtagtcccagatactcaggaggctgaggtgggaggatcacctgagccccagaggtcgaggctgtagtgagctgtgttcgtgtgccattgcattccagcctgggtgaaagagcaaaactctgactcaaaaaacaaaacaaaacaaaacaaaaaaacaaaaaccccacaaaaacaacaaaacaaaaatgaaggctgtatttttcacttagctttattttcttctgttaacatactttttagctttccctcatattaacattaaccaagtatagtgagtcatctgtaattctttttggctgcctaccatatgaacttttttgcatttgaaaaacctccaaccttatcagctagagcctgcctctcactgtggagatactaagtgctagacttctctttcccatttttccctgcagcttgggagtagctgtgtgacccatgtgtgacttgggtctatcaaccagacacatgtgctttacactctgcatggaaagttagtgattcaaagaagcagtgatcacagataatttattctggcaaaagtgccacagctatatccagctctagaagttgcactggcagtgtgaggtgatttgtgcttggcagtggcggcagtaatagtttcattgggccaattctatgcctttggctctgaagcctctaacactggtctgaagacacctacattttcctaatgccctttaatcccttttctgcttaaattagggttgatttttggtgcttataagaagaatttgacttatacatgtataaaaggttgtctcctagtcttcactataataagcaacctagcataaatatccttctcatcatttccttttaaatttctaaaagtcaaaatctagttgctttgtctttaaactgtaaataattctgccattatctttgtgcataggctattctccacatttttctgtttttaaaaaatagacttacaggtgactactatttaacacttatttacaagcccacagtataaactccccaacctcaaaataaaaaatcctgaaaataatttactctctcccatctcagtcattatttttcagagtaacctagaagtaggagaatgatagcagtgaaaccaactgctacaatgtaacttcgtaatttctgacactgggaaaagataatcattttcagaacagggtaagatatttcaattaaaatacggaaaaactatgcccaaacgaccattaagaatggactatctaaaaataaagagcctataaatctaggactgaaatgttgatgggcagtagcctgtcaaggtgaccaggagccaaaggactcagtgcattccagagtcacagcgtgctttgcctggctttctcaactgggactcatatatgcttcagtgctttttcaccaattctaaatgtccttacaaatacaaatgagcaatggaaatagccattaatatctttcagtggaaagccttaaagataataaagaacactgtatcagagaagaataacggttaatagttggattaaaataactttagaagttctcctcaagctataattctgagtttaaaacttaaaagctttgttatactcctatgctatggtaaaactgtaacagaaatgtttttctttccttttttttttttttttttgacaatgtctcactctgttgcccaggctggagcacagtggtccactgcagcctcaacctcttaagagatcctcttaccaacaagcctgggtaggtttttttttttttttaatttcttgcagagacagggtctcgccatgttgcccaggctggtctcgagctcctggtaagcaatctgcccacctcagtttcccgaagtgctgggattacaggcatgagccgctgtgccagcccaaaaacatttttcttagagtagcctatggcttcacacctcccccattctataaacagtagagacagagcgtactcacctccaaagtcaccgctctcaccagctctggattagaattacacaatgctcctgcaagcacccctccagcactgaaagcagtcagggttgttagacttggctgagaaaagccttggccatgaagcgtcttaatgcaagcctctaaatcagcaaggccattgagttttttagttaggcggccatcagcgtgccactggaggcctaactcaccaccacctctgaaattgaagggcaaaaaagttttagtggaaaaaaaaagttaatactgtaggctggggtcagcgaactacacctggaggcctgttttttgtgtggccctggagctaagactggtttttgctttttaaaggttgagtgaaaacaaggaatgtgcaacagaaactgtacgcggcctgcaaagcttaaaatgtgactatgtagctctttagagaaaaaggtttgccaactcctgatatagacaatccagaattgattcaacgaatatattttgagtgcctgcccatttatcagggattaagtacagaccttaaaagtagaaacaaacgaaaatcccctaccgtggagaagacagtaattttgtggggtaagaaaacaacgacttacccagcaatgtggtgtcattgctacaatacaagtgtatttaaggtattacaggagcagaggaaagaacatccatctgccaggtgaggggtatatacacgagtcaggaacacaaatgcttttaaggagatgatgcctaaactgagttgtgaaggaaaaatttgagtttccagagggcaaagaaaaggcattaagacacagatacgacacagcatgtataagggcaaggaggtgacagagcatgtcatttaaaagacatgactttgggggctggacacagtgcctcaagcctgtcatctcagcattttggtaggctgaggtgagcaggtcacttgaggtcaggagtttgagaccagactggccaacatggtgaaacccccgtctctcctaaaaatagaaaaaattagccaggtgtggtggtgcgtgcctataagcccaactactcgggaggctgaggcaagagaattacttgaacctgggaggcggaggttgcagtgagcggagattgcgccactgcactctagcctgggagacagagtgagactccatctcaaaaaaatacaaaacaaaataaaaaaaataaaaggacatgattttggaaggctgaggcgggcggactgcttgagctcaggagttcgagaccagcctgggcaacattggaaaaccctgtctctactaaaatacaaaaaaatcgggctggtacggtggctcatgcctgtaatcccagcactttgggaggctgaggcgggcggatcacttgaggtcaggagttcgagaccagcctggccaacatggtgaaaccccatcgctacaaaaatttcaaaaattagtcaggagttatggcaggcacctgtaatcccagctactcaggaggctgaggcaggagaatcgcttgaaccctggccaagatcatgccactgcacactccagcctgggcgacagagcaagattctatctcaaaaaaaaaaaaaaaaaaattcagacagtgtggtggtgtgcgcctgtagtcccagctactcaggagcctgaagcatgagaatcacttgaacctgggaggcagaggttgcagtgagccgagattgtgccactgcactccagcctgggcgacaaagcaaaactgtctcaaacaaaaaaaaaaaaaaaaaaaaaaaaagggtctgatgctaaatgccgctacagagatccatcagaccattaggagtattatactggggaatctggactgtgttctagagatggggaggtggagaagaattttaagcagaaatacaaaataatatttgtgtcttgaaaacagctgaaataaaatggaagttaaatggaaaacagttcagattcagaggctacttaaacctgaattcaggagaactgaaaggaaataataatattactaaataagtacagagtctggtacctctatgcaaaaatcctaaaaacctatccttttgctttttggatcaactaatctgttaaagaatcaagtttcaccagtgctggtttaggaatacaaaaattgaataataagaatgaaaaaaataagcttttgttccctgatatatattgttattcttgacatctctcacaatggtctagcacttacatgccaggtaaaatatactgactcaccgaacatggcagtatgctaatatccatccatcatccaccaggacccgcctctcaggcctgaaattcattttcaaatccattccataagctccatatacatgtaccaagagaggtttcttctgcaagtcctcagagtcagttttgtggaaaacagtcattggcactaattttccatcctagaaatgaagaattactatgtatgtaaagaagagtcttttataataactgttttatcccaatttaaaatacattgaggtgcactgtccccacttgtgtgctacctactgatgttgagcacaaatttgtttaagaaaaagaattatggtctctaaaaataaatcatggcttttggtttcagctaccttgctgtcctacagtattaaccagaaaagagcagcaagactggcctgaaaacattttattaaatgcagcttttcatgacaataatgtaattttaaagagttcttcactacctactataattttaaattttcagatgaaaccaaaatacttaccaaggttagaagtcctagtatagcactcttcctatgcctaagagctagatattggcatttttcacttttgagtatctacaaatatgctgactaaagtcttaccagctcaattttctatatcctctgtagtcggaattctcaaccattaagacctgaaatcttactgatgttactgataactaccacaatcctcttcaaaggcccatttaactttattaaaaaaaatttaaagtggtcttaaaatttttcggtaaaattctttgtagggttaaagtaagttaaattatttgtaaggttactaagttacttgtaggttatgtaaccatcccccaatgtagctcaaactcatcagttccagttgattgaaactaggcagtctctgaacagacaaaagaactaattctgatctacctttcacacaaaaaagataaagaaattggttttcaccctgcttaaactaatgaaatagcaccgtttacataaagaaaataaataatacatccaagtcactcttcatattttcattctcattttgaaaacttcactttggggcaataactggagacagcaaaatgtaatcaaataaggaggaaattctcctctcattcttctttaaaatacccaagttgttatgacattgttaactttcacttttagtaagattcacttttataaaacttgatgtagattaatttctataaaacactcttggtcttttcacttcccaactcttccccaacttcaattatacaatcagaaaaagttgcttgttgaaaagttttgaaaggaagaggtaaaacagtagctactcctgtgatgggctggatctgggtttgccagcagtactaaaatgcctgtggaaaggtatagcgcttccattcagcagctgcttcccttctcccctcttggctctccaagaacatggtgcttaactgttctttccatctcgggtccaataattgcaacattttgatagactagtctaattccatgtttgtaaaaccaaataaaacctatctaaaagataatacactaagtgggtaacaatgattatttctaagaggtgcagcaagcaaatggtactgagaagtagtcatttaagatttgttctgtatttttgcatctgttcaacaagcatgtattgcttttgtaatataaaaatattaatatttacttaaagattgtcagagaaaaataaatgaattaaagaaaaaaattcctaagaataaaaggcttgtgttgtaattcattgtgtcagcacatgtgaaattatctgatatatgatatgctaaagtctgaggtttccttaaattcaaggctatagtttacatattaatttgttccctacttgcataaatttgtatattctgtatattgagtatacctggaatatggatatttgttatttccttttctgtgtctcatctctctctactcctcaccctgccaatcttccctcttttacttgattttggccataatggcctcctttatatttgttctttttctgagacaggatcttactctgtcacacaggctggaatgcaatggcgcaatcacaactcactgcagcctcaacctcctgggctcaagcaatcctcccacatcaggttcccaagaagcagggactacaagcatatgccaccatgcctggctaatatttttggtttttgtagagatgaggtctcactatattgcccaggttggtttctaacttctgggctcaagtgatcctcccagcttggcctcccaaagtgttgggattacaagtttgagccactgtgcctagccctacacttcttctgtaggctggagagcagtggtgaggtcttggctcactgcaacctctgcctcctgggttcaaaggattctcctgcctcagcctcctgagtagctgacattacaggcacctgccaccacacccggctaattttttgtatttttagtagagatggggtttcaccatattggccaggctggtctcgacctcgtgatctgcccgcctcagcctcccaaagtgctgggattataggtgtgagccactgtgcccggccagccctacacttcttgaattgtataatttctccccaaattcagggcctctatacaaaatggaatcccctatctcctttctagtttactcttaatcatcctagtggtcttacctgagacataacttccttggagaaaacttccctgatctctctagactaggtaaaatccctttgctctatgctcccactgtactcagtatgtcctcctttgcagcagtcagtacattattaatgactttttaaacatgtcatctttcctgctagatgtatgctccatgagggcagggactgtatcagtctagtttactctagtcaactaccaccttcactatttttgccataactacataccaactctattaattttttcttaaaatcaactttaaaaaatcagacataaacaacatgtaaaataaaaagtttgacatgctataaattttcttttttttttttttttttgagacggagtcttgctctgtagcccaggctggagtgcagtggcacgatctaggctcactgcatgctccgcctcctgggttcacgccattctcctgcctcagcctcccaagtagctgggactacaggcgcccgccaccatgcccagctaattttgtgtatttttagtagagatggggtttcaccgtgttagccaggatggtctcgatctcctgacctcgtgatccacccgcctcggcctcccaaagtgctgggattacaggcgtgagccaccgtgcccggccgacatgctataaattttctaatccatgttaaaacaaacatgaatattaaggttaaaaaaaattcacctatccctaaagtcacttgggtattactgtggtctaagaaatctacattaggaaaccgtgctaatgtaactccaacaactgcatggcatctggcaaacggtatgctttcagtaaatgggagctgaaagtgaagattataagacctaccttgcttttggcttctagacgtaaaacgcgactagtctttgtgattgggtcttcatgcccagtttcctcaaacagtttgccttctgcaaacttgtatgtgtaatattttgggggacgtattggagagcaaagttgaaaggggcagttctttgggtcagaatttgtatccattatgaatccacaggcccaaggagggagctaaagaaatacaacagctatttttattctttatttaggccaccaagtatcattaattaaatttctaagtcttctccaaacaagatgatgtggatatctcgtttactttttgttaccacgtcatgcctcattcaaggattactttatcacaacaacatacatttcaaataaaaaacaaaactgtacattaatgaccaataaaataagacaaactataggaaaatgatttatcatgattctagctttacatgaaattgcctttaacataaaagtttattttggggtataatcttggataataaaatagtaaaatggaagaataagagcaaatcaaatagtaattccagaacccaccgacactgccaagatctctgttctcaaagaacgtgaaattcctcacatgcgtgtgtttttcataatttacccactagtccttaccctgctgcctggacagccacagtgatgacagttattatttcagggctataaacgggctcagcagcattaaggcatttgcaatttgtttctaacttttagctcctaggctaaccattgtgcagaacaaaacctcttctggcacatctactctgagagactcacagctattatactcaaggttcttaactttaagaaaaaaggaaaggaatcaaaatttattctctcagagcagcagggtccagcttcaagccttgcactaacatccctcttacaccttttaaagaactctggtaagcaggttgacagagcgttagaaatggtaccgagaggcagaacattaaaagaaaattgcctttcttttcctgagtaattgtagaaagagcaaattccttagaaaatcagaggcacagaaacatcactggtgggcactattgaaaaagggcagccggggatttgtgcgtaaaggggataccattccacctgcagcaactacagccagagtttacgttctctgagcaaatctcttattaataaaaaaaaaaaatctattttcatgaaacactagtaaggacacacatctgcaatctctaaaagctcctaatgtatgcttctcacattgagggttgttttaaaggataacttgtctatttaaatttaagccataactggagagtaaaatgtaaacaaaaattgagaaatctggtagcatagttataagcaagcaaactgagacttgagaggggaaaaaaaggaagcactgctacaaacctcataaccaggcctcagagcgagggtacaaggttccttagcccatggaagctcaagtttttctgccctttgatgagacttcaggacagtctctatgtgacccacgcagtaagctgtcttagctttagaccaagtggttccaataaatcaaaaagtatttttggtgtttttctaaaactaatgggaccaacattaatgttttaatcataataaaaactgtttcaaggctatggacttttagaagttcatccagctaatgcagatataagtattaactaactcaaggatatcttaagccacatttcctattcagataagcctgcagtgtatctgtgtatattaatggacagcaccagagagtaagtaggccaggagatagggagacattccttagatacctgagagaaacaggttcagttttagcactctaccagcaaactatagttatttcatcaaaagaataagacatacatgccgaaagaaaattggcctgaatatgcagactcctcctctaaataaaactgatgttagcatacagcaaaaaacgtcccaactggcctaaattaaatatcataacttctttttgtgacaaaaaaaaatacttccagaaaatactgatggcatggtgaccaaggatacgaggcaaatatgtgaagggttttacatttctgttgctaagatagaatttatttatttatttagagacggagtcttgctcttgcacccaggctggaatgcagtggcgtgatctcggctcactgcagcctccagctctcggcttcaagtgactctcctgcctcagcctccagaatagctcggactataggcacctgccaccacgcctggctagtttttgtatttttagtattctttgtattttatattttttgtatttttagtagagacagggttttgccatgttggccagggtggtcttgaactcctgacctcaggtgatccgcctgccttggtctcccaaagtgctgggattacaggctgagattgaatttaaaaagatcttttaatcaagtgcccaccaggcagagatactgcataaagaaatattttataatgcactcacgctatggttaaagattttgtctttcgtgtatggatggcactgtctatgtatattaattaatattattcaggctcataaaaagggtctgatctataaaattctctttattatataccaggtactaaccagaaagatcaagaagtatttaattccacttgatgatgactagaacattataaaagtcgtaataggtactatcatttgggaagggtcagaaaatgaagagatagaagatacagaataaattaaagacataatgtttgttccagtggaatttaaaaccatggaaactggggcatatctttaaaataagaatacttacaaaaaatataaaaggtcatatttacttagaagtcaaatcatatagcagagtaaactccacatgacatttctaactttcctgacatagaattttgttctaacaagtgcattgctagaaattacatattctctcccattcttattcatacagactgaaataataatagatgctccaccagtttcccaactgaagatgtctaaatttggcaccagttaacatgtaaatggttagccataggcagaagattgaaaactggaccccttccttacaccatatatacaaatcaactcaagatgaattaaagacttaaatgtaaaacctaagactataaaaacccttgaagaaaacctaggaaatataattctacagaaaggcaaagattttatgacaaagatgccaaaagcaattgcaacaaaaacaaaaatcagcaactggaaactaaagagttcctgcacagcaaaataaactatcaacagagtaaatagacaacctacagaatgggagaaaatatttacaaactatgcatctgacaaagatctagtatccagaatttataaggaacttatattaacaagcaaaacaaacaaaaacagaaaaaaaccccaacaccataaaaaagtgggcaaaggacatgaacagatatttttaaaagaagacatacatgcagccaacaagcatatgaaaaaaatgctcaacatcactaaccattagaggaatgcaaatctaaaccacaacgagataccatctcacatcagttagaatgactgtagttaaaaagtcaaaatataacagatgctggtgaggctgtagaaaaaagggaaagcttatacactgctagtggaaatgtaagttcagccactgtggaaagcagtttgggaatttctcaaagaatgtaaaacagaactactatttgactcagcaatcccattattggatatataaccaaaggaatacaaatcgctctaccataaagacacatgcacacattatgttcatcacaatagcaaagacatggaatcaacctaaatgtccatcaatgatagactggatacagaaaatgtggtacatatataccatagaatactacacagccataaaaaagagataatgttctttgcagcaacatggatgaagctggaggccattatcctaagcaagccaacagaggaacagaaaatcaaacaccccatgttctcacttataagtgggagctaaacattgtgtccacatggacacaaggaagagaataacagacactggggcctacctgagggttgaaggagggtgaggattgaaaaactacctattgggtactatacttattacctgggtgacaaaataatacgtatatcaaacccctgtggcagacaatttatctattaaaccaacctgcacatgtacccctgaaagtaaaagttaaaaaaaaagaaatgctatctaaaataataatattaaaatttttaaaattagcaagtgaaaagaaatactttgcactccagcagatgaagacaataaggacatccctccaagtcagtcaccattttggttttaggacacttacatagtgttctaagagactggacattacatttgatcttttgattttagggagtagctggagatttcagttatttcaggcccttgttatttcttatttataccaataaaacaatctcaaaactagcttcctgccccttacttctttttggtttagtgtatcctaatatggctgccactcctcaaaccattcccctgctcaaaaacttcaaatgttacctttcataattaataaattcctcatattgacactcacaaaaagtcaaatcatgacttcatcccccagaaatgtatagcgctttaataaaacagaataattaacagtttcctgaacattttctgaatgtcagagcatacagcttcatttgatggctttctcatcttggaataccatcccctctccacctgtcaaaatcctatctctcttctctggtttatttcacattcaaccaactttaccaaaagctttcctgggccttcttctctagtttgagccccacagcacattttatgtttttgatactacttattcaaatccatgatacacttaacctttatgtactagtttaatcttgtgattaactatatcttccttaaggctaggatattctgctttaacagctttcgattctataatgcccgatacagtattgtgcacatgaaagttcaataaaaagccactgaattgactgaaattgcatttttacaggagttttaagaatattggagttagggaggtataaatggtctatgctgtttgctcatcaactggctcagtaactcttttcatatcaaacaaaatggaagccatcctcttcccttcagtgcctactacctcaactcacatgttaatgctgctttaaaactaggcaataaggttgtcattcaccaattttaggaagttcacttgtgaaggcaggttatctttcctggtagccacaagcagtatcaactagtcagcttgccaagcagtcttgccactattagccttctgtgctgctgtggagaccactgctactcctacactgaaagaaaccaaagtttgttccctgcatcccctgcggataagaaaactggcagacagaagatgatgcagacaaaagcatgtagtggctaaaaacacagtggataccactactgtccctgttggggatgtgggatgggggaacagcagtcagtgtttaggcactagctaccaactttggcctgagtttttactatatctcaagttgcagagatatgtgaggtagagagatatacagaaagagaaatattagcactcaactctacttgtgaagtccatgccataagacactatcttaagtaaaactgcataaaaagcaagatcctctaagtaattctaagataaccctcctaaacccaagagtgactttgctaaattccatttaagttacattcctttcaagaaaaagaacactgctgccactattcaaaatgtgatgttctgttaagctaaactgcataaatattttgattaacagtattaacttctgaaaattaaacatacctttagagaccgaactgaatcatcagccagaccaatcacattaacataaaggagattgctgtgcttcagaaatagaacacagtgatccttaaacatgtccaagtctatcacttttgtatttctcttcattgtaaaaaataaatcccaattcataattgcaggggtatcagccgctgttctcattagctacgtggaacaaagttagaagacatataggtaagaaaacacgaaggctgcagcatccagagatgcaatcactgagaactagaccatactagtcctcactgttttatgaagagctgaaggaactaacgctgcatcagggataaagtgtgaccatcaaccatatgaatgagtcctgactagcctgctgggtggtgagacagtatatccagtgcttagccaaccactggacatttgagtgagggcactgacagctagctgactacagatacatcagtgagcttagctgatatcagcagaagaactgcctagctgagatcaatccaaattgccaactcataaaatcacgagtttgtaagtttgctcttttaagctactaagtttgattttgttaacataaactcaggacagaatatgttttatttactaactttttaggcacaattaaaatatgtagaggcattagctctaagggaaaagaaatgggattggttatacataggaaggtggcatcaatttataaaacaatgagctcttggagcaagaaatgttgttgatcgaagtgtgacacttcttaacagcccaaataggaacaacgagcatccaggattaccttaaattctgtaggttctccaacattagtgagaatgtataattcatcatctctgtgttcaacatagtaaaggaccccatgtattcgcttctggataagtactggtgggtcccaagggctcaggccatctatcaaccacacttcagaagtagtcttgttcataatatttatggtgaggaaacgactgtcttttgtaagataaaggaaaacaaagtagctagagagagagagagagacatgagatcacagtttatttcagatgcatgctaccttgttaaggacagtatctcagaggtggtcagtatacatgttgatttataatgcagataggaaattaaaataattccttagtgaatatcacttgtaactttaacaattagctattatttttctcattttctcctaaagggcattcaaaataatttacttctaacattttatcataaatgtttttcaaaaatacagaaaagttgaaaaaaccatcttgattccatcattgctaacattttgctacatttactttattacatatctatgcacctattaatccatctttatttggatgcatttcaaggtaaactacaaacgtcatttctcaatcacatgagtagataacatagctttttgctgagaagaggaaataaactttctataggagacacaaatagggaataaaagggacacggagttatttttattttcttctttctctgcatgcattttggatttttttttcctttctcccagtttttacaacaaaatagaataggaagaaaacccctcacaatcttactaacgtaacacatttaaaacattaacatagctattttactttttaaatttttccttctaagttatatttatatttcatgtgtgtctttaaatagatgtaattatagatacaatttttgattctgtatttcttacttcatatatcaattttctccctacatgagttgaaagtctttgtgattattatttttaaaggctacctaatattataacaggtttaatggctacctaatatatcataattcttaaaaatttagattttaatgtttcattataataaacaatataacaagaaacatattcatgaagatattttccccttccatgatcttcacaattattttcccaagacaaatttttagaaatggaaatactaatttaataagtgtatttttatgacttgatgaatataatcaaataatatcctagaagcactatactaacataatgagtggctttaaatgttatatttatatttttccttattataaaagtaatttatactgaaactactgaaaaacgtaaagaatcccaatgcccccaaataacaactgcttatagtttggtaaaatttcttctgtattggatcacattaccatgtttatttgtcaatcgttatttcttttgtgaaatgtgtgtctattttaaactttgaatgtagcttaaattattagtatgtaaatagctctttaaaaattaagaatattggctgggcacagtggctcacaactgtaatcccagcactctgggaggccaaagctggcagatcacctgagatcaggagttcaagaccaccctggccaacatggtgaaaccccgtctccacaaaaaatacaaaaattagccaggcatggtggcaggtgcctgtaatcccagctacttgggaggctgaggtagaagaatcacttgaacctgggacgcagaggttgcagtgagctgagattgcgccactgcactccagtctgggtgacagagtgagactctgtttcaaaaaaaaaaaaaaaaaattaagaacattaacttgtctttttgttgaaaacactttcctccattttgttacctagattttaactatttacaatagtttttgtggtttttgacttgagtttaatattttacgtaatcgagactgctactaccctttgtaatttcttatattgattttatgtttcaaaaatattccaaccaagctgactaaaaagcttatattttcatcttattaaaaaattatttttctcaatgggttctttaaatctcttaggaatgtatgctgacatatacaatgatgaaaattattttttcccaaatagtatttcccattgcattataaaataacaccgattcatttttcattagtttgtgatgccttttatcatataaattttcacatagactaggatctatgttttagagttattctaagctctattatttgtctatcaatttgtattatttttactgttattgctttatatgctttaatatataattgtagggcaagtcccctaccctactttgctctttattttcaacactttcttcgctgtttttatatatttttgtttgcttagtttggtgatgacaaattaaaaataaactacttgaccaaatagttgttagatatgtggttacaggaagtgagaacacaagtggctctagggtaaaatgtgtctaagagaatatacgaaatataaagaactagacattaatctttttttccaattatttctatcgacaattatttttaaatttaaaatgtattataaaaataataatgcttattacaaaaagaaaaaaagaaaagtaaaaaaaaaaccattgttagtactttgggtgtatttcctttcaatcttttaaaaatgcatcttttttccttgatacccaattgaaaccatagcatatatttaattttttcacctagcacaataatacatttttgagttagttttaatttataatttagtagcaacacatactttaaattcttctatatattactaagaatttaatggttaaaaggtactcaacaatcatcaggaacaaggggttttagtttgaaagagagatacctatctaagtatataccatttatttaagcaatagatactgactaaatagcactatacaaacctggcaccctgcttatcaattaagatgcaaaggtgaaacagactcagtctgttcacaatctagcagttctaggtcatctttatgaatttacatgaatgaactatgttgtaattcacaaaatcaatttcagtttttaataaaatattagtgatatatctgtatttactctgattttgaatattaccagactccaattttgaatacaaacaactaataaaagaatgatcgttttagccttattattcctggttccaaccaaaataaacgttttaagtcaaccaaagtcagtactttaaataactggaggaaggttctggagagaaagatttaattatattattctagtaccttgggtctttttctgtgtaaaagcgttcattacgtttgttatcaccaaaagtggctcgatatacgtcatgacagcgaaggttcctctggaaggtgtagaataaaacatcttcatcttcctcgtcctttacccattctgaaagaaaataatgagataattatacataatcacctacactccattaaaaaaaaaaaaaaagcacagcacattctaattttgaatgccagtgagaacatgtgcaagtttatccctggaaatctaaatatttgactgtatctaatctgtgctgtatataagccagagagctttcctgagaataaaccactactacaccattccaaggtttcaagtagttatcagtctcagggtactcaggtttctaaataagagctaaatgctcaatatttaggaaagacattggtaaagtcacatttgcttttaggaggtgaattccgtctcaatctacaacttgaaactgtaagtctgaaggaatattgcatctttctctcatgtgtaaaccttctctgtctgctttcaagccacaggatatctccaactaccaaacacaatttaatgctgattcttgatcccaccagaagctgtcaacagaagtttgcacacaattacaccatgactgccacctggctgacagtgattgtaagtcatcattgtataatatgcaccatgattttaaaggttataaaatgtacaaaatatatgtcttagaattcaatagttagggtataatttcaattcactgcaacaacatttagttaaacaatggagaaaatgatggctgaaaatgaaaagggaggacaaaatgtaacatatgtaccactcaatgataaatttaaagttagttctattactaaaaatgtcacagcttccattgataaacaggttagttcaacacataccaagttctttggtagtgactttatgctgtaacagctctataagataacatgaaattaaaaaaatacattcaagcttaaagttgaataaaatattaagatgcaacttacgtgtaaaaatttattctagataataatttggcaaataattctgataaatcaaaacatattgtatgacatggactctaattataacacttttaaaaacatgagtattttaaaattacccatctagatatataattaaataagggaaggtctcctgaataagaggtacataggaagatgtatagtccatagggatacatgaatcaggcattcaccttctccctccctcacatgcgacaaaaaaatgtttcaaaagtgttaccgttgcctttcaacacagaggactattttggttggtggcttaccaaaactggacacattcgggaaagaagcttccattacgggctgatcgctgagctttataattacacaggtagatgcttcagaatcttcagttcttatcttggcagccacatatttttcatctggagcaactctgatacaatcaatgaagggctggtctaacttaagttcctccaaattgaataaaacttcataattatcattgtctgctgtataaagaaaaatacgaaagtgataacttcaaaggatgtactttaaaaaattaaaactgtattttaatgttttaaattagaattcccattctgtaagaggccatatcctagcttctttcaacaatgatggcagcttaacttgcacatcaactgacaataagttatttaatattaccttatactattcaatactattctgtgcatcaacctatgagacattatttgatattgttatagtctagtttagtatttacagaccatacagaacctagaaagtaagtgaatataaatgacaatcaacaatatatgccaagtgcctagcatagtacccaagacacagcagatgctcaaaaaatgctggatgccgtctccattctccctgccaaagcttctgagtctaactatatcttacacaaacccagatattaaaaactagtcattaaaaaaaaattcagaaataatctttaaaaaaatcttttctctatctttgagaaattaataaatttcctataaaaaatatgaaatctgaaaattagagcacgtaaaaagaaaaattgtggtgtaccttcttcatctttggaacgaaccaagcaacaaccttcttggtaataaacaaaaccaccatgtttaacctgacaaaagaaacatgcagtttacttaataataatttaattaaccttttcatagtctgactattcaagatgaagatgaaatgaagactcttataaaaaacagacctgttgaagtatatgaatgaacacatatgaaatataaaattgaccatttttacaatgtagttgataagatatggttttcgtatgttcataaccactagaggggtttttaatacataaatacaagaggcaataaagaaaaggtataacaaaatctgtcagttctcacaactgtacaaaccacttctgctacattttagaaacatctgatacctgtacagtgggagtcaattaacagaaatcaagtggcatctttaagacaatccaaaatgatgcagatgaggaaactgtggctcagactagcctgaaaacccagtctataactttctgagactccttcctttaaaatatgctgtcaccaacaactatacacagtcttgacttaacacaaactatttcacctgctgtagggtgacaaatacaatttgaaattgagagaattaatattacccaaatataaatagtgttcttgtctaatgcctacatattaaatgtaattgattggttgatatgatttcagtggcttacgtttattatctgttagttggtggcgtaatttgaatctggagatccttattcttaacctactatttccactctactatgtatgtgattttcacctattgcggttcaattttccaatcttattgaaaaattcaattcattttttcttttttttttgagacagagtcttgctctgtcacccaggctggagtgcagtggtgcaatcttggctcagggcaacctctgcatcctgagttcaagtgattctcctgcctcggcctcctgagtggctgggactacaggcgcctgccaccatgcctaatttttgtatttttagtagagatggggtttcaccatgttggctaggctggtcttgaactcttgacctcaggtgatctgcccaccttgacctcccaaagtgctgggattacaggcgtgagccactgcacgcacagccctcaattcatttcgactgactatttatgactgtgataaccataaaatggttaaacagatacttggctttcatggtattatactacttaaagtgaattccttttattaaaaaatttagacaaaacaatcaagtaattttcaaataataacaaagtatgaactactttcatttgaacttctccttagaatgattaaaaaatttttaaatcagtgctgggcatggtggctcacacctataatctcagcactttgggaggctgaggtgggagggttgcttgagcccaggagttcaagatcagccagggcaacacagtgagaccctgtctcttgaaattttttttttttaaatcggaactgattgtttgcaaaaaccagaattaatatattacagttgaaaattcatcttactttcgatctttacatttattaaaagatgtaaaggatcacattctgtgatcacaatctctgaaatctttgctttttaagtttttcagcatattttaaaggccaaaagcagtataatcttgatgtggactatgtctctaaatcaccaagtatctcatttgcatcttgattggtaatatcaaaaatttttttttaaagacatgagatatcttacttccacattgatgatttcatattcttcttgtggctgtgtttctaattttgttctcactttttcaaatgcatccatgttttctggaaggggtttttcgttttcttgtttaacaggctgaagatcctggaaaaagttttgttatgatcaaaatatttcaaactagggaaaaaaaacttttgctttttaaagataagtaggtctataccgtagacttaacgttgtacaaaaaagaaataagattaaatagtaggtatttcacagattgtaaatgttctttcctaggctcatcaataaaatgatctttttcgttaaaaaaagtaaacaaagtaagatagacatttgatggttatactattattttagatgaataagtccttaagaagcaggaatactaagaagctcagaagaatgttcagaaatactatggggaaaatttatacacaattaaggagaaaataaaattccatgaacttttacatatttaataggaaaatcaggtagagaaaaaaatctttcgcgtttaggaagtactgaagtacttcctaaaagaagggaaatatcaaagaagtggaagacattatcactactaataaatgttcactattattttattcacagccagagtgataagaaatatttccctacttcattaactataattttttactttttaaattttttaaatttaaatgggtctgagaaccaagggatataattttcttttcttgtgggaataactaagccccaaaacagaactgtttatcacatcaaaaagtaaactggcgaggcgcagtggctcatgcctgtaaccccagcattttgggaggccaaggagaatggatcacttgagcccaggagctcaagaccagcctgggcaacatagcgagaccccgtctctataaaaaaatacaaaaaaatttagccaggtgtggtggcacacacctgtagtcccagctacttgggaagctgaggtgggagggatcacctgagcccaggaggttgaggctgcagtgaagcatgatcatgccattgcactccagcatgcagagtgagaccctgtctcaacaacaacaaaaaaaagggaattaatgcctaatgaaacagagcttctttttcagtttctttgaggaaaaataacatgttcactttatgaaaggaagaaccaggaaaaataatagaaaataatgaacatgagtggagatatagatgaaagctaaataagcattcactgtgtcttatcaagagtgactaataagctgacagctttatttgagttctggtaagcaaattaatatcatataaatcattacaatttggataaagcaaaacctgttatcaaatttaaaaactgtttaataattcaacactccagtggtttgccttgtttaagcaaaaggattctggccaagatattttacttcagctctctgccaaagatgacaattgtacagtgatttgtaccagaggggggacttaagtctttggtaaggatcgccaacagctggaaagtatttattgcataaaatatgtccatgatactttaccaacattgtagagaatgtaagctataaatacagtttatattacaaagagtttacaatctaaaattaaacacaagaatataacggaaaaatcaccaaaacaaattaaatggaaaataatcattttcacaaaggttttccttttagatttttttgggacacattattatttgaattagattaaaattagcaataatggttgttatgatagtctcaatcatttagcctctacttactatcatataattttctgaattttttttaagagacagggtctcactatgttgcccaggctggactcaaactcctgggctcaagcaatcttcctgcctcagcctcccaagtagatgggactatagataggtgtgtgcctcctcattccatacagttaattttttgagtaattatttgaagatcaaatactggaggcttatatatttatttttcattcatttttaaagcatttctacaaaatctacagttgatctttaaagtggtgagacatgatatctgtatcaataatcccctcatatcaccatcataagtcagaagatgactaaaaatctattctgaaactgtaaaatagcaataggagctgcctttgcatttctagattcaggattgtctgttctgtaatttccattaaaacttttgaagtagagtcaggattatctctctactaccctgtagcttctagcacattctaggtcatggagctgggttctgtcacttttaaatactcattcttactgagagtcatagccaacacagagccaaaagcaacagagcgggctccaaaactcatcttcttaactttacattccttcctgattaacattttttctgtcatatatccaaataaactgagcttatctgaaccaaaataactctgaaagcaataggatttttgactcccttaacgaaattcaagcagaactcaacagctttctaagtaactcttctaaaggaattactcccatggaaactgaggttttatataatattcattaagtactccaggttacttttggtttttgttgcgtcccagggatacctgctcagtgttttaagctttcatttcaatttcagctagcaatatcattagcgtacacagctaaagccatccattttagccaggtatcttagtccagttgtttcaaaggcatatactacccaatggagctgaggtaaggatggctttaccttcagattttgagaaggttactggtacagtatcactccattagtggtaaaaagaagcactccttcccactccccaagtgacccaccactaaatcattttaacaatgaaagctgttataaaatagaaggagaatgatatgtgttaactttatcatggcaaagatgctgaactctaaagatagaaaaaatggtgaagtagaaagacaccggacagcccttcagtcaagactaattagccattagtaaatggctaattctaaggctagagcagggagaaaatacatggtaggtttgggaaatcttatgccagaaaataaggaagtgctcaaagtttaatggagacatgtcaaaagaatacaagtgtcaactgaaggggtttctacaggccacattttggacaactggagcctcaaaaagaataataaataataaataatacattgaaaaaacataaatccacagcaattgaaaaacagaatgcaatatgaagcatttcaatttaggaaaacagaaaaagagtaagtcttaaggaagtagaagaaaggtaagaaaattaatttttgaaattaaattgataacaaagaaactaaagagaatcaaattaaaagttggttcttttagaaacctattaaaaaacaaacatcacaaaactgatagaaaaaagaatacgaggccgggcgcggtggctcacgcctgtaatctcggcacttcgggaggccaaggcgggtggatcacgaggtcaagaaaaaagaatacgaggagagaaaaaggcataattacagatacaacagagatttttaaaaattacaataagctttatgtgaatctatttgaaaataaatgaaatgggtaattttccaggaagaaaaattaccaaaattgacccaagaaatagaaaagctatataagtcactaactcttaaagaaattaaattgctaactaaatgtccccttcttgaaagaaacaccaagcccagatgctttcaaatgtagctttcttggatcttcaagaaacagctaatcttttcatacgtcaactatttaaaaaaatagtaaaagaggtaaaactactcattttattaggctaatataaccttgacatcaaaattagacaatgatgatatgagacaattaaaaaaatcaatcttattctaaaataaaacttgataaaatcaaatttttaattttaaaaagcacaaaataagaacagtaatagtaataccaattaaacttaatgtgaccaagaaggattttttcctaagaatgaaaggatggtccaacatcagaaaaaaatctatcaatgtaatctaacacaaataaaggagataaatcttagagccatttttgataaatgcagggaaaaaataaaaaataatcacactttaaaaaaatgataaaaccttaaattaggaatagagaggaacttccttaatagtttctgtcagttatcttacacagaaatatactaaatctgtaatcaaaatacctgaaattaattcatattagcatatacatggtatttagcaaccatgaaacaccaatgagatttccaaaattttaataatgttcatgtaaaacaactaattgtatttgctgttaactcattttattttttaaaagcaactgttaaatgaaggaaacttgttcctttcatcttctgcctccaattcttctccttaccccttctctagagcccagacttttgctcttcttatgccactgactgctcctgtcaaggtcactcaatggctaccacattgcaaagtgcaaaagttaatgttcagtattcatattacttgacctgtcaggatcatgatacaattgatcacttcctcctcctaaaaacacttttctttacttggcttccaggacacctcattctccttgttttcctcttacttcactggcccttccttctcagtatctttagctagttccttctcaactccctggctttttttttgtttgagatgggatttcggctccctgcaacctctgcctcctgggttcaagcgattctcctgcctccgcctcctgagtagctgggattacaggcacttgctcaccacgctggctaatttttttttttttttttgtatttttagtagagatggggtttcaccatattggctaggctggtctgaaactcctgacctcaggtgaaccacccgcctcagcctcccgaagtgctgggattacaggcgtgagccactgggcctggcatctccctggctttttaacactggcagagctcaattcctgcactaagtacttctcttctttgcagtctgcactaattcccttggtgatctcatccagtcatgaccttaaataccatttatatgctaaggactcccaaatttacagctgtagcctgaacaatcctgaccaagatgaacttgtatatccaactgactacccaacatttttacttagatgtctaatatgccaaaaaatgtccgaatctgaactttaaatctccccatatatccctcgccctattaaaaaaaaaaaaaacaaaaccctgttctccaggcaatctttccaatttacataaatgacaaatctgtcctcccagctactcaggcttaaaaacattacagttggatttgtctttttctcttgccacaaacaactggtctgctaaatcctctcaattctactttcaacatatatttagaatctgaccacttctcacacttggactggactacttggctagtatcatcatcatttctcccttggattactgcaaaagcccaaaagctttctctgcttctgcgcttgcctcctggtctattttcaacaaaggagcttgtgtgagtctgaagtcagattatgttactccactcaaaaccctccagtggtttcccatcttgctcaagaggaaaagcaaaaattcttacaatggtctacaaagtcctaaagaatcttgtcccattacattgctgacctaatctactgctacacgccaagcccacttattccagttaatccatacttgatgtttcttgaacatatcaagcttgctcccatatcagtttcttagaacttgggccctatgcccaaatacctccttaaagctattgctcaaatgtcatcttctaagttaggcctttcctaaccattttactaaaataacacccctccctatccccacactgcctattcacatcttccccgtcttttttttcttttcttcttcgccataactatcgcttttgacccactttgtatttcattcatgtaattctttttatttttttgagagatgaggacttgcttgtgtccacctcagctggagtgcagtggcatgatctcggctcattgcaacctctgcctcctgggctcaagcaattgatccttgatctcagctctcaagtagctgagactacaggcgccaccatgcccagctaatttttgcattgtttgtagagacagggttttgccatgttgcccaggctgttcttgaacttctgggctcaagcaatgagcccacctcagcctcccaaagtatattacaggcatgacccattgcacctagccttgttcatgtaattctttattctttctcttttcctttctcaagtaggatggtaagcttcacaaaggcagggatttttgtttattttgttcagtgttatatctccagtgcctagaatggtgcatagcaggtgttcaacaaatatttgctgagttgaataaaattcagacagcataaaacataaaatgaaaaaaacatatttaacaaaagatatcacaaagtgaaaaaaataataatagaacaaatatggagaagatatctacagcacatataaaagacaaaggacacgtaaagaaatcttatgaatcagtaagaaaaggacagacaattaaaagaaggtcaaaagacaagaataggcattcaagaagaaaaactataggatcaataagtgtaagaaaagatgctcactggccatgagtggcagctcatgcctgtaatcccagcactttgggaagctgagacaggaggattgcttgagcccaagagcttcagaccagcctgggcaacatagcaagactctgtctctatttaaaaaagttttggattttggagcatttcagattttgtattagggatggtctacctgtactacaagatattaaaaaagaaaggtactgtgaatgaggctaacttaggtctacttctgactctactagttttcttacttaactttaggctctgtggctttagtttcttcatttgtttagaaagaatacacacgcttcctgattttaagacttattacaggccaggcgcagtggctcatgcctgtaatcccagcactttgggaggccaagttgggcagatcaccctgaggtcaggagtttgagaccagcctggccaacatggtgaaaccctgtctctactaaaaataaaaaaaaaattagctgggcatggtggcaggcacctgtaatcccagctactcggggggccttggcaggagaattgtttgaatctgggaggcagaggttgcagtgagctgagatggcaccactgcactccaacctgggcgacagagcgagactccatctcaaaaaataaataaataaataaataaaacttattacaaagctatagtaattaaatgtgtagtactggcataacgacagacatatacaaaaatgagatgaaagtgagagtcaagaataaaccattgaatttatggtcagttgattttcagaaaggacaccaagacaattcaatggaaaaagaacactcttttcaacaaatgttgctcagacaatggatatccacaagcaaaataataaagttgtaccccaatcccttgcactataaacaaaatgaactcaaaatgggtcatagggctgggcatggtgggtcacacatgtaatgccagcactctgggaggctgaggcaggaggattacttgagcttaggagtttgagacaagcccgcacaacaaagtgagaccctgtctccacacacacaaaaaatcaaaaaattagctgggcatagttgtgggcccagctacttgcaaggtaaggcaggaagacagcacgagcccaggaggttgaggctgcagtaagccatgtttgtgcctctgcactccagcctgagcaacagagtgaggccctctctcaacaacaacaacaacaaaaaaagtatcaaagacctaaagaaagagctcagatgggatgatttctggggtatgttttctagcaataaaatttatggttatatgaaaagaaaaaatgcattaatttaactattaattcattctataaacacgttgcttatctacaatgtggcagtcgttatgctatgtgctggcaagatgtgtattataaaattcttgtctttaaggacctcccaatataatggggagacaggaaaagtttaaaatgatgtagtaatagcagagaggtaaatatagtgatttgactcctatggcttcaactactatctacatgtaacaactctccccaaattccagactcatatatccaactgctactgaaatctccactttactagtgagttatatttatcctttcctcctctcttttttttttttgagatggagcctcgctcccatcacaccaggctggagtgcagtggcacgatctcagatcactgcaatctccacctcccgggttcaagtgattctccttcctcagcgtcccgagtagctgggattacaggcatgcgccaccaggcccggctaaaatttttggattttcagtagcaatggggttctgccatgttggtcaggctggtcttgaacttctgacctcaggcaatccacccgcctcagcctcccaaagtgctaggattataggcgtgaggcgccacgcccggccttcttcacccttaagatctgaatatcagtaagattacatacatgactgtgaaataagtccatctgaaacataaagataaaccaggtacgttttagaattttgagattttggaatgttaactgggtaccttatctcagtttacaggggaacaacactctaatcaaatgcagtaacattttagagctaaacatctactaattgggataaagatcataatagctttgtgtcagtttaggtcaggttttgcccattctcaacagcctccaatcagttaaaaaaaatcatttgttttctaacaggcttttggattttagaatccaaagagatgaggaattatcactcaagctctctagtcttccattaagatgtctcaaataaaatgtaatcagggccagctgcggtggctcatgcctgtaatcccagcactttgagagggcaaggcaggtggattgcttgaggctgggcttccagaccagcctagccaacatggcgaaaccctgtctctacttaaaatataaaaaaattagctgggtgtggtggcacatgcctgtaattccagttactcaggaggctaaggcacgagaatcacttgagcctgggaggtggaggttgcagtgagcagagactgtgccactgcactacagactgggtgacagagtgagacactgtctcaaaaaaaagcaatcaccctgtaaagactctcatcttcactcatctgagttactgacaaggcttcctacttccaatttattctctattctgtcagagtgattcttctaaaatgcaaatctgattgcgcctacatttttcaataacattctattgcttaaaaggatgtagctcaaactttttgcaagatatacaaaactacatattatatatatatatatatatatatatatacacacacacacacatatgaatatgagactattgcaggagctgctaacctgtattgtagaaataggcaaatgacatgtttaaccaaaggatttagtcttctctctttaattatacaatttcattttgtatcttgttcaaattatcactattaaagattttgggaattattttttaggcagagcagagcaggatgatgtggaagataaagaaatgtgatatctggatggatggatgctagtctttgaatatcactggctggcttgtaagtataatagagtaagttcatcttgccatctggctaatgtaaaatggaaagcagaggtacttgccaataagaactgcagaactgaatgaattcaataaggtttagatcggcaacacttgatcatcaaacatttccaatttctaaattcaggtccagtgtcagtcaagttgtgagttccagaattacctgatgtgaacttcaaaaaacagatctggggccgggcatggtggctcactcctgtaatcccagcactttgggaggccgaggcaggtggatcacctgaagtcaggagttcgagaccagcctgaccaacgtggtgaaaccctgtctctactaaaaaatacaaaaaaatttagctgggcatggtggtggacgcctgtaatcccagctacttggcagctgaggcaggagaattgcctgaatctgggaggtggaggttgcagtgagccaagatcatgccattgcactccggcctgggcaacaaagcaagactccgtctcaaacaaacaaacaaacaaacaaacaacagatgtgtaggcctcaaccatagagattttcattacgcagatgtggggtgagatccaggaatccgcatttctaaaaagctctccaggatttctgatatacagttagactgcagaagttgatactgaagagtccccaaacttttaggcagtaatttgttgctaaggtaacaagaggtatagaatcatgaaattttagcacctctaagactttctacagaatgacaagttgaaactccctatttttttttttttgagacagggtatccttctgtcacccaggctgaagatctcactgtgcctcaacctcactgcagcctcgacctcccaggctgaatcaatcatcccacatcagccttccaagcagctgggattacaggcgtgcgccaccatacccagctaatttttagtctttttggtagagttggggttttgccatgttgccaaggctggtctcgaattcctgagctcggacaatctgctcgccttggcctcccaatgttctgggattactggcgtgagccagtatgcctgatcagaactccctatttttttcagtcaggaaaattaggagtcctgattagttcagtcacaccaatcgtggctggatcttttgccttctaacattcccactacacatgctacttttctgttccttagttaacttatataggtaatagctctttaagcagacattttaatttacctaaaagcagtaactactttttctactttattacaccctataaaagtggacagagttggaaatcagtggatgcttgctgaaagaaggaaatgtgcattcttctctacaggtgttttcacagctgccggggcatctttataaagcttccccaggtctcagtgataaagaccatggcttttacattacatcatttctcatagagggaatggttgatacatgacatgtgacagcaggattactttatcaggtaaaggaattactaaatgaactattaatacttggagttattgagtcaggttaaagtttccaggtagtgggaatctataaaagagaacggaaaagttgcttcaggaacaaatggagggaagaaatagtcaaccttctgtttagaatgtgagctaatatcacagctgttactctgatggtaattcctgtctactatttataaactaagtgttaagacaaagtacgacatgacaaaatgttctaaacacaatgcaaaataaaataacctaaaggtccaaaatttagttcaataggtgaaattaaaaattttatctttctgaagtaggaaagatgtacaaaaaacacaaaaatgaaataaaaagaagttataaagaatttctaaatgagtaaagaaagtactaaactaaggcaagacactacaaaaaggaaaagaatttcaaagactaaaacataaacagtaaaagtctaggaagactagggggctaacatataaaatgttaaaagcaaaagagacacacacaacacctaaataggtatcagctaagatagcggcaaaaattgaacaaaaactagaaaaactgagaaaaattagattgaaaagatagtttctaaaatgagaagaatctgcccaagtgtccatcaattacaggaatggataaacaaaatgtggtttatacatacaaaggaatattattcaactataaaaagaaatgaagttatgatacatgcatacaacacagatgaactttgaaagccactgaattgcatactttaaaatggatcaagtggaaaactttgttatacatatattttacccgaagaaaggaggaagccaaaacagactaaaagaaaaatcagtatgcgacaaaaccagaaattaaaataaaaaaaatattaaaatcataaatttgtgaaactattgcaagaataccacccccaaatatcattaaggaacctaaggaacataagaagtaaaaggtaggagagggatgtcaaagcagcagcagcacaaatagatcatttaatcctacttactgtaggatgaccatataatttaccattctaaccaggacacttttgagaggaaaggggacactattaataattacacagggacaacaggtgtaggctggagctgtgccaggcaaaagtggttatgtggttactctctatataagggcaatcaggtccttaaggttgagttcacgcccacagcttggggtctggcagaagtacaatactctgacagtgtcttcctgaatgactcaagtggtcaaaaacgcaagattatttttcatttttttacagagaaataaaatacaattcatggcctttactgaagtttactgatttgtgattcataaaacaattagcgtatcattagattttattaagagctataatttagtgttctaggaaatttagaaggccgaattatactttgaaatgcactggcaggcatactaaggaagtcctgaggtgaatcattttttataaacctacatttttatatattacattagagccctataaatatatgtatacactttttttttttttttttttttcagacagagtctccctgtcacccaggctggagtgctgtggtgcgatctcagctcaccgcaacctctgcctcctgggttcaagagattctctgcctcagcctcccaagtagctgggattacaggtgggtgccatgacgcctagctaacttttgtatttttagtagagacagggttttaccatgttggccaggctggtctcgaactcctgacctcaggtgatctgcctgcctcgatgtatatactcttttatacttacttttgactagagacaattgagacttgaaaattagaaaaatcaagttagaattactgagaaaattagtagctctgatattctacccattctttatttttaaattaaaattaatcttaatgacctacaaataggttaacttaaacagtccataccttacatgagaagctccgacttgggatgtttcttgctaactctgatatcttgggtttattctgaagacacttggttaggtgatattttttcaattttattctattgtaacaatgatcagcgaagttatagtgattcaaatgctgtttctgcatgcattttccaaggtgaggaatactatacttcaaagcttggagaaataatttggtcttctgctgcatgatatcaaagtccctggtttatgctccttttggggctgccagcacacgaatgattttataggtatgattacagagtagtgggttctcagagtaactaagatcagcagttctcatccctccttttcagggccatgccccacttaggttatgaataacttcagacagctgataacttaggctaactaaatctaaaaacctgtgtaagttaaagtttcattcaaatcataattcttggcagatgtgacttaaatgtctcatttgtaaagttaatcctatcaggctcaaactatgcagcactgactctggcacacataggggttaaactaaaacaaaaaacaaaacaagaaacaaaatataaatttgcaaataagtacacagacttaatggggtatctcaggaactcagggctgtaaaaggtaaaaagccctttggtcttacataattatgaacgtatctttggtatatatgtggaagataaactggaaaagcctaattatttaataaaggtgggggagggaagattaattattgttgagtgttaactaactgccaggtgcttttatcttgtttgtctaatttaaattttatatggacttaataaagtagatattaccatgcacattttacaggttgccaaactgtggctgtgggaggttctaagcaactgttccaggtcacttgtacagtaagctgtatagcaaaaaatccaatttggttcggttccaaatactggacatactcaacttcggatttttaatgttaaaaaggtatttagcgctttaattaaaaacaacaaaaaacccctgcaagatgcacaaataaaatgtaaggccatctctggtttgtcaggaggtagcttttattaaccttgattgctaataagtagttaagagtcagagagacctgggttgaggtcttagctcctacacttaactgtgtctccgggcctcagtttcttcatctgcaaaaatgaaatgacaccatttaccttctagggttgttgttgtaaagacaaaatgagacagcttaacattaagaccatacagtgcctggcacatagtgaccactcaataaatggcagttgctattatttacgacaggaataatctaggtatgttgcacaccgctgaatgtcattatggaagtcttccacaaaatgccccctggtatcaaaggtagaatgctgcgtcaaatttaccatagatcagatgcgctacgacgcccccgccccccttaatccctttccatgtcgcagcaaaataatgggcgattgggggtaggggagcaacactagtttactagccgacactagtaaaaaaaggggaaaaaagacccgaataacaaggacctgcaaaggtcctacatcaccacgttcccacagcctttatccatccatctttcatccccaagaagacagtatgcaaggctaggatgggggtggggtagataaatgggtgttctcaggagaacctattcgtttaccccgtgcaactctccaccccagggatgaggcgatctgaatgcaacagggagagggaccaggtgacacgcacgcagtgccgggacattagtcaaaaagcgaggacctggggactgaggggtgggtggctgggcggggggagaaaggggagaaggaaagagaccagcacaccccccatacatacgcaaattgagagaatcagtccggctctggacacaaaccagtgaaggcaggccggagaacctgaagctctcagaggggagcaggtgtcaccgcaggcaagtccagccgaagtctgcgttccgcagcccacagaacgacaacttacccagagccgcctagagctggtttgcagcacgccaatct

SEQ ID NO: 2476 - DNA, 43954 bp, Homo sapiens; identical to SEQ ID NO: 2475

SEQ ID NO: 2477 - DNA, 43067 bp, Homo sapiens
tttcaagtggtcataattttaatggtaaaattaggacataaaaataattttcaaagaattattttcaaagaacactagacataaaatataacaattttcaaattttcaaagaatactagaagaaaaaaattatacagtcaatccaacaaaaagcttaatagaaaaaaaccctaaacaatagtataactacaaataaaatagggcttccgaattatgtctaaataatacaataattacaaatatgaatgggttaaattagcctattaaaagataaaaccactcagataacaaaaacagacataagaaacactaacataaaacacaaagaattaaaatgaagatatagcaagcaaataatagaaagcttgcaacccagctatagctataaacacaaaaaatgaagttatcttttgacctaataattccattcctaatacttagaaatatttgcacatgtgcacaataatacttaaaggatctcaacactgtttttttttttttttgagacagtcttgctccgtcacccatgctcgagtgcagtggcgtgatctcggcacactgcagcctctgcttcctgggttcaagtgattctcctgctgcagcctcccaagtagctgggattacaggtgcacgtcattatgcccgggtaatttctgtattttttagtagagatggtgtttcaccatgttggccaggctggtcttgaactcctgacctctggtgatctgtctgccttgcctcccaaagtgctaggattacgggcctgagccaccttgcctggcctgcaaaatttgtttttaatagaagacacaagaaatgatttaaatattttatcaacagaaaaccagttctatcaactatgggcccagtatgcagcttttaaaaatgacagttctatatacattgatatgagaccatttcaaacaggtattcaataaagtatagaatggtaacatatcaccaactgtgtaaagaaaaatatataaacatatgaaatgatacattctgtgcctatgcaaacatatgatacattaaaaacaaaagaacatatagtgcctgtctctgaggggaactgtgaagctatggaaaggtgttgaagaaaacctttttatagtatgtattcttgtaattgaataaaaaataaaattacaaaaatcaggcttggaagtatttaatagcagacaaaatatagttcaatatgaaaagcattatatgagacaaaggcaattttcaaaaattgataaaacattccaccaaaaatcatgactacgcatctaacagcttcaaaatatagaaaatactcaaatgcaaaatcaacaaatctgcaattacagaaaaagacttcaacatacttttagaaagtagtaactcaagtagacaataatagctaacacttaccgggcacttcttatgtgagtggcactgaaacatgtgctttcatgcattacctaaggctagagaaaatgttaataacttagacaagtcatacatgtatcataaatatctttgtacctgacaaacagaataaacatctttttaaacaccattagataattatttaaagaccacatattgggaacctacccctaaagaacaataacaaccacaataacaactatcaccccagtaaacatggctggcaagaatacaattaaatgaacattatcactgatttggcaacagctcttatgaagaataatttggcattatgtatcaagtgcccatactctttgacaaagtaactgtctttctgataatctatcttaagtaatacaaaaatggggggaggggaataaaaatacaaaatattagaaacactatcgtcaaaatgaaagggcatggctgagtatggtacaaccgttcaacagaatattgtcattaaaaacatttatggaggctatattatatagtcaataacagaaaatgcttgaaaggttagaagtacatcatcaaattatgttttatatagctgtaaaataaacccaaatcatctttaatgaacacatactattatggtaaaaaaaagtctacaatttctaactttcaccttaggcagctttttattttgcatcctttttttcaactttgtcttctattagctgtgcaagaaatacatgtctgctaaagttacacgatcttcgcacaacagcaacctacacattagtctacaaaggggaacaaacccaaattcctcagaagtctgagtccactgttgccttctttctggccatctggcagttacaatatagcacagaatgactatgcaagttaaatattcatcttagacatggacatttgctttgggactcctaaagtggagtcaaatttgatctctacagaaactctacaatgtagcagagcactgtgcgtacttattgactcccagacaagccgaaaccccgaatttgtcatttctatcagtttttatataaattgttcttacctacttattgatgcttacaatttggcaattataaggggcaaaattggagcaagtgttttgggtaaataactccttacaatatattaaaaatacttacaaacaattcttagaatcaaacacttacgtaaatacttttttaaaaaaataggtccaaaagactcagcccagatcggctttgaagttatatcaagatttaagtctacttcatgccaatgagctactcctcaacaggggctggttttgccatttgaggaatgacagccactatgttgtgtacacaagagagctggatggcatcgacagaatctttatcgtggttctgaattttggagaatcaacactgttaaatctacataatatgatttcgggccttcccgctaaaatgagaataaggttaagtaccaattctgccgacaaaggcagtaaagttgatacaagtggcatttttctggacaagggagagggactcatctttgaacacaacacgaagaatctccttcatcgccaaacagctttcagagatagatgctttgtttccaatcgagcatgctattccagtgtactgaacatactgtatacctcgtgttaggcacctttatgaagagatgaagacactggcatttcagtgggattgtaagcatttgtaatagcttcatgtacagcatgctgcttggtgaacaatcattaattcttcgatatttctgtagcttgaatgtaactgctttaagaaaggttctcaaatgttttgaaaaaaataaaatgtttaaaagtaaattatggcttataggagcttataactttattcagatagcatcaatcagggatgaccagaacacattaggaccccagattattcaaaaactttaacgaattttaaggggaagaattttatcttttcccttaaaatgcagtcatagaaattagaggatgactcactgccacagtgtctaaaagcatttgctagcaaagaggcaggacactaatttgtaaactgctcaactgttctgactggaagggaggcctggagctctgctatcaccaatccttcccttccctctactccacatccttctaaggagcatgatttgaaaattactttcctaggttaatgggcatgtgcatcaatggagagaatagtataagcaagtgagatgtagactaagcaaaatttagatggagaagcacattttaaaaaattaataacttaaaagtctcaagttattaattttttttttgctaactcaattggaagtaagactatgaaatatttcagtgtgtttccaattcccagttgaatgcagtgtttcagaatttcaggtatttcttaagatcctcgaaaacactggtgctgtcaagtccaagttcctcgtacaggaatttaatttgggctgtaatctaaaagaaacacattaaaaaaattaaatagaaggcctttgtagtaaaatgccactgtttaagcttctctttatctatccatctttacctaaccgtgaagtcagcaatttatggcaagaatactttcattcgagagagaggcagaaggcttccaacaattaagattaaattattttctttaacagagctcacgtatcaagtacaagagagagacatttctcttgattgacacagtgtccctccctcccctcctgggtctcacccatagataggacatttgtgaagtggctttgtcataaacctgctgcaaccactgaaaatgtgaaaacaacatgtatctagttcgggaatctgtccactgagagggccttgataacatacctttttgtgagaatcctcaattacatgattgcctccaggctgaatatctagaataatattaggggtctgatagcctggaagagttaacatgtagaacaattagaagattgtatgggatcttctttggaagatcgagacccattcctcccctcttctttgagtactcagttcaaataatagtaaaggaataaaaagcaaaaaccaccatcatcaacaaaaagatgggaggggacaagcaacagaagacaaacttctgacacagcgaaagcaggaagaggccgtatggaaaagactatatggtgccacacggacaaggttgaaacccaggagatcatcaacctgccctgtggaatctgagagtcttatgccctggaaacaccaactacagcaatggatgggggtgacaaatggagatgaatacagggagactgatatggcatgtagtttcaaggcaaaagggagggattcttatctcataaagctgaaacagctagctagaggaaattcatgcagctaaacagtttgggcactgatggcccaaaacaaaaatctcagaatctgtcttttagagattcccaagaataacggctcaataaatattgttaaatgaattaataattgtatggcagtgcatctccaagttatatctgattcttaaatttcctgtttcctttgtgtcctgcctatctattttaatactgtcctttgaaaaagaggtgaggcagtgtatgtatagacatgtagttacgtacactttaactggggagtcaacatagcaaaataattgtttgccctaaatcctgggcagatgatttggctacagcctgaaatatattcctctgagcagtgtgctgtgggtagtagtctgtttggccatgttccctgcttctagggggtctcctaccttcacctgtgtccttagcatgctccgcgatggcttccttgagtttctcagtataacttacaattcctttcagaggtacccgttcatcgttttcatatgccgttatgtgaattgaaggataatgctgaaagaaaatacatgcacgaagagtttacattatttcttatggtcccttgccactatagagactatgaaaaataattacctccaatttttccctgtaagtgctctatgctttttctcacttgctatcttgagagcgcctcagtattacagtagtagactacttgttatctggaatagccttttcttgactaaaggaccttagctaatttagtaattaaggcatgataagtctattcccctgaggtattaaacatggagcatgagcagagatggtgctgaagatatttgggcatcataagtagaaacatctctaaagctcctatttttgcttcagcttggataagttttttttttattatcttctgtgtaaattcaggataatctaacacaattgtctttcactacctgaggtttaatattttgatagggacagtaacgttttatgtagttcttgtgtttttcatcagatgaaggattcccccattcttctaattcttctaatgtcagaggaagtgtagtgtccatcatggtgttgagaacatccaagaaaggtgcctaaaaaaaaggcaaagaaacttatacttcaagtaagaggttggtaagtgagtttcagaaaaacattctattttatgaatatacatactaatatgagagaaaataactcaagccatgtagattcctaggagctagaatactcagtccttaaccagggcctgtaatttataacctacttttaaagtcttcagattccttaaatgacatataacaagaaatggtttatcttctaatttcacaatatttatttttagcttagtaccttttattcatttatattttttcttatataaaagcaataaatgctactgtctcataccaattaggacagttagttattatattaaaacaacaacaacaacaacaagtattggcagtaatgtggagaaaccggaatcctgatacactggtggttggaatgtaaaatgggggagctgctttggaaaacagtatggtggttcatcaaagagttaagcttaagattaccatatgatccagcaattccactcctggcatataatccccaaaactgaaagcagggtcttaaagagatctgcatacctatgttcacagcagcatattcacaacagccaaaaggtggaagcaactcaagtgtccattaaccaaagaacgaataagcaaaatgtggtatacacatgcaatattacatggaatattattcagccttaaaaatgaataaaattctgatccacgctacaatatggatgaacctcaaggatataatctaagtgaaataagccagtcacaaaaaattttgtatgactccacctatgtgaggtgtttgagtagtcaaattcacagagacagaggctgtgggaagaagcaaatggagagctgtttaatcggtacagggtttcagttttgttaagatgaaaaacgagttctggagattgactgcataagcctatgagtgcacttaccactactgaactattcacttaaaaatggttgagatggtaaattttatggtattttaccataattaaaaatttttaaatgaaaaaaatacacaaggaataaagtctttttgaccagttggacattttatattaaaagcaaaaaacgctaagtaaagaaactctgcaaaatacccaaggtgaaagaagagaaaacaacccattggcttataattagtgttacaaaatttaataaaacgaaggctgggtcgcacatggtggctcatgcctgtaatcccagcacattgggaggctgaggtgggcaaatcacttgagcccaggagtttgaaactagcctgggtagcatggtaaaaccacatctctacaaaacaacaacaaaccacaaaaattagcagggcatggtggcacatgcctgtagtcccagatactcaggaggctgaggtgggaggatcacctgagccccagaggtcgaggctgtagtgagctgtgttcgtgtgccattgcattccagcctgggtgaaagagcaaaactctgactcaaaaaacaaaacaaaacaaaacaaaaaaacaaaaaccccacaaaaacaacaaaacaaaaatgaaggctgtatttttcacttagctttattttcttctgttaacatactttttagctttccctcatattaacattaaccaagtatagtgagtcatctgtaattctttttggctgcctaccatatgaacttttttgcatttgaaaaacctccaaccttatcagctagagcctgcctctcactgtggagatactaagtgctagacttctctttcccatttttccctgcagcttgggagtagctgtgtgacccatgtgtgacttgggtctatcaaccagacacatgtgctttacactctgcatggaaagttagtgattcaaagaagcagtgatcacagataatttattctggcaaaagtgccacagctatatccagctctagaagttgcactggcagtgtgaggtgatttgtgcttggcagtggcggcagtaatagtttcattgggccaattctatgcctttggctctgaagcctctaacactggtctgaagacacctacattttcctaatgccctttaatcccttttctgcttaaattagggttgatttttggtgcttataagaagaatttgacttatacatgtataaaaggttgtctcctagtcttcactataataagcaacctagcataaatatccttctcatcatttccttttaaatttctaaaagtcaaaatctagttgctttgtctttaaactgtaaataattctgccattatctttgtgcataggctattctccacatttttctgtttttaaaaaatagacttacaggtgactactatttaacacttatttacaagcccacagtataaactccccaacctcaaaataaaaaatcctgaaaataatttactctctcccatctcagtcattatttttcagagtaacctagaagtaggagaatgatagcagtgaaaccaactgctacaatgtaacttcgtaatttctgacactgggaaaagataatcattttcagaacagggtaagatatttcaattaaaatacggaaaaactatgcccaaacgaccattaagaatggactatctaaaaataaagagcctataaatctaggactgaaatgttgatgggcagtagcctgtcaaggtgaccaggagccaaaggactcagtgcattccagagtcacagcgtgctttgcctggctttctcaactgggactcatatatgcttcagtgctttttcaccaattctaaatgtccttacaaatacaaatgagcaatggaaatagccattaatatctttcagtggaaagccttaaagataataaagaacactgtatcagagaagaataacggttaatagttggattaaaataactttagaagttctcctcaagctataattctgagtttaaaacttaaaagctttgttatactcctatgctatggtaaaactgtaacagaaatgtttttctttccttttttttttttttttttgacaatgtctcactctgttgcccaggctggagcacagtggtccactgcagcctcaacctcttaagagatcctcttaccaacaagcctgggtaggtttttttttttttttaatttcttgcagagacagggtctcgccatgttgcccaggctggtctcgagctcctggtaagcaatctgcccacctcagtttcccgaagtgctgggattacaggcatgagccgctgtgccagcccaaaaacatttttcttagagtagcctatggcttcacacctcccccattctataaacagtagagacagagcgtactcacctccaaagtcaccgctctcaccagctctggattagaattacacaatgctcctgcaagcacccctccagcactgaaagcagtcagggttgttagacttggctgagaaaagccttggccatgaagcgtcttaatgcaagcctctaaatcagcaaggccattgagttttttagttaggcggccatcagcgtgccactggaggcctaactcaccaccacctctgaaattgaagggcaaaaaagttttagtggaaaaaaaaagttaatactgtaggctggggtcagcgaactacacctggaggcctgttttttgtgtggccctggagctaagactggtttttgctttttaaaggttgagtgaaaacaaggaatgtgcaacagaaactgtacgcggcctgcaaagcttaaaatgtgactatgtagctctttagagaaaaaggtttgccaactcctgatatagacaatccagaattgattcaacgaatatattttgagtgcctgcccatttatcagggattaagtacagaccttaaaagtagaaacaaacgaaaatcccctaccgtggagaagacagtaattttgtggggtaagaaaacaacgacttacccagcaatgtggtgtcattgctacaatacaagtgtatttaaggtattacaggagcagaggaaagaacatccatctgccaggtgaggggtatatacacgagtcaggaacacaaatgcttttaaggagatgatgcctaaactgagttgtgaaggaaaaatttgagtttccagagggcaaagaaaaggcattaagacacagatacgacacagcatgtataagggcaaggaggtgacagagcatgtcatttaaaagacatgactttgggggctggacacagtgcctcaagcctgtcatctcagcattttggtaggctgaggtgagcaggtcacttgaggtcaggagtttgagaccagactggccaacatggtgaaacccccgtctctcctaaaaatagaaaaaattagccaggtgtggtggtgcgtgcctataagcccaactactcgggaggctgaggcaagagaattacttgaacctgggaggcggaggttgcagtgagcggagattgcgccactgcactctagcctgggagacagagtgagactccatctcaaaaaaatacaaaacaaaataaaaaaaataaaaggacatgattttggaaggctgaggcgggcggactgcttgagctcaggagttcgagaccagcctgggcaacattggaaaaccctgtctctactaaaatacaaaaaaatcgggctggtacggtggctcatgcctgtaatcccagcactttgggaggctgaggcgggcggatcacttgaggtcaggagttcgagaccagcctggccaacatggtgaaaccccatcgctacaaaaatttcaaaaattagtcaggagttatggcaggcacctgtaatcccagctactcaggaggctgaggcaggagaatcgcttgaaccctggccaagatcatgccactgcacactccagcctgggcgacagagcaagattctatctcaaaaaaaaaaaaaaaaaaattcagacagtgtggtggtgtgcgcctgtagtcccagctactcaggagcctgaagcatgagaatcacttgaacctgggaggcagaggttgcagtgagccgagattgtgccactgcactccagcctgggcgacaaagcaaaactgtctcaaacaaaaaaaaaaaaaaaaaaaaaaaaagggtctgatgctaaatgccgctacagagatccatcagaccattaggagtattatactggggaatctggactgtgttctagagatggggaggtggagaagaattttaagcagaaatacaaaataatatttgtgtcttgaaaacagctgaaataaaatggaagttaaatggaaaacagttcagattcagaggctacttaaacctgaattcaggagaactgaaaggaaataataatattactaaataagtacagagtctggtacctctatgcaaaaatcctaaaaacctatccttttgctttttggatcaactaatctgttaaagaatcaagtttcaccagtgctggtttaggaatacaaaaattgaataataagaatgaaaaaaataagcttttgttccctgatatatattgttattcttgacatctctcacaatggtctagcacttacatgccaggtaaaatatactgactcaccgaacatggcagtatgctaatatccatccatcatccaccaggacccgcctctcaggcctgaaattcattttcaaatccattccataagctccatatacatgtaccaagagaggtttcttctgcaagtcctcagagtcagttttgtggaaaacagtcattggcactaattttccatcctagaaatgaagaattactatgtatgtaaagaagagtcttttataataactgttttatcccaatttaaaatacattgaggtgcactgtccccacttgtgtgctacctactgatgttgagcacaaatttgtttaagaaaaagaattatggtctctaaaaataaatcatggcttttggtttcagctaccttgctgtcctacagtattaaccagaaaagagcagcaagactggcctgaaaacattttattaaatgcagcttttcatgacaataatgtaattttaaagagttcttcactacctactataattttaaattttcagatgaaaccaaaatacttaccaaggttagaagtcctagtatagcactcttcctatgcctaagagctagatattggcatttttcacttttgagtatctacaaatatgctgactaaagtcttaccagctcaattttctatatcctctgtagtcggaattctcaaccattaagacctgaaatcttactgatgttactgataactaccacaatcctcttcaaaggcccatttaactttattaaaaaaaatttaaagtggtcttaaaatttttcggtaaaattctttgtagggttaaagtaagttaaattatttgtaaggttactaagttacttgtaggttatgtaaccatcccccaatgtagctcaaactcatcagttccagttgattgaaactaggcagtctctgaacagacaaaagaactaattctgatctacctttcacacaaaaaagataaagaaattggttttcaccctgcttaaactaatgaaatagcaccgtttacataaagaaaataaataatacatccaagtcactcttcatattttcattctcattttgaaaacttcactttggggcaataactggagacagcaaaatgtaatcaaataaggaggaaattctcctctcattcttctttaaaatacccaagttgttatgacattgttaactttcacttttagtaagattcacttttataaaacttgatgtagattaatttctataaaacactcttggtcttttcacttcccaactcttccccaacttcaattatacaatcagaaaaagttgcttgttgaaaagttttgaaaggaagaggtaaaacagtagctactcctgtgatgggctggatctgggtttgccagcagtactaaaatgcctgtggaaaggtatagcgcttccattcagcagctgcttcccttctcccctcttggctctccaagaacatggtgcttaactgttctttccatctcgggtccaataattgcaacattttgatagactagtctaattccatgtttgtaaaaccaaataaaacctatctaaaagataatacactaagtgggtaacaatgattatttctaagaggtgcagcaagcaaatggtactgagaagtagtcatttaagatttgttctgtatttttgcatctgttcaacaagcatgtattgcttttgtaatataaaaatattaatatttacttaaagattgtcagagaaaaataaatgaattaaagaaaaaaattcctaagaataaaaggcttgtgttgtaattcattgtgtcagcacatgtgaaattatctgatatatgatatgctaaagtctgaggtttccttaaattcaaggctatagtttacatattaatttgttccctacttgcataaatttgtatattctgtatattgagtatacctggaatatggatatttgttatttccttttctgtgtctcatctctctctactcctcaccctgccaatcttccctcttttacttgattttggccataatggcctcctttatatttgttctttttctgagacaggatcttactctgtcacacaggctggaatgcaatggcgcaatcacaactcactgcagcctcaacctcctgggctcaagcaatcctcccacatcaggttcccaagaagcagggactacaagcatatgccaccatgcctggctaatatttttggtttttgtagagatgaggtctcactatattgcccaggttggtttctaacttctgggctcaagtgatcctcccagcttggcctcccaaagtgttgggattacaagtttgagccactgtgcctagccctacacttcttctgtaggctggagagcagtggtgaggtcttggctcactgcaacctctgcctcctgggttcaaaggattctcctgcctcagcctcctgagtagctgacattacaggcacctgccaccacacccggctaattttttgtatttttagtagagatggggtttcaccatattggccaggctggtctcgacctcgtgatctgcccgcctcagcctcccaaagtgctgggattataggtgtgagccactgtgcccggccagccctacacttcttgaattgtataatttctccccaaattcagggcctctatacaaaatggaatcccctatctcctttctagtttactcttaatcatcctagtggtcttacctgagacataacttccttggagaaaacttccctgatctctctagactaggtaaaatccctttgctctatgctcccactgtactcagtatgtcctcctttgcagcagtcagtacattattaatgactttttaaacatgtcatctttcctgctagatgtatgctccatgagggcagggactgtatcagtctagtttactctagtcaactaccaccttcactatttttgccataactacataccaactctattaattttttcttaaaatcaactttaaaaaatcagacataaacaacatgtaaaataaaaagtttgacatgctataaattttcttttttttttttttttttgagacggagtcttgctctgtagcccaggctggagtgcagtggcacgatctaggctcactgcatgctccgcctcctgggttcacgccattctcctgcctcagcctcccaagtagctgggactacaggcgcccgccaccatgcccagctaattttgtgtatttttagtagagatggggtttcaccgtgttagccaggatggtctcgatctcctgacctcgtgatccacccgcctcggcctcccaaagtgctgggattacaggcgtgagccaccgtgcccggccgacatgctataaattttctaatccatgttaaaacaaacatgaatattaaggttaaaaaaaattcacctatccctaaagtcacttgggtattactgtggtctaagaaatctacattaggaaaccgtgctaatgtaactccaacaactgcatggcatctggcaaacggtatgctttcagtaaatgggagctgaaagtgaagattataagacctaccttgcttttggcttctagacgtaaaacgcgactagtctttgtgattgggtcttcatgcccagtttcctcaaacagtttgccttctgcaaacttgtatgtgtaatattttgggggacgtattggagagcaaagttgaaaggggcagttctttgggtcagaatttgtatccattatgaatccacaggcccaaggagggagctaaagaaatacaacagctatttttattctttatttaggccaccaagtatcattaattaaatttctaagtcttctccaaacaagatgatgtggatatctcgtttactttttgttaccacgtcatgcctcattcaaggattactttatcacaacaacatacatttcaaataaaaaacaaaactgtacattaatgaccaataaaataagacaaactataggaaaatgatttatcatgattctagctttacatgaaattgcctttaacataaaagtttattttggggtataatcttggataataaaatagtaaaatggaagaataagagcaaatcaaatagtaattccagaacccaccgacactgccaagatctctgttctcaaagaacgtgaaattcctcacatgcgtgtgtttttcataatttacccactagtccttaccctgctgcctggacagccacagtgatgacagttattatttcagggctataaacgggctcagcagcattaaggcatttgcaatttgtttctaacttttagctcctaggctaaccattgtgcagaacaaaacctcttctggcacatctactctgagagactcacagctattatactcaaggttcttaactttaagaaaaaaggaaaggaatcaaaatttattctctcagagcagcagggtccagcttcaagccttgcactaacatccctcttacaccttttaaagaactctggtaagcaggttgacagagcgttagaaatggtaccgagaggcagaacattaaaagaaaattgcctttcttttcctgagtaattgtagaaagagcaaattccttagaaaatcagaggcacagaaacatcactggtgggcactattgaaaaagggcagccggggatttgtgcgtaaaggggataccattccacctgcagcaactacagccagagtttacgttctctgagcaaatctcttattaataaaaaaaaaaaatctattttcatgaaacactagtaaggacacacatctgcaatctctaaaagctcctaatgtatgcttctcacattgagggttgttttaaaggataacttgtctatttaaatttaagccataactggagagtaaaatgtaaacaaaaattgagaaatctggtagcatagttataagcaagcaaactgagacttgagaggggaaaaaaaggaagcactgctacaaacctcataaccaggcctcagagcgagggtacaaggttccttagcccatggaagctcaagtttttctgccctttgatgagacttcaggacagtctctatgtgacccacgcagtaagctgtcttagctttagaccaagtggttccaataaatcaaaaagtatttttggtgtttttctaaaactaatgggaccaacattaatgttttaatcataataaaaactgtttcaaggctatggacttttagaagttcatccagctaatgcagatataagtattaactaactcaaggatatcttaagccacatttcctattcagataagcctgcagtgtatctgtgtatattaatggacagcaccagagagtaagtaggccaggagatagggagacattccttagatacctgagagaaacaggttcagttttagcactctaccagcaaactatagttatttcatcaaaagaataagacatacatgccgaaagaaaattggcctgaatatgcagactcctcctctaaataaaactgatgttagcatacagcaaaaaacgtcccaactggcctaaattaaatatcataacttctttttgtgacaaaaaaaaatacttccagaaaatactgatggcatggtgaccaaggatacgaggcaaatatgtgaagggttttacatttctgttgctaagatagaatttatttatttatttagagacggagtcttgctcttgcacccaggctggaatgcagtggcgtgatctcggctcactgcagcctccagctctcggcttcaagtgactctcctgcctcagcctccagaatagctcggactataggcacctgccaccacgcctggctagtttttgtatttttagtattctttgtattttatattttttgtatttttagtagagacagggttttgccatgttggccagggtggtcttgaactcctgacctcaggtgatccgcctgccttggtctcccaaagtgctgggattacaggctgagattgaatttaaaaagatcttttaatcaagtgcccaccaggcagagatactgcataaagaaatattttataatgcactcacgctatggttaaagattttgtctttcgtgtatggatggcactgtctatgtatattaattaatattattcaggctcataaaaagggtctgatctataaaattctctttattatataccaggtactaaccagaaagatcaagaagtatttaattccacttgatgatgactagaacattataaaagtcgtaataggtactatcatttgggaagggtcagaaaatgaagagatagaagatacagaataaattaaagacataatgtttgttccagtggaatttaaaaccatggaaactggggcatatctttaaaataagaatacttacaaaaaatataaaaggtcatatttacttagaagtcaaatcatatagcagagtaaactccacatgacatttctaactttcctgacatagaattttgttctaacaagtgcattgctagaaattacatattctctcccattcttattcatacagactgaaataataatagatgctccaccagtttcccaactgaagatgtctaaatttggcaccagttaacatgtaaatggttagccataggcagaagattgaaaactggaccccttccttacaccatatatacaaatcaactcaagatgaattaaagacttaaatgtaaaacctaagactataaaaacccttgaagaaaacctaggaaatataattctacagaaaggcaaagattttatgacaaagatgccaaaagcaattgcaacaaaaacaaaaatcagcaactggaaactaaagagttcctgcacagcaaaataaactatcaacagagtaaatagacaacctacagaatgggagaaaatatttacaaactatgcatctgacaaagatctagtatccagaatttataaggaacttatattaacaagcaaaacaaacaaaaacagaaaaaaaccccaacaccataaaaaagtgggcaaaggacatgaacagatatttttaaaagaagacatacatgcagccaacaagcatatgaaaaaaatgctcaacatcactaaccattagaggaatgcaaatctaaaccacaacgagataccatctcacatcagttagaatgactgtagttaaaaagtcaaaatataacagatgctggtgaggctgtagaaaaaagggaaagcttatacactgctagtggaaatgtaagttcagccactgtggaaagcagtttgggaatttctcaaagaatgtaaaacagaactactatttgactcagcaatcccattattggatatataaccaaaggaatacaaatcgctctaccataaagacacatgcacacattatgttcatcacaatagcaaagacatggaatcaacctaaatgtccatcaatgatagactggatacagaaaatgtggtacatatataccatagaatactacacagccataaaaaagagataatgttctttgcagcaacatggatgaagctggaggccattatcctaagcaagccaacagaggaacagaaaatcaaacaccccatgttctcacttataagtgggagctaaacattgtgtccacatggacacaaggaagagaataacagacactggggcctacctgagggttgaaggagggtgaggattgaaaaactacctattgggtactatacttattacctgggtgacaaaataatacgtatatcaaacccctgtggcagacaatttatctattaaaccaacctgcacatgtacccctgaaagtaaaagttaaaaaaaaagaaatgctatctaaaataataatattaaaatttttaaaattagcaagtgaaaagaaatactttgcactccagcagatgaagacaataaggacatccctccaagtcagtcaccattttggttttaggacacttacatagtgttctaagagactggacattacatttgatcttttgattttagggagtagctggagatttcagttatttcaggcccttgttatttcttatttataccaataaaacaatctcaaaactagcttcctgccccttacttctttttggtttagtgtatcctaatatggctgccactcctcaaaccattcccctgctcaaaaacttcaaatgttacctttcataattaataaattcctcatattgacactcacaaaaagtcaaatcatgacttcatcccccagaaatgtatagcgctttaataaaacagaataattaacagtttcctgaacattttctgaatgtcagagcatacagcttcatttgatggctttctcatcttggaataccatcccctctccacctgtcaaaatcctatctctcttctctggtttatttcacattcaaccaactttaccaaaagctttcctgggccttcttctctagtttgagccccacagcacattttatgtttttgatactacttattcaaatccatgatacacttaacctttatgtactagtttaatcttgtgattaactatatcttccttaaggctaggatattctgctttaacagctttcgattctataatgcccgatacagtattgtgcacatgaaagttcaataaaaagccactgaattgactgaaattgcatttttacaggagttttaagaatattggagttagggaggtataaatggtctatgctgtttgctcatcaactggctcagtaactcttttcatatcaaacaaaatggaagccatcctcttcccttcagtgcctactacctcaactcacatgttaatgctgctttaaaactaggcaataaggttgtcattcaccaattttaggaagttcacttgtgaaggcaggttatctttcctggtagccacaagcagtatcaactagtcagcttgccaagcagtcttgccactattagccttctgtgctgctgtggagaccactgctactcctacactgaaagaaaccaaagtttgttccctgcatcccctgcggataagaaaactggcagacagaagatgatgcagacaaaagcatgtagtggctaaaaacacagtggataccactactgtccctgttggggatgtgggatgggggaacagcagtcagtgtttaggcactagctaccaactttggcctgagtttttactatatctcaagttgcagagatatgtgaggtagagagatatacagaaagagaaatattagcactcaactctacttgtgaagtccatgccataagacactatcttaagtaaaactgcataaaaagcaagatcctctaagtaattctaagataaccctcctaaacccaagagtgactttgctaaattccatttaagttacattcctttcaagaaaaagaacactgctgccactattcaaaatgtgatgttctgttaagctaaactgcataaatattttgattaacagtattaacttctgaaaattaaacatacctttagagaccgaactgaatcatcagccagaccaatcacattaacataaaggagattgctgtgcttcagaaatagaacacagtgatccttaaacatgtccaagtctatcacttttgtatttctcttcattgtaaaaaataaatcccaattcataattgcaggggtatcagccgctgttctcattagctacgtggaacaaagttagaagacatataggtaagaaaacacgaaggctgcagcatccagagatgcaatcactgagaactagaccatactagtcctcactgttttatgaagagctgaaggaactaacgctgcatcagggataaagtgtgaccatcaaccatatgaatgagtcctgactagcctgctgggtggtgagacagtatatccagtgcttagccaaccactggacatttgagtgagggcactgacagctagctgactacagatacatcagtgagcttagctgatatcagcagaagaactgcctagctgagatcaatccaaattgccaactcataaaatcacgagtttgtaagtttgctcttttaagctactaagtttgattttgttaacataaactcaggacagaatatgttttatttactaactttttaggcacaattaaaatatgtagaggcattagctctaagggaaaagaaatgggattggttatacataggaaggtggcatcaatttataaaacaatgagctcttggagcaagaaatgttgttgatcgaagtgtgacacttcttaacagcccaaataggaacaacgagcatccaggattaccttaaattctgtaggttctccaacattagtgagaatgtataattcatcatctctgtgttcaacatagtaaaggaccccatgtattcgcttctggataagtactggtgggtcccaagggctcaggccatctatcaaccacacttcagaagtagtcttgttcataatatttatggtgaggaaacgactgtcttttgtaagataaaggaaaacaaagtagctagagagagagagagagacatgagatcacagtttatttcagatgcatgctaccttgttaaggacagtatctcagaggtggtcagtatacatgttgatttataatgcagataggaaattaaaataattccttagtgaatatcacttgtaactttaacaattagctattatttttctcattttctcctaaagggcattcaaaataatttacttctaacattttatcataaatgtttttcaaaaatacagaaaagttgaaaaaaccatcttgattccatcattgctaacattttgctacatttactttattacatatctatgcacctattaatccatctttatttggatgcatttcaaggtaaactacaaacgtcatttctcaatcacatgagtagataacatagctttttgctgagaagaggaaataaactttctataggagacacaaatagggaataaaagggacacggagttatttttattttcttctttctctgcatgcattttggatttttttttcctttctcccagtttttacaacaaaatagaataggaagaaaacccctcacaatcttactaacgtaacacatttaaaacattaacatagctattttactttttaaatttttccttctaagttatatttatatttcatgtgtgtctttaaatagatgtaattatagatacaatttttgattctgtatttcttacttcatatatcaattttctccctacatgagttgaaagtctttgtgattattatttttaaaggctacctaatattataacaggtttaatggctacctaatatatcataattcttaaaaatttagattttaatgtttcattataataaacaatataacaagaaacatattcatgaagatattttccccttccatgatcttcacaattattttcccaagacaaatttttagaaatggaaatactaatttaataagtgtatttttatgacttgatgaatataatcaaataatatcctagaagcactatactaacataatgagtggctttaaatgttatatttatatttttccttattataaaagtaatttatactgaaactactgaaaaacgtaaagaatcccaatgcccccaaataacaactgcttatagtttggtaaaatttcttctgtattggatcacattaccatgtttatttgtcaatcgttatttcttttgtgaaatgtgtgtctattttaaactttgaatgtagcttaaattattagtatgtaaatagctctttaaaaattaagaatattggctgggcacagtggctcacaactgtaatcccagcactctgggaggccaaagctggcagatcacctgagatcaggagttcaagaccaccctggccaacatggtgaaaccccgtctccacaaaaaatacaaaaattagccaggcatggtggcaggtgcctgtaatcccagctacttgggaggctgaggtagaagaatcacttgaacctgggacgcagaggttgcagtgagctgagattgcgccactgcactccagtctgggtgacagagtgagactctgtttcaaaaaaaaaaaaaaaaaattaagaacattaacttgtctttttgttgaaaacactttcctccattttgttacctagattttaactatttacaatagtttttgtggtttttgacttgagtttaatattttacgtaatcgagactgctactaccctttgtaatttcttatattgattttatgtttcaaaaatattccaaccaagctgactaaaaagcttatattttcatcttattaaaaaattatttttctcaatgggttctttaaatctcttaggaatgtatgctgacatatacaatgatgaaaattattttttcccaaatagtatttcccattgcattataaaataacaccgattcatttttcattagtttgtgatgccttttatcatataaattttcacatagactaggatctatgttttagagttattctaagctctattatttgtctatcaatttgtattatttttactgttattgctttatatgctttaatatataattgtagggcaagtcccctaccctactttgctctttattttcaacactttcttcgctgtttttatatatttttgtttgcttagtttggtgatgacaaattaaaaataaactacttgaccaaatagttgttagatatgtggttacaggaagtgagaacacaagtggctctagggtaaaatgtgtctaagagaatatacgaaatataaagaactagacattaatctttttttccaattatttctatcgacaattatttttaaatttaaaatgtattataaaaataataatgcttattacaaaaagaaaaaaagaaaagtaaaaaaaaaaccattgttagtactttgggtgtatttcctttcaatcttttaaaaatgcatcttttttccttgatacccaattgaaaccatagcatatatttaattttttcacctagcacaataatacatttttgagttagttttaatttataatttagtagcaacacatactttaaattcttctatatattactaagaatttaatggttaaaaggtactcaacaatcatcaggaacaaggggttttagtttgaaagagagatacctatctaagtatataccatttatttaagcaatagatactgactaaatagcactatacaaacctggcaccctgcttatcaattaagatgcaaaggtgaaacagactcagtctgttcacaatctagcagttctaggtcatctttatgaatttacatgaatgaactatgttgtaattcacaaaatcaatttcagtttttaataaaatattagtgatatatctgtatttactctgattttgaatattaccagactccaattttgaatacaaacaactaataaaagaatgatcgttttagccttattattcctggttccaaccaaaataaacgttttaagtcaaccaaagtcagtactttaaataactggaggaaggttctggagagaaagatttaattatattattctagtaccttgggtctttttctgtgtaaaagcgttcattacgtttgttatcaccaaaagtggctcgatatacgtcatgacagcgaaggttcctctggaaggtgtagaataaaacatcttcatcttcctcgtcctttacccattctgaaagaaaataatgagataattatacataatcacctacactccattaaaaaaaaaaaaaaagcacagcacattctaattttgaatgccagtgagaacatgtgcaagtttatccctggaaatctaaatatttgactgtatctaatctgtgctgtatataagccagagagctttcctgagaataaaccactactacaccattccaaggtttcaagtagttatcagtctcagggtactcaggtttctaaataagagctaaatgctcaatatttaggaaagacattggtaaagtcacatttgcttttaggaggtgaattccgtctcaatctacaacttgaaactgtaagtctgaaggaatattgcatctttctctcatgtgtaaaccttctctgtctgctttcaagccacaggatatctccaactaccaaacacaatttaatgctgattcttgatcccaccagaagctgtcaacagaagtttgcacacaattacaccatgactgccacctggctgacagtgattgtaagtcatcattgtataatatgcaccatgattttaaaggttataaaatgtacaaaatatatgtcttagaattcaatagttagggtataatttcaattcactgcaacaacatttagttaaacaatggagaaaatgatggctgaaaatgaaaagggaggacaaaatgtaacatatgtaccactcaatgataaatttaaagttagttctattactaaaaatgtcacagcttccattgataaacaggttagttcaacacataccaagttctttggtagtgactttatgctgtaacagctctataagataacatgaaattaaaaaaatacattcaagcttaaagttgaataaaatattaagatgcaacttacgtgtaaaaatttattctagataataatttggcaaataattctgataaatcaaaacatattgtatgacatggactctaattataacacttttaaaaacatgagtattttaaaattacccatctagatatataattaaataagggaaggtctcctgaataagaggtacataggaagatgtatagtccatagggatacatgaatcaggcattcaccttctccctccctcacatgcgacaaaaaaatgtttcaaaagtgttaccgttgcctttcaacacagaggactattttggttggtggcttaccaaaactggacacattcgggaaagaagcttccattacgggctgatcgctgagctttataattacacaggtagatgcttcagaatcttcagttcttatcttggcagccacatatttttcatctggagcaactctgatacaatcaatgaagggctggtctaacttaagttcctccaaattgaataaaacttcataattatcattgtctgctgtataaagaaaaatacgaaagtgataacttcaaaggatgtactttaaaaaattaaaactgtattttaatgttttaaattagaattcccattctgtaagaggccatatcctagcttctttcaacaatgatggcagcttaacttgcacatcaactgacaataagttatttaatattaccttatactattcaatactattctgtgcatcaacctatgagacattatttgatattgttatagtctagtttagtatttacagaccatacagaacctagaaagtaagtgaatataaatgacaatcaacaatatatgccaagtgcctagcatagtacccaagacacagcagatgctcaaaaaatgctggatgccgtctccattctccctgccaaagcttctgagtctaactatatcttacacaaacccagatattaaaaactagtcattaaaaaaaaattcagaaataatctttaaaaaaatcttttctctatctttgagaaattaataaatttcctataaaaaatatgaaatctgaaaattagagcacgtaaaaagaaaaattgtggtgtaccttcttcatctttggaacgaaccaagcaacaaccttcttggtaataaacaaaaccaccatgtttaacctgacaaaagaaacatgcagtttacttaataataatttaattaaccttttcatagtctgactattcaagatgaagatgaaatgaagactcttataaaaaacagacctgttgaagtatatgaatgaacacatatgaaatataaaattgaccatttttacaatgtagttgataagatatggttttcgtatgttcataaccactagaggggtttttaatacataaatacaagaggcaataaagaaaaggtataacaaaatctgtcagttctcacaactgtacaaaccacttctgctacattttagaaacatctgatacctgtacagtgggagtcaattaacagaaatcaagtggcatctttaagacaatccaaaatgatgcagatgaggaaactgtggctcagactagcctgaaaacccagtctataactttctgagactccttcctttaaaatatgctgtcaccaacaactatacacagtcttgacttaacacaaactatttcacctgctgtagggtgacaaatacaatttgaaattgagagaattaatattacccaaatataaatagtgttcttgtctaatgcctacatattaaatgtaattgattggttgatatgatttcagtggcttacgtttattatctgttagttggtggcgtaatttgaatctggagatccttattcttaacctactatttccactctactatgtatgtgattttcacctattgcggttcaattttccaatcttattgaaaaattcaattcattttttcttttttttttgagacagagtcttgctctgtcacccaggctggagtgcagtggtgcaatcttggctcagggcaacctctgcatcctgagttcaagtgattctcctgcctcggcctcctgagtggctgggactacaggcgcctgccaccatgcctaatttttgtatttttagtagagatggggtttcaccatgttggctaggctggtcttgaactcttgacctcaggtgatctgcccaccttgacctcccaaagtgctgggattacaggcgtgagccactgcacgcacagccctcaattcatttcgactgactatttatgactgtgataaccataaaatggttaaacagatacttggctttcatggtattatactacttaaagtgaattccttttattaaaaaatttagacaaaacaatcaagtaattttcaaataataacaaagtatgaactactttcatttgaacttctccttagaatgattaaaaaatttttaaatcagtgctgggcatggtggctcacacctataatctcagcactttgggaggctgaggtgggagggttgcttgagcccaggagttcaagatcagccagggcaacacagtgagaccctgtctcttgaaattttttttttttaaatcggaactgattgtttgcaaaaaccagaattaatatattacagttgaaaattcatcttactttcgatctttacatttattaaaagatgtaaaggatcacattctgtgatcacaatctctgaaatctttgctttttaagtttttcagcatattttaaaggccaaaagcagtataatcttgatgtggactatgtctctaaatcaccaagtatctcatttgcatcttgattggtaatatcaaaaatttttttttaaagacatgagatatcttacttccacattgatgatttcatattcttcttgtggctgtgtttctaattttgttctcactttttcaaatgcatccatgttttctggaaggggtttttcgttttcttgtttaacaggctgaagatcctggaaaaagttttgttatgatcaaaatatttcaaactagggaaaaaaaacttttgctttttaaagataagtaggtctataccgtagacttaacgttgtacaaaaaagaaataagattaaatagtaggtatttcacagattgtaaatgttctttcctaggctcatcaataaaatgatctttttcgttaaaaaaagtaaacaaagtaagatagacatttgatggttatactattattttagatgaataagtccttaagaagcaggaatactaagaagctcagaagaatgttcagaaatactatggggaaaatttatacacaattaaggagaaaataaaattccatgaacttttacatatttaataggaaaatcaggtagagaaaaaaatctttcgcgtttaggaagtactgaagtacttcctaaaagaagggaaatatcaaagaagtggaagacattatcactactaataaatgttcactattattttattcacagccagagtgataagaaatatttccctacttcattaactataattttttactttttaaattttttaaatttaaatgggtctgagaaccaagggatataattttcttttcttgtgggaataactaagccccaaaacagaactgtttatcacatcaaaaagtaaactggcgaggcgcagtggctcatgcctgtaaccccagcattttgggaggccaaggagaatggatcacttgagcccaggagctcaagaccagcctgggcaacatagcgagaccccgtctctataaaaaaatacaaaaaaatttagccaggtgtggtggcacacacctgtagtcccagctacttgggaagctgaggtgggagggatcacctgagcccaggaggttgaggctgcagtgaagcatgatcatgccattgcactccagcatgcagagtgagaccctgtctcaacaacaacaaaaaaaagggaattaatgcctaatgaaacagagcttctttttcagtttctttgaggaaaaataacatgttcactttatgaaaggaagaaccaggaaaaataatagaaaataatgaacatgagtggagatatagatgaaagctaaataagcattcactgtgtcttatcaagagtgactaataagctgacagctttatttgagttctggtaagcaaattaatatcatataaatcattacaatttggataaagcaaaacctgttatcaaatttaaaaactgtttaataattcaacactccagtggtttgccttgtttaagcaaaaggattctggccaagatattttacttcagctctctgccaaagatgacaattgtacagtgatttgtaccagaggggggacttaagtctttggtaaggatcgccaacagctggaaagtatttattgcataaaatatgtccatgatactttaccaacattgtagagaatgtaagctataaatacagtttatattacaaagagtttacaatctaaaattaaacacaagaatataacggaaaaatcaccaaaacaaattaaatggaaaataatcattttcacaaaggttttccttttagatttttttgggacacattattatttgaattagattaaaattagcaataatggttgttatgatagtctcaatcatttagcctctacttactatcatataattttctgaattttttttaagagacagggtctcactatgttgcccaggctggactcaaactcctgggctcaagcaatcttcctgcctcagcctcccaagtagatgggactatagataggtgtgtgcctcctcattccatacagttaattttttgagtaattatttgaagatcaaatactggaggcttatatatttatttttcattcatttttaaagcatttctacaaaatctacagttgatctttaaagtggtgagacatgatatctgtatcaataatcccctcatatcaccatcataagtcagaagatgactaaaaatctattctgaaactgtaaaatagcaataggagctgcctttgcatttctagattcaggattgtctgttctgtaatttccattaaaacttttgaagtagagtcaggattatctctctactaccctgtagcttctagcacattctaggtcatggagctgggttctgtcacttttaaatactcattcttactgagagtcatagccaacacagagccaaaagcaacagagcgggctccaaaactcatcttcttaactttacattccttcctgattaacattttttctgtcatatatccaaataaactgagcttatctgaaccaaaataactctgaaagcaataggatttttgactcccttaacgaaattcaagcagaactcaacagctttctaagtaactcttctaaaggaattactcccatggaaactgaggttttatataatattcattaagtactccaggttacttttggtttttgttgcgtcccagggatacctgctcagtgttttaagctttcatttcaatttcagctagcaatatcattagcgtacacagctaaagccatccattttagccaggtatcttagtccagttgtttcaaaggcatatactacccaatggagctgaggtaaggatggctttaccttcagattttgagaaggttactggtacagtatcactccattagtggtaaaaagaagcactccttcccactccccaagtgacccaccactaaatcattttaacaatgaaagctgttataaaatagaaggagaatgatatgtgttaactttatcatggcaaagatgctgaactctaaagatagaaaaaatggtgaagtagaaagacaccggacagcccttcagtcaagactaattagccattagtaaatggctaattctaaggctagagcagggagaaaatacatggtaggtttgggaaatcttatgccagaaaataaggaagtgctcaaagtttaatggagacatgtcaaaagaatacaagtgtcaactgaaggggtttctacaggccacattttggacaactggagcctcaaaaagaataataaataataaataatacattgaaaaaacataaatccacagcaattgaaaaacagaatgcaatatgaagcatttcaatttaggaaaacagaaaaagagtaagtcttaaggaagtagaagaaaggtaagaaaattaatttttgaaattaaattgataacaaagaaactaaagagaatcaaattaaaagttggttcttttagaaacctattaaaaaacaaacatcacaaaactgatagaaaaaagaatacgaggccgggcgcggtggctcacgcctgtaatctcggcacttcgggaggccaaggcgggtggatcacgaggtcaagaaaaaagaatacgaggagagaaaaaggcataattacagatacaacagagatttttaaaaattacaataagctttatgtgaatctatttgaaaataaatgaaatgggtaattttccaggaagaaaaattaccaaaattgacccaagaaatagaaaagctatataagtcactaactcttaaagaaattaaattgctaactaaatgtccccttcttgaaagaaacaccaagcccagatgctttcaaatgtagctttcttggatcttcaagaaacagctaatcttttcatacgtcaactatttaaaaaaatagtaaaagaggtaaaactactcattttattaggctaatataaccttgacatcaaaattagacaatgatgatatgagacaattaaaaaaatcaatcttattctaaaataaaacttgataaaatcaaatttttaattttaaaaagcacaaaataagaacagtaatagtaataccaattaaacttaatgtgaccaagaaggattttttcctaagaatgaaaggatggtccaacatcagaaaaaaatctatcaatgtaatctaacacaaataaaggagataaatcttagagccatttttgataaatgcagggaaaaaataaaaaataatcacactttaaaaaaatgataaaaccttaaattaggaatagagaggaacttccttaatagtttctgtcagttatcttacacagaaatatactaaatctgtaatcaaaatacctgaaattaattcatattagcatatacatggtatttagcaaccatgaaacaccaatgagatttccaaaattttaataatgttcatgtaaaacaactaattgtatttgctgttaactcattttattttttaaaagcaactgttaaatgaaggaaacttgttcctttcatcttctgcctccaattcttctccttaccccttctctagagcccagacttttgctcttcttatgccactgactgctcctgtcaaggtcactcaatggctaccacattgcaaagtgcaaaagttaatgttcagtattcatattacttgacctgtcaggatcatgatacaattgatcacttcctcctcctaaaaacacttttctttacttggcttccaggacacctcattctccttgttttcctcttacttcactggcccttccttctcagtatctttagctagttccttctcaactccctggctttttttttgtttgagatgggatttcggctccctgcaacctctgcctcctgggttcaagcgattctcctgcctccgcctcctgagtagctgggattacaggcacttgctcaccacgctggctaatttttttttttttttttgtatttttagtagagatggggtttcaccatattggctaggctggtctgaaactcctgacctcaggtgaaccacccgcctcagcctcccgaagtgctgggattacaggcgtgagccactgggcctggcatctccctggctttttaacactggcagagctcaattcctgcactaagtacttctcttctttgcagtctgcactaattcccttggtgatctcatccagtcatgaccttaaataccatttatatgctaaggactcccaaatttacagctgtagcctgaacaatcctgaccaagatgaacttgtatatccaactgactacccaacatttttacttagatgtctaatatgccaaaaaatgtccgaatctgaactttaaatctccccatatatccctcgccctattaaaaaaaaaaaaaacaaaaccctgttctccaggcaatctttccaatttacataaatgacaaatctgtcctcccagctactcaggcttaaaaacattacagttggatttgtctttttctcttgccacaaacaactggtctgctaaatcctctcaattctactttcaacatatatttagaatctgaccacttctcacacttggactggactacttggctagtatcatcatcatttctcccttggattactgcaaaagcccaaaagctttctctgcttctgcgcttgcctcctggtctattttcaacaaaggagcttgtgtgagtctgaagtcagattatgttactccactcaaaaccctccagtggtttcccatcttgctcaagaggaaaagcaaaaattcttacaatggtctacaaagtcctaaagaatcttgtcccattacattgctgacctaatctactgctacacgccaagcccacttattccagttaatccatacttgatgtttcttgaacatatcaagcttgctcccatatcagtttcttagaacttgggccctatgcccaaatacctccttaaagctattgctcaaatgtcatcttctaagttaggcctttcctaaccattttactaaaataacacccctccctatccccacactgcctattcacatcttccccgtcttttttttcttttcttcttcgccataactatcgcttttgacccactttgtatttcattcatgtaattctttttatttttttgagagatgaggacttgcttgtgtccacctcagctggagtgcagtggcatgatctcggctcattgcaacctctgcctcctgggctcaagcaattgatccttgatctcagctctcaagtagctgagactacaggcgccaccatgcccagctaatttttgcattgtttgtagagacagggttttgccatgttgcccaggctgttcttgaacttctgggctcaagcaatgagcccacctcagcctcccaaagtatattacaggcatgacccattgcacctagccttgttcatgtaattctttattctttctcttttcctttctcaagtaggatggtaagcttcacaaaggcagggatttttgtttattttgttcagtgttatatctccagtgcctagaatggtgcatagcaggtgttcaacaaatatttgctgagttgaataaaattcagacagcataaaacataaaatgaaaaaaacatatttaacaaaagatatcacaaagtgaaaaaaataataatagaacaaatatggagaagatatctacagcacatataaaagacaaaggacacgtaaagaaatcttatgaatcagtaagaaaaggacagacaattaaaagaaggtcaaaagacaagaataggcattcaagaagaaaaactataggatcaataagtgtaagaaaagatgctcactggccatgagtggcagctcatgcctgtaatcccagcactttgggaagctgagacaggaggattgcttgagcccaagagcttcagaccagcctgggcaacatagcaagactctgtctctatttaaaaaagttttggattttggagcatttcagattttgtattagggatggtctacctgtactacaagatattaaaaaagaaaggtactgtgaatgaggctaacttaggtctacttctgactctactagttttcttacttaactttaggctctgtggctttagtttcttcatttgtttagaaagaatacacacgcttcctgattttaagacttattacaggccaggcgcagtggctcatgcctgtaatcccagcactttgggaggccaagttgggcagatcaccctgaggtcaggagtttgagaccagcctggccaacatggtgaaaccctgtctctactaaaaataaaaaaaaaattagctgggcatggtggcaggcacctgtaatcccagctactcggggggccttggcaggagaattgtttgaatctgggaggcagaggttgcagtgagctgagatggcaccactgcactccaacctgggcgacagagcgagactccatctcaaaaaataaataaataaataaataaaacttattacaaagctatagtaattaaatgtgtagtactggcataacgacagacatatacaaaaatgagatgaaagtgagagtcaagaataaaccattgaatttatggtcagttgattttcagaaaggacaccaagacaattcaatggaaaaagaacactcttttcaacaaatgttgctcagacaatggatatccacaagcaaaataataaagttgtaccccaatcccttgcactataaacaaaatgaactcaaaatgggtcatagggctgggcatggtgggtcacacatgtaatgccagcactctgggaggctgaggcaggaggattacttgagcttaggagtttgagacaagcccgcacaacaaagtgagaccctgtctccacacacacaaaaaatcaaaaaattagctgggcatagttgtgggcccagctacttgcaaggtaaggcaggaagacagcacgagcccaggaggttgaggctgcagtaagccatgtttgtgcctctgcactccagcctgagcaacagagtgaggccctctctcaacaacaacaacaacaaaaaaagtatcaaagacctaaagaaagagctcagatgggatgatttctggggtatgttttctagcaataaaatttatggttatatgaaaagaaaaaatgcattaatttaactattaattcattctataaacacgttgcttatctacaatgtggcagtcgttatgctatgtgctggcaagatgtgtattataaaattcttgtctttaaggacctcccaatataatggggagacaggaaaagtttaaaatgatgtagtaatagcagagaggtaaatatagtgatttgactcctatggcttcaactactatctacatgtaacaactctccccaaattccagactcatatatccaactgctactgaaatctccactttactagtgagttatatttatcctttcctcctctcttttttttttttgagatggagcctcgctcccatcacaccaggctggagtgcagtggcacgatctcagatcactgcaatctccacctcccgggttcaagtgattctccttcctcagcgtcccgagtagctgggattacaggcatgcgccaccaggcccggctaaaatttttggattttcagtagcaatggggttctgccatgttggtcaggctggtcttgaacttctgacctcaggcaatccacccgcctcagcctcccaaagtgctaggattataggcgtgaggcgccacgcccggccttcttcacccttaagatctgaatatcagtaagattacatacatgactgtgaaataagtccatctgaaacataaagataaaccaggtacgttttagaattttgagattttggaatgttaactgggtaccttatctcagtttacaggggaacaacactctaatcaaatgcagtaacattttagagctaaacatctactaattgggataaagatcataatagctttgtgtcagtttaggtcaggttttgcccattctcaacagcctccaatcagttaaaaaaaatcatttgttttctaacaggcttttggattttagaatccaaagagatgaggaattatcactcaagctctctagtcttccattaagatgtctcaaataaaatgtaatcagggccagctgcggtggctcatgcctgtaatcccagcactttgagagggcaaggcaggtggattgcttgaggctgggcttccagaccagcctagccaacatggcgaaaccctgtctctacttaaaatataaaaaaattagctgggtgtggtggcacatgcctgtaattccagttactcaggaggctaaggcacgagaatcacttgagcctgggaggtggaggttgcagtgagcagagactgtgccactgcactacagactgggtgacagagtgagacactgtctcaaaaaaaagcaatcaccctgtaaagactctcatcttcactcatctgagttactgacaaggcttcctacttccaatttattctctattctgtcagagtgattcttctaaaatgcaaatctgattgcgcctacatttttcaataacattctattgcttaaaaggatgtagctcaaactttttgcaagatatacaaaactacatattatatatatatatatatatatatatatacacacacacacacatatgaatatgagactattgcaggagctgctaacctgtattgtagaaataggcaaatgacatgtttaaccaaaggatttagtcttctctctttaattatacaatttcattttgtatcttgttcaaattatcactattaaagattttgggaattattttttaggcagagcagagcaggatgatgtggaagataaagaaatgtgatatctggatggatggatgctagtctttgaatatcactggctggcttgtaagtataatagagtaagttcatcttgccatctggctaatgtaaaatggaaagcagaggtacttgccaataagaactgcagaactgaatgaattcaataaggtttagatcggcaacacttgatcatcaaacatttccaatttctaaattcaggtccagtgtcagtcaagttgtgagttccagaattacctgatgtgaacttcaaaaaacagatctggggccgggcatggtggctcactcctgtaatcccagcactttgggaggccgaggcaggtggatcacctgaagtcaggagttcgagaccagcctgaccaacgtggtgaaaccctgtctctactaaaaaatacaaaaaaatttagctgggcatggtggtggacgcctgtaatcccagctacttggcagctgaggcaggagaattgcctgaatctgggaggtggaggttgcagtgagccaagatcatgccattgcactccggcctgggcaacaaagcaagactccgtctcaaacaaacaaacaaacaaacaaacaacagatgtgtaggcctcaaccatagagattttcattacgcagatgtggggtgagatccaggaatccgcatttctaaaaagctctccaggatttctgatatacagttagactgcagaagttgatactgaagagtccccaaacttttaggcagtaatttgttgctaaggtaacaagaggtatagaatcatgaaattttagcacctctaagactttctacagaatgacaagttgaaactccctatttttttttttttgagacagggtatccttctgtcacccaggctgaagatctcactgtgcctcaacctcactgcagcctcgacctcccaggctgaatcaatcatcccacatcagccttccaagcagctgggattacaggcgtgcgccaccatacccagctaatttttagtctttttggtagagttggggttttgccatgttgccaaggctggtctcgaattcctgagctcggacaatctgctcgccttggcctcccaatgttctgggattactggcgtgagccagtatgcctgatcagaactccctatttttttcagtcaggaaaattaggagtcctgattagttcagtcacaccaatcgtggctggatcttttgccttctaacattcccactacacatgctacttttctgttccttagttaacttatataggtaatagctctttaagcagacattttaatttacctaaaagcagtaactactttttctactttattacaccctataaaagtggacagagttggaaatcagtggatgcttgctgaaagaaggaaatgtgcattcttctctacaggtgttttcacagctgccggggcatctttataaagcttccccaggtctcagtgataaagaccatggcttttacattacatcatttctcatagagggaatggttgatacatgacatgtgacagcaggattactttatcaggtaaaggaattactaaatgaactattaatacttggagttattgagtcaggttaaagtttccaggtagtgggaatctataaaagagaacggaaaagttgcttcaggaacaaatggagggaagaaatagtcaaccttctgtttagaatgtgagctaatatcacagctgttactctgatggtaattcctgtctactatttataaactaagtgttaagacaaagtacgacatgacaaaatgttctaaacacaatgcaaaataaaataacctaaaggtccaaaatttagttcaataggtgaaattaaaaattttatctttctgaagtaggaaagatgtacaaaaaacacaaaaatgaaataaaaagaagttataaagaatttctaaatgagtaaagaaagtactaaactaaggcaagacactacaaaaaggaaaagaatttcaaagactaaaacataaacagtaaaagtctaggaagactagggggctaacatataaaatgttaaaagcaaaagagacacacacaacacctaaataggtatcagctaagatagcggcaaaaattgaacaaaaactagaaaaactgagaaaaattagattgaaaagatagtttctaaaatgagaagaatctgcccaagtgtccatcaattacaggaatggataaacaaaatgtggtttatacatacaaaggaatattattcaactataaaaagaaatgaagttatgatacatgcatacaacacagatgaactttgaaagccactgaattgcatactttaaaatggatcaagtggaaaactttgttatacatatattttacccgaagaaaggaggaagccaaaacagactaaaagaaaaatcagtatgcgacaaaaccagaaattaaaataaaaaaaatattaaaatcataaatttgtgaaactattgcaagaataccacccccaaatatcattaaggaacctaaggaacataagaagtaaaaggtaggagagggatgtcaaagcagcagcagcacaaatagatcatttaatcctacttactgtaggatgaccatataatttaccattctaaccaggacacttttgagaggaaaggggacactattaataattacacagggacaacaggtgtaggctggagctgtgccaggcaaaagtggttatgtggttactctctatataagggcaatcaggtccttaaggttgagttcacgcccacagcttggggtctggcagaagtacaatactctgacagtgtcttcctgaatgactcaagtggtcaaaaacgcaagattatttttcatttttttacagagaaataaaatacaattcatggcctttactgaagtttactgatttgtgattcataaaacaattagcgtatcattagattttattaagagctataatttagtgttctaggaaatttagaaggccgaattatactttgaaatgcactggcaggcatactaaggaagtcctgaggtgaatcattttttataaacctacatttttatatattacattagagccctataaatatatgtatacactttttttttttttttttttttcagacagagtctccctgtcacccaggctggagtgctgtggtgcgatctcagctcaccgcaacctctgcctcctgggttcaagagattctctgcctcagcctcccaagtagctgggattacaggtgggtgccatgacgcctagctaacttttgtatttttagtagagacagggttttaccatgttggccaggctggtctcgaactcctgacctcaggtgatctgcctgcctcgatgtatatactcttttatacttacttttgactagagacaattgagacttgaaaattagaaaaatcaagttagaattactgagaaaattagtagctctgatattctacccattctttatttttaaattaaaattaatcttaatgacctacaaataggttaacttaaacagtccataccttacatgagaagctccgacttgggatgtttcttgctaactctgatatcttgggtttattctgaagacacttggttaggtgatattttttcaattttattctattgtaacaatgatcagcgaagttatagtgattcaaatgctgtttctgcatgcattttccaaggtgaggaatactatacttcaaagcttggagaaataatttggtcttctgctgcatgatatcaaagtccctggtttatgctccttttggggctgccagcacacgaatgattttataggtatgattacagagtagtgggttctcagagtaactaagatcagcagttctcatccctccttttcagggccatgccccacttaggttatgaataacttcagacagctgataacttaggctaactaaatctaaaaacctgtgtaagttaaagtttcattcaaatcataattcttggcagatgtgacttaaatgtctcatttgtaaagttaatcctatcaggctcaaactatgcagcactgactctggcacacataggggttaaactaaaacaaaaaacaaaacaagaaacaaaatataaatttgcaaataagtacacagacttaatggggtatctcaggaactcagggctgtaaaaggtaaaaagccctttggtcttacataattatgaacgtatctttggtatatatgtggaagataaactggaaaagcctaattatttaataaaggtgggggagggaagattaattattgttgagtgttaactaactgccaggtgcttttatcttgtttgtctaatttaaattttatatggacttaataaagtagatattaccatgcacattttacaggttgccaaactgtggctgtgggaggttctaagcaactgttccaggtcacttgtacagtaagctgtatagcaaaaaatccaatttggttcggttccaaatactggacatactcaacttcggatttttaatgttaaaaaggtatttagcgctttaattaaaaacaacaaaaaacccctgcaagatgcacaaataaaatgtaaggccatctctggtttgtcaggaggtagcttttattaaccttgattgctaataagtagttaagagtcagagagacctgggttgaggtcttagctcctacacttaactgtgtctccgggcctcagtttcttc
